United States Patent 10,724,096 (METHODS AND COMPOSITIONS FOR INHIBITING AND TREATING NEUROLOGICAL CONDITIONS) - sequence listing, part 69

SEQ ID NO: 1511 - DNA, 697947 bp, Homo sapiens
aaataaacgtggcgggacgtatgtgtcatggcgctctccatctaaagtctgtgcagcttccggagagtggcgggttgattttctcactttggactggtttttacttcccgacttctgggtaagggtggccgatgggtccatgtggggcagagtgtggccacagctccttttatggccaagccttgtttctccagtttcagtttttcttgggctgtttgcaaatttgtttcgcagttaaaaggggatttgccagctgggatgggggaattgggaggcagatggggcttccaggagcgaggatagggtcgttggcctcaggtgccgctctccagttaggagtattttaggcacctcgttccttattgtcaggtttaacttcatttgttctcccactttataccttagtgaatttgtagatgtgacaaggctttcgcagttatatagctttcccagatcagtatgttaagaatttaagcagaagttattgagaaaagcaggtgtcttgctttttcacttttcgttcttctttgctcataaaacctttttctgaatctcgggacgacagttatctttcggatggaacgtgatctggatgtctatctaccttattgacttaatcctgttttgtagtggttggttactcgcactatgcagacgtgttgcggtgctgaatacaacatttattactaaagccagacactggatcaccgtcacggcagatgtcagcacacctgttgtaatcagtaagaagttacaagtagtatggagcatcattaatcctgctgtataaagcagtcttttatggagtctgattccttttaagtaaagaatccttacagtggttttgtgaactttttgggtgcttacttttcctaatcaatttttattttccagactcatctttcaagaggactttagactaattgcagataattaaggtactgatttattttaaaccttttatgtttgagtgctgtgcgtatttctgcatgttagaaaatgcagagaggtagcctaatgttttagctatttgccactatcatgttatggaaacattgtgctttacatagcattaaatcgaagagatattttcatttattttacttaacctttcattttcattcaccagcattgaccatgtccacttttttgagatgcccttttcatttgccttccatggcccatggatttttttccttgtctggtggctgcttcttggaatccattataagctgattttcctttatctggcagttaaatttggagtctctcaagtcgtggtcttgtaccttctcctacctctgttctctttttcttcccctctgggtgatgtaatccacatgcctgtcaacagttatttgtctttttgattctacccatcctaatgggtatgaagtggtgtattattgtggtttggatttccatttccctgatggctcatgatgttgacatcttttcatgtgcttatcagccatttgtatgtgtgtgtttttgagacacggcttccctatgccacccaggccagagtgcagtggctcgattacggctcactgcagccttgaccacctggtctcaagtgatcccacttcagcctcccaagtagctgggactacaggtgcatgccaccatgcccggctaaattttacttttttttttttttttgtagcgatagggtccgtgttgcctaggctctggccttgtactcctggcctgaagtgatcctgccaccttggcttcccagtgttgggattataggcatgagcctctgcacctggcccatttctgtatcttcttcatctaatctgtttttccttttgttgcttgtgcttttcatttcttagctaagaaagaagggcctactctaacatcataaagatttgtgcttatgtttttttctaagagtttcataatgttagctcctaaatttaggtctatgatccattttcggttaatttttgtatatgatgtgaaatgtgaaatagggctccaactttattttttacatgttgctatccagttatcccagtgtcatttgttgaaaaaaaaactacgctttcccccttgaattgtctaggttatgtatatttgacatacattctaggtggtttttatgaaagaataattctgggacagtgattatcaaactttaattcagatcaaaatcacctagagggcctgttaaatattgctaggttttactcaaaatatctgatttagtatgtctggagtggagttcaagaattttcatttctggctgggcatggtggctcatgcctgtaatcccatactttaggggccaagatgggaggagtttgagaccagcctggacaacaaagcgagaccttgtttttacaaaaaaactgaaaaagaaaaaatgttcatttctaacaagttccccatgatgctactccagctgatgtggaaactacactttgaaaaccactggacattgctttgcaactgtggctgtacacacatgagaatgactggaaagtttttaaaagatattgatgcccaggctccattctcagagattcattcagctatcttggggcttagttgggaattttcttttttttcttttgtttttgtttttgttttgagacagagtctcgctctgtcgcccaggctggagtgcagtggcgtgatctcggctcactgcaagcttagttgggaattttcaaaagctcttcaggtgaatagaatgagtgttgaagattgagaaccattactgtggaatcgtggttcttaattagggatctatagtggaattacctggacagtttctatgttcacatacttcagttctactcttggagattctaattcagaatggaacctggagatttgatatgatgaaaagcttcccgctgggtgcagtggctcacgcctgtaatcccagcactttgggaggccaaggcaggtggatcacctgaggttgggagttcaagaccagcctgaccaacatggtgaaaccccgtctctactaaaaatacaaaattagctgggcgtggtggcaggtgcctgtaatcccagctactcgggaggctgaggcaggagaattgcttgaacccaggaggcacaggttgcagtgagccgagatcgtgccattgcactccagcctgggcagcaagagtgaaactctgtctcataattacaaaaaaaaaaaaaaaaagcctccctaataactcacctatgtaagtaaccactgctctaggatattgcatcctccttcttcctatcattttgagtattttccttttcactgactctatttttattccctttatcaaatttgatttcctctacctttgagaaaaatttttaatgatccttttgctccatttagctattacgctgctttccttttattctcaaactttcatttccatatgatttaattaaaaatttctgaaggctaaacaattccctctatcagtctatcagtttgttcaaagtaaaacctttagcttattaatagtgatgagtgagattatttaggtacttatgatatacagccaggtttatgctacataatgctgatatgcagcgttatatttatcttttttgagtgaatatctccaaatgaaattgctggctcgaaggatatacatatgtttggtataattgtcaggttgccctccagaaggggtgtaccagtttttctgtgctttcagctaacagagtttttgtcagctttgtatcagtgaggcagctgaaaaataacttattgtttcaatacttgttgttagtgtggttgagcattctttcctctttttttttttttcttttctgggtatttgtatttcttaagtgaactgcctgtttttcctttacgcattgttttctggaatgtggttacttattagtgtcacattagattcttgcattgtttgtactttgccagtgaggcaaagccatagtgggaagagcatggtattgagaggatgccaaggttctgatttctagctctatcaatgtacaaatccttttgcttcagtggactccagctctgtaagataagaagcttagcaacttctgcttctctaactctaatgatatgggatgtctattgcagtggattcctttcattcctctttttcctttctatttctcttcagtggatccatacacacttgtatatgggatggcaaaattgtgtaattaaaaaatatggcttttaattaatgttatttaattattcatgatctgtcagtagttcttccgcattccaaaggcactacctggtcctagcctctctcatttaattatttcatagaagagtggtgatagaagaaatcctaggggttgggcatttacttcagcttcccacccagtgtagaatttcctgctgtgtcatagaaagactagctaaattcaacttaagcattgtgttcattcatttagtcagtaactattgtgtgcctgctatgtgtcaggcattgttagaggtgttgtagagacagtactgaaaaagagatgatgcctttgtgcttaacaagcttacattgtaatgaggaagatacaattatatatgtggtgtcaggtaggtaagcacaatgaagaaacatgaaacaaaagcagggttagaagcagtgaaagtgtgggcatgcttgggcagcgtggttattttagataaggtagtaggaaaggcctctccgaggagatgttgtttgagtgaagaagtgggtgggaagacatacttatctgggggctgatattctggcagaggaatagcaattatgaaggctcccgagtcagaaactaatttggcatactcagaatatctatatccatatattgcccgactgtgtagtctgcagtaaaagtatttattgagaacctgcaatgtgctagacatagttctaggcacctgggataaaacagtgaacacctcacacgaaaacctttaccctcacgaagtatgtattctagtaagataaacagttaaaaaattattaaaacattttaagcagatgattaaatgctacagtttaaaaaaaggcaggaaaggggcataggaagagggtgtgtggtgaggtgggggtgttggttggaaagtcctctcttgttacacttgagcaaagtccttaagggcttgagtgagtgagccattcaggtgtcttaagtaagagcattccaggcaagaataagactgtgaaatgaatgcatatctagtgggtacgaaataacaaagcctgcatgactgaggggagcgtggtaggaagtggggccagagatgcagcaggaggctgattatatatgtcattgcagatctttgtagtgattttggctttttactctgatatggaataccactggaagggtttgattgagaagcttgagatgaacttaggttttaaagggatccctgacttctgtgctgaaaatgttcttgtagagtttaaggatagaagcaaggatattagggattgcaataatccagacaagaggtgatgttggtttggaccaagagtgtaacagtgggtatggtcacaaatagattctgaatatattttgaaggtacagccaacaggatgttgttgattgattggatttagggtgacagaaagaggggagtgcaggatttttggcctgagcagtagaagattgggattgtcttttttttttttttgagacagagtctcactctgttggccgggctggagtgcagtggtgagatcttggctcactgcaacctctgcctcctgggctcaggcaattctcctgcctcagcctcccaagtagctggggttacaggcgctcgccactatgcctggctaattttttgtatttttagtagagatggggtttcaccatgttggacaggctggtcttgaactcctgaccttgtgattcacccacctcggcctcccaaagtgctgggattacaaacatgagccactgcgcccagccaggattgccattaaatgaaatgggagaagttgtaagaggatctggtaaggtagggagaagatcaggaattctgtttcgactttgactttttttttttttgggatggtgcttcgccctttgtcgcccaggctggagtgcagtggtgcaatctcagctcactgcaacctctgcctcctgggttcaagcggttcttctgtttcagtctcccgagtaggtgggattgcaggtgcccaccaccatgcctggctaatttttgtatttttagtagagacgaggtgtcaccatgttggccaggctgacctccaactcctgacctcaggtgatccatccgcctcagcctcccaaagtgttgggattacaggcgtgagccaccatgcccagccctgttttaactttttaagtttgaaggaattattagacattcaagcagtggtgtggaataggcagttgaacgtctgagtctgaagctcgggggaagaatggggctggttatgtaagcatagacgtagttcatatttcaaggccatgggactggatgaggtcacctagggagtgcctgaaactagagaagagttcctgtaacagagccatgggggcattctaatggtgagaagttggagagatgagcagaggagactggagctaggagagtgtggcatcctggaaactagtgcaatttcttactgcagttcttcagtctttaataatgcacactgtgaatgggtaaggacgcagaattttctaaatttatttgaccacagaaccatttttttttccagataggtagtaaataattagaagcaatttgggaaagactaacctggttcatttcaccctacctggatggctgagttggccagggctcttttttgcaagaacagaatacccacctcaaactgatttaagccacaggctcgcatgactgggcagagcagggctgcatttggcttcaggcatttgttggattcagatgctcaaataatgtcagtatggttctttatctttctagatcttattaggcttcattccttaagtaggcttcctccctgtagcagacaagagggctctggtatccccaagttgacatcctcccaacttagccacttcagtgacaagagaagctatcttctgttaacactagcgtagaatcctcacagtgattcttattggctaggcttctcatgactgaccttgaactggtcattgtggccaggaggatgagttaccctggcaagcttgggtcatgttccccattccagtgtctagggaaagggaagtctgtgattgacagtcttttttttttttgagacagagtttcgctcttgttgcccaggctggagtgcaatggcgcgatctcggctaaccaaaacctctgcctcccgggttcaagcaattctcctgtctcagcctcctgagtagctgggattacaggcatgtgccaccacgcccggctaattttgtatttttagtagagacagggtttctctatgttggtcaggctggtcatgaactcccaacctcaggtgatctgtccgccttggcctcccaaagtgttgggattactggcgtgagccaccgtttccggcaattgacagtcttaccatgaccacgtggtacgtatgttaactataatccagccaatccttgatggattgatgtttggtttatttctaatctttggttcttactgacaatataaagctagctgagatttgaacacagatttttcggatacccagtgcataatttgtcatagctgtaatgaatacattacagaggaaaggagcctggctggctgccactctgttaattgaatgatgtgaatggaaggatgggaatccagcaaatgagaaggaaaattcatcagaaagctttgaggacaactgaaagaatgtaagatccttaacactgcaactcagatgaggaacagtggtcattcaatatacacatactaagtaggtagtagagtaccacacagtgcgtgggcttggactcatctgtcatggtatccttgtttagcttctttgggcaagttaatttatctgtgtttcagtttgttcatctttaaagcgaggatagtaatactatctacctagtaagagttgttgtgaatggttgatgagatgaccctataaaggacttgccttgtgtctggatatagtattagtggtagtactatcagtaagtatatacgagtgtattccccccccatttttttcttaactattttattctaacataattaccgctttacctgcagttgtaaaacttatgcagagatccttgtacactttacccaggtctcccgttggtaacatcttgcaaaactacaatacaatacagtatcacaaccaggatattgacattgatacagtcaggatgcaaaacatttccatcatcacaaggattcctcatgttgctcttttatagtcatacccattctcctctcaccctgttctttctttaatccctggcaactactattctgttctccatttccataattttctcatttcaagcatgttatataaaagtgatcatacagaatgtaaccttttgggattgaatttcttcattcagcataattctcaggagagtcatccaggttgatgcatatgtcattagtacatttctttttattgctcaatagtgttccatggtatggatgtaccacactttgtttaaccattcaccttttgaatggcatccaggtggtttccagatttgggctattacaaagaaagctgctgtgaacattcatgtacaggtctttgtctgaatacaagtctttatttctcttggataattgcccaggagtacaattgctgggttgcatcacagtcatatgatttgtttaagaaaacaccaaactgtttactggagtggctataccatttttcattccctccaggactgtatgaatgatgcagtttctttgcatccttgccggtgtttggtggtttcactgttgtctgttttatccattctgaaaggtgtatactgatacctcattgtggttttagtttccatttctgtgcttatttgccctctgtatattctcttgaaatgtcttttgtcattttctttttacggttgtgttttgacactagttctttgtcagatatgtggtttgcaaatattttcttccactctgtagtttgactgtttgacttttcagcctcttaatagggtctttcttaaagcaaaagttttaaattttaatgacattcaatttattactttttctttttatggattgtgcttttggtgtcacatctggtaactttttacctatccctaagtccagaagattttctcctgtgatttttttctaaaagttttataatattatgttttacattttttttttttttttttttttgagacagagtctcactgtgtcacccaggctggagtgcagtggtacaatcttggcttactgcaacctctgccttgtgggttcaagcaattctcctgcctcagcctcccaagtagctgggattacaggcgtgcaccaacacactcagctaattttttgtatttttagtagagacgcggtgtcaccatgttggccaggctgttcttgaactcctgacctcaagtgatccacacgcctcggcctgccagagtgctgggattataggtgtgagccactgcgcccagcctatgttttacatttaagtctatgatccattttgaattaatttttgtataaggtgcaagacttaggtcaaggttcattttttgcctataaatgtctgcttgctccagcacgaattgtttaaaaagcaatctttcctccatttaattgcttttgtggaatatttgtgtaggtctgtttctgggttttctgttatgttccattgatctatatttctatccctctaccaataccacggtctcaattatagctatctaataagtcttaaaattgggtagaccaggccgggcgcagtggctcacgcctgtaatcccagcactttgggaggccgagacgggcggatcgcgaggtcaggagatcgagaccatcctggctaacacggtgaaaccccgtctctactaaaaatacaaaaattagccgggcatggtggcgcgcgcctgtagtcccagctacacgggaggctgaggcaggagaatggcgtgaacccaggaggcggagcttgcagtgagtcgagatcgcgccactgcactccagcctgggccacagagcgaaactccgtctcaaaaaaaaaaaaaaaaaaaaaaaaaattgggtagaccagttcttcttactttactcttctcaaaattgttttaaatatattagtttctgtacatttccatataaaatttaggatagtcttatctatacctacaaaaaaatcttcctgggattttgatagggattattttaaacttgtgtatcagtttggtctccactgacactgcaaaacttcattactggtcggttggttggtttgaatgtccaggatccctccaggtccttctctgattctacactagtggagtgtgttggggtgcttgattgtaggtagaagtccaagctctccccacttggcctttgtagcgtgcctgggggtgggattacagttttgtgtgtgtgtgtgtgtgtgtgtgtgtgtttgtgtttggctggagtagaatgattattatctaaaacttttctgtcttcctaggctgccctttgtatagttctttaacgagaaagcaggcttttattggggggttttattgttggcatctcttgccatttctgattgctgggatctttagtgagctgtaggaggcagaagaaaacccaaggaactcatcatattccttgggtcctgaggttcatagccagtctgccttatgcttgttttatatataatgtccagagttttatttgtattttgctggcggggcagggaaaaatgtgcttatcttcttgcaagctgtgtccacattttcttcttttaattataaaaattttgaatatttagaaaagtcgtataggataatgaacatgaacctatctagtttctagttttaagagttgtaaatgcttttcagtatgtcttaatctattttttcttcttttttgagatggagttttgctctgttgcccaggctggagtgcagtggtgcactctcgactcactgcaacctctgcctcctgggttccagcgattctccttcctcagcctcccaagtagctaaaactgcaggtgtacaccaccatgcctggctaattttgtacttttaaaagagatggggtttcaccatgttggccaggctggtctcaaacgcctgacctcaagttatgcgcccacctccccaaagtgctgggattacaggcataagccacccaaagtgctgggattacaggcataagccactgtggctagccagtctattttttctgaggtccttttaaagtaaattatagacataatgacatttcacttctaaatattcaatatgcatctctaaaaaataaaatttttgaatataaggacaatactttatatcgaatgatttataataacttcttcatattatctaatatccagcttatattctgatttccctagttatacccaaaatttcttatagcttgacagacaaagaagaaacaatcaagaacatgaactgcattttgttgttaggcttttacgcttcctgttatctgaaacagttcctctcctactttttcctacttgacattgatttgttgaagaaatagttcctgttgaaccttggaatgtcccattgtcattagggttttgtctgattgtttcattgtgtttcttttttcaatatacccaagatagtacttcatccttgtgtttctttatctcttgtattttctataaatttgaagttagatccaaaggcttgattagattcaaatttggtgagaatatttcataaatgatgctacgctaagcagattttcataagttgattttatttataacttttatgtggtagagaatatgccttctgcatcctgtgatacactactggatgacatcgaagatatcgtgtctcaggaagattcaaaaccacaagataggcattttgtaagaaaggatgttgtcccgaaggtacgaaggcgaaatacccaaaaatatttgcaagaggaagaaaacagtccaccaagtgacaggtaagcttttttccttgaaattatattcattttctttttttttcttttgagacagagtcttgctctgtcgcccaggctggagtgcagtggtgtgatctcggttcactgcaacctcctcctcctggattcaagctattctcctgcctctgcctccctagtagctgtgattacaggcacacaccaccatacctggctattttttgtatttttagtagagatggggtttcaccatgttggccaggctggtcttgaactcctaacctcaggtgatctgcccaccttggcctcccaaagtactgggattactggcctgagccactgagcacggccgaaattatattcattttcattccagggagaagctgacgctactggtctgtgtgatatatataatgtctcttcattagaatctttgaacttttgataggaaatacaagttgagtatcacttatctgaaatgcttgagaccagaagtgtttcagatatcacatttttttttttggatttcggaatatttgcattacatactttccagttgagtattcctaatccaaacatctgaaatgctccagtgagcatcctttgagtatcattttggcactcaaaaagtttcagattttagagcattgtggattttgaatttttgaattaaagaaactcaacctgtatgtagattttttttttatttgaatgattttaaatttggcaaggtaattggttaaaaagaaatgagatgtcaaattggatgttcctagaagatagcctcgggcaatagggatctcttgggtattactgtagttgatatgtaagtctgtgttatttccaaataaaatttttaccagagtttgtgattcttatgagacagtagtattttggacatttgaattttcttagctgattttcaaatacctgtggatcaggtaaaggcagtgggcacaaataaattattgccctatttacgctattatagtagatctctagtccgtgaaattttgatacaacctaaccagaaaggataatgtaattatatggttttaataagcctatatttgtttatctagtcaactgctgaactttataatctgcttattttgttgggaaactaagcttttaaattcttggaatttaaaatttgcttatattttaatgactgaagtttataaaatttgtcctaaatgtgtccttaaggtaatttttatttacttataaattattagagcaatccaagttgaaagtccttttttcccctaaaagttatttttagaactctgattttatagagtgcttttaataatgctttaggatgacggtttttaactttgattaagttacttatatctgtaagttttaaggaagctacagattgcaactagtatgtaggaatctgtaaacagacatacttttctttatttgccattgctgctagaaccactttctttcctattgttatttttgtgtacctttccaggagttgaacttagtaagttagtagtatgaatttaaaatgcaattcagagaaaaaggatatttttttatgtggagtgttaactttttagaattctgtggttattttatcttgattttagacttttgatacaacaacagattttgagttaagttggtgcgtttaatgaatagcttttgaatggattgtagtgagtttgttttttgtgtaatatatcttaaaatcatctagtggtttttattttaaaaataactcaatgaggttgggtgtagtggtggctcatgcctgtaattccagcactttgggagacaaggtgggaggatcacttgagcccaggagttcaagatcagcctggacagtatagtgggccactgtctctacaaaaaataagaaaaattaacaggtgtgttggtgcatgactgtagtcccagctacttgggaggctgagatgggaggatcccttaggcctgggaggttgaggttgcagtgagctgtggtcacacagctgcactgcagcctgggcaacagagcaagaccctggatcaaaaaaaaaaaaaatcactcaatgaaacttacttttttttttttattgattccttaacagcactattccaggcatacagaaaatttggatacgaacatggggttgttctcataataattcagatggagaatatatggctggacagctagctgcttatggctataaaattacaggtaatgagatctataatatattttattgattaaatttttcagaattaagcttttagagataaatagcctagcagttaaagggtattttagcatgacagtgattttaaggtgaaacagatagttattacacattttgtagataaccatggatgtcatatttaaaaaaactttttattttgaaataagtttagactttcagaaaagtagtaaaattagagagttcacatatgcccatcaccaagcttcccttgatattaacatcttacgtagttgtaatatcattaataaaccaggaaattaacattagtgcatttctgttatctaaactgtagatcgtatttgaattttaccagttttcccattaacttcctttttctgtcccaagatctaatgttgggtcccaccttacatttagtttcatgtccccttagtttcctccaatctgtgacagtttcttaattttttcttgtcttctgtgaccttgacacttctgaagaaaacatttccttgatatttctgatgaaaatgattattatgtagaatgtccttcaacttgaattggtctttttctcatgattagaatgaggttctgggtttttggcaagcagagaacagaagcgatactatatttttctcagtgcgtcatatcggggtcatgatgtcagtgtgtcttatactggtacactaacccatgtctgctaggtttctttccaatacagtcactgtttttctcattacaactaataaacatcctatttctcctcaacctttggcctgttaattttagtatctactggtggatcttgtctgcaacagttattactgtggtgtttacttaatggtgattttctgctatcttgttttctttacatttatatttatttatttatttatttatttatttatttatttatttactttgagatggggtctctttgtgccccattctggagtgcagtggcacgatctcagctcactgcatcctctgcctcccaggttcaagcgattcttctgcctcagcctcccaagtagctaggattacaggcatatgccaccatgcctggctaacttttgtatttttagtagatacggggtttcaccatgttggccaggctagtctcgaactcctcagctcaagtgatccactcgcctcggcctcccaaagtgcggggattacaggtgtgagccactgcgcccagcctcctctttacatttattaattggagtttttctctaaggaagagctgtccattcttctccatcttaattaattaattaaattttttttttttagacagagtctcgctttgttgcccaggctggagtacagtgttgtgatctcggctcactgcaacctctgcctccggggttcaagggattctcctgcctcagcctcccaagtagctgggattacaggcatgcgccaccacaccaggctaattttttgtattttttagagatggggtttcgccatggtagccaggctggtctagacctcttgatctcaggtgatttacctgccttggcctcccaaagtgctgggattacaggcatgagccactgcacctggcccgtcttagttatttctatcagtacagactcatggatatttattttatcctgtggatatagtctgatactatcattatgtattatgctgcttgttgttccaatcttggccattaggatcttgttcaggctggctcctgtgtcttttcagcatgccggcatcttttttttgagcacttctttatttcctggcaccacaaaatgttctaatctctcatattttcccttccccagtcttggaagcaaccagttttccaaggagtcctgatttttttcattaagagaatggcatttagaaaaggggatctgggcagtcaatatgcttgctcgttgccaccgtgaggtgtcgctgttgtgaggtcctcttgggggatggagctaggaattatgtatgaatagtaacccacacatatgcacgcatctgtagctatttctgtatctattatgtgtactaaatggaactataattcgaatgctttgtgacaggcactgacccggtgctttatgtatgttatcttgcttagtccttgagtaggaggaaatattggcacccctactttacagttgagaaaggagaggttgtgtcttttttttttttttttttttttttgagacagagtcttgctctgtctcccaggctggagtgcagtggcgcgatcttggcccacagcaagctccgcctcacggttcaagggattctcctggctcagcctcccgagtagctgggacttcaggtgcccgccaccatgcctggctaatttttcatatttttagtagagacagagtttcaccgtgttagccaggatggtctcaatctcctgacctcgtgatccactcgccttggcctcccaaagtgctgggattacaggcgtgagccactgtgctcggcctgagaggttgcgtcttatcttaaatcacatatgcagtgaagtcctttgtcacttccaaacactgctcctgaccattgttctgtacctcatggctgcctttgcatgtgtaattggcaagtcctagctataagacagcatgtaatgattaaggaggattggaaacctagtccttgtatcaccctttttccttcagtaactaaaatatctttttttttttttttgagacggagtctcgctctgtcacccaggctggagtgtagtggtgcaatctcagctcactgcaagctccgcctcctgggttcatgtcgttctcctgcctcagcctctcgagtagctgggactacaggtgcccaccaccatgcctggctaatttttttgtatttttttagtagagacggggtttcaccgtgttagccaggatggtctcgatcccttgacctcgtgatccacccgcctcggcctccccaagtgctaggattacaggtgtgagccaccgcgcctggcctaaaataccttatgttattaattttgtattttttataacatattctttagatggcaaaatgagtcttaatatttctgtcctttaagttaaaaatggtcaaaatatgctttcagaattacttctctatattcattagtaatttttagtataatttagcctgggcttgccttaccatattctgatggtgtagtttgagtattaagaaaatagaatttatttattgatttatatttatttatttttgagacaggtctcactatgtttgcccaggctggccccaagctcctgggctcaagtggtccttctacctcagcctcccaagtagctgggactacagttgtgtgcctggctaagaaaataccctaaggaaaaaaaaaaaaaaaaggctgggtgtgttggctcatgcctgctgtaatcccagcactttggaggccgaggtgagagagggtgggagggtcgcttgagcccagtagtttgagaccagtgttggcaacatagtgagaccctggccctgcaaaaatatttaaaaagtagccaggtgtgttggtctttgcctgtagtcccagttacttgagaggatgaggtggcaggatcgcttgagcctgagaggtagaggctgcagtgagctgttctgtgcacagcacttcagcctgggcaacagagtgagatcctatctcaaaaaaaaaaaggccctgagataatttcctaaaacataaggaaaatcagatattgactttttctatgtcatattaaatatctaatacattttaattaaattttaatccattagcagtttgtgtttggtcttgtaacagtacttgtctgtataaaataacagtcctggtatgtttatacaagaatattaggttttgttttacacacctaattttgtttcttatttgggaatagttaaaaagagaaaataaggaagtaattacttgaatgggaattttttttttttttttgctaatgtagcatagtctgttgcttttatatattatatgtatttgtattaattttataaactattgattgttcctactttagaaattcatagttgttaattccagcctggcttgcatgcagcagactgtgggaatactttcttcactagtctaggtgctataggcccaggaaatataaacagaattagctttgataagacatttaagaagtaaatctctacagattttatatttaaagatttgatatgaatgacttctggattacctatgccagtagtcactttcattactatggaataatgagaatgtataaagtttattatggcttactagttgataatgttttcgttaatcaaatggaaacctaaaatattaaatgtataacataaaataggtataaaatataccttatgtataatgtatagggagtttattgaaaacagtatgcagataaattatatcaaaattagttctcagtagtcatagatatttttatcatttggggaagaaagattatgtgggtatgtatttgaaattgctgcttttaaatatgcaaattcaggatataattattctgtgttaatacttcataaggccaggtgtggtggctcacgcccgtaatcccagcacttaggaggccgaggtgggcagatcacctgagatcaggagtttgagaccagcctggccaatgtggcaaaaccccgtctctactaaaaatacaaaaattagccaggtgtggtggcacacacctgtaatcccagctactcgggaggctgaggcaggaggattgcttgaacccaggaggcggaggttgctgtgagctgagattgccccactgcattccagcctgggtgacagagtgagacactgtctcaaaaaaacaaacaaaaacaacagcttcataaagcgaactgtcagagcagtttgctgttgttcattgcctcttttcaaacccttttttattttgaagaaaaaggtggctcataacttttttgttacgtagtctcactccgctgcccaggctggagtgcagtagcaccatctcggcttactgcaacctctgccttctgggttcaaatgattctcctgcctcggcctccggagtagctgggattaccggtgtgcgataccatgcctgactgattcttgtatttttagtagcgatgggggttttgccatgttggccagactggtctctaactcctggcctcaagcggtctgcccaccttggcctcccaaagcgctgggattacaggcatgagccaccgtgctcggccagcttttaaatgattctcctgcctcagcctcctgagtagctgggattacaggtgtgcggtaccatgcctgactaatttttgtatttttagtaacgatggggttttgccatgttggccagactggtctaactcctggcctcaagtggtctgcccgccttggcctcccaaagtgctgggattacaggcatgagccactgtgtttggccaacttttaaataaactattacaaaatcgtgcctgcttgtctctcattcaaagaataaaacttactgaggagaaatgatgttagcccctaaaactcagaacaattacttgtatcgtgggtacatggatatgtgatataattagattagtatcttgggaagcaattaaactttccctgtgagcaccatggctttttaaagaaatgaatgtgttctccaagtaggcaatttttatagattaaactttttttccagtcatcctttgtttattgtttttggattatttctttgggagatgttggtaaattgttttcagtgtgctcattggtggcaaatcttcatatcttgagaatacatttagtattagaaaatggccacaggtcatttgaggccaaatctggtgaataaaatatgtgctatgatgttgcacaatgctgttctagttgagaataaattttgtcttaagtgattctgaaatcagttcttaaagagttctgaaagagtagctgtgattcttacacgtttttggtctcttcagaacctcacaatccttacacaattttgttaaggaattcgtaaccactccctagcctgatagtggaataaaggtttaggcttccaaggtgactgctttgggaacagccctcatttagatacagctgtgttagatacagctgtgttatgtttagtttgcagccatgcctggtgtgaatgaatattgtatgtgttttttggttagttggaaaaaaaagtccatccaaagaccattgactgaggctgtggttcataaacactgaagagtaatggtgttatgtgtacgaaatatttgtggacatgcttacctaagtcagaatagagtgtttagcctgggtgcccacattttcagagcagttatttaaaaattgctgagctgttaacattcttgatagtttctttgtatatgtgtttatagtttattcatttggcaaacattctctgaacatgatatatgttacagagtagagtgctaaagaggtgtaaagatatgaaattgaaccagccatggattccagcagacaagaagtttattcttttttggcaaaggaaaggccttcatattctgtgttaaatcctagaagttgttttaggaaatacttaagctcataatgtattctttcactttttgtaatatgggaggtaggacctgctttatttttttatttttatttatttttattattttccgagatggagtcttgctctgttgcccaggctggagtgcagtggcacgatctgggcttactgtatcctccgcctcctgagttcaagcaattctcctgcctcagcctcctgagtagctgggattacaggcatgcaccaccacgctcagctaatttttgaatttttagtggagacggggtttcaccttgttggtcaggctggtctcaaactccttacctagtgatctacccatcttggcctcccaaagtgctgggattacaggtgtgagccactgtgcccagccagagttgtttttttttttttttgagacggagtcctgctcttttgcccaggccagagtgcagtggcgctatcttagctcgctgcaagctccgccttccaggttcacaccattctcctgcctcagcctcccgagtagctgggactacaggcacccgccaccacgcccggctaattttttgtatttttagtagagacggggtttcactgtgttagccaggatggtctcgatctcttgacctcgtgatccgcccgcctcggcctcccaaagtgctgggattacaggcatgagccactgcgcccggccccagccagagttttaaaatatgtaacccttattagaagcctttctcgtttttttttggtggaaagaagggggtatatatcccactgcagtctataccacaggaacatggtcagtctgttaatttcagtgctgagttgggatttgaaagtaagctgtttcttggccgggtgcgatcgctgtcgcctgtaatccctgcactttgggcggcctaggcaggtggatctcctgaggtcaggagttcgagaccagcctggccaacatggtgaagccccgtctttactaaaaatacaaaaattagcctggtatgatagtgcatgcctgtaatcccagctactaggaaggccgaggcaggagaatagcttgaacctggagggcagaggctgcagtgagctgagattgtggcactgcactccagcttgggtaacaagactgaaactccgcctcaaaaaaaaaaagtaagctgtttcttcagttatagatagcagtgtcagcagagtgctacctggtccattcctacctccttaatcataagtataaagtaattgatccagtggaacctcaataggatatttttggaaattctagtggattcaatgaaagaatcatcaactatcttagtatagggctgttaacttatactttctacacataactctttaatctagctttcttgctcctttactatcaccatgattatttacatttatatagtgtcttacagtttgtaacatacatttagctctgctaattttgtatagcttgtacctgaagataaaggaaaaacaaaatgttaacttaggccttacagaaattatttaaaaacatcctgacataggccaggtgtggtgactcacacctgtaatcccagcactttgggaggctgaggcgggcagatcatgaggtcaggagatcgaggccatcctggctaacacggtgaaatcctgtctctactaaaagtacaaaaaaattagccgggcatggtggtgggcgcctgtagtcccacctactcgggaggctgaggcaggagaatggcgtgaacctgggaggcggagcttgcagtgagctgagatcatgccactgtactccagcctgggcaacagaaagaacgagtctccatctcaaaaaaaaaaaataaataaataaataaataaataaataaataaatgaaaaataaataaatacataaataaataaaaatcctgacattaaggtttctgacttaaaattatatgtgtaagtaataagtatttacagtgaagtgtttagttatatattgaatagaacttttaaaaaatgtaacccagggttttcttgccaaaattctttattctgtagccaaagatgatgtctgttgttaatatcttaaggttctgaagtctacctggaattatagtgcaagtaaattgtagtctgatcatgtgtagtatctgtaatgcaaggtgtgaccatcagcttatagatatagttgaatcttagcattattctaaggcttggaagttaaacatagaattatatacagagaaacaaagcctttcatacattaaaatagaaactatttctgctgatctgtaaaatgtccttcttgtggatattttcagataattttccaagcttttactatatatatgtatacatatgtatatatatgtgaatacatatatatgttttatgtactgcaaaactgtagtctcaagatcattatttaaaagtacatccttaacatggctgggcacggtggctcatgcctctaatcccagcactttgggaggctgaggcaggaggatcgcctgaggtcaggagtttgagaccagcctggccaacatggtgaaaccccatctctactagaaatacaaaaattagcccagcgtggtggtgcatgcctgtaattccagctactcaggaggttgaggcatgagaattgcttgaacctgggaggcggaggttccagtgagcggtgatcacaccactgcactccagcttgggtgacagagtgagtgagactccgtcttaaacaaacaaacaaacaaacacatcaaacaaacaaacatccttaacttgccagtaattcactcttacttttcttcctgtggaaatgtgcttatgttaggttatttgcatgaactgagattattaagttctaatatttttctgcacattttggccactattatttcatgtagaaagttgagagaattttattcaaagctgcctttgtgtgaggatctgatagcatagaggtagtagaaatagacattttttaaggggtaactcccaacaaaataaaagcgaagtaccagttgtggcagggatgacagtggttattggatcaccgagctgtattctttctatcagctctctccaagggactcagctttctaggagggggagatggaaatcttaaacaggtttgatagcttccctaccttttatctgcccagacaacaaaaataaaacagctcacagtgttaggatttggggtgataaattaatttggagatatctaaatgtaaaatgagatttctgggcacatggcagtgcggtctgtatgataaacaactggggttgaaacagtaagtgcatgaactagacagactctttttgaccagaccttgtgttataggtgaatgaaatttgggaatcctatacttggaattctggaatggctagcctgggccaggaaaaatcactttgtaatctaagaaggaattgagttaagaagatttgttcatcacaccacatttccatgttgttgaggaaaatagattggcagtggtgacaaggtcaaggatgtgttgttcgaagttgtagaagataagcagcaatttaaaggcgttacaatacatttttaagagtggaaattgcattgaagagtggaagaaaagtcgacataagagaattagggcatgttgtttgcccaggctggtcttgaactcctgagctcaaccaatccacctgcctcggcctcccaaagtgctgggattacaggcgtgagccaccgtggctggcccttaatatgttttaaaaggatgtttaatactcttcattactgtgttatgcaatagttgcatgatgatttttctgatctctacattctattttttttctttttaaaatggagcacagaagtacttagtttctgatgtttttccatcttggcccagtaatttcctttttttttgttattttatgaagcacaaaactaaatatttttgaaccaagagactactgtgtggtattaattttgattttgtactaaattcatgttatttacacaaatcaaatagtgtcaaccttaaaatttttttaagcaatatttttcttatgtttgagagttaacatgtatggttgattagaatcttcaccttctaaagggattaaggaaaaacctcgttcactgttgtgaattctaaaatgttttggttccaagtcctagtttttcttaccctggtattatgtccaaaatgaatgcccactaaaagttagtaactctcatggcaattaaagtattttgataatgtttataagttcttgttctcaattttgccactagtaaagatgtgggagaagttaatctttttttgttgtctttcttgtgaacttaaagatcatttttcatcctgttcaacctttggcctgaccttttcaggtcactaaatgtctggtttgcacttcttgtagcatgtgagaaataatacttcaaaattcaagtgtaattgtattaatttttgtgaataaactgctatggagtgctgaagtgtgttaagatgcctagtcttttcagaattaccggcattatggtattgaacttaaaatattttatgtttataatattttagaattttcatgagtcagataaacatatacccagattttcagaaacttgacatttgcttaattgcttaataattcacatcaggcttagagatttgtgaaatatttttgggataatttatttagaaatagcgtgtgtttaaatattaattttcttttttaagaaaatgggcagatgataaattaccatgaaagcttcatttaaaaatctgttgttagtattgtcttctttaattttggggagaaaaaacttctgagatgttaacaattgaacatgtagtgttggctctttttggccttcaatttaaaattgtcatgtgtttggattaaagacatgatgtatttttagctattgggcaagagatggcaatattgcattacatgatcactgcagttacactattataaatgaaagtgaatttcatgttacaaatgttcttctaatgcaattattaggcgtcattaaattagtttacactttatttcttctgattgattttttaaaaaactttttagcagtatttatataaaaattggacaaattgaccctttcagaggcagtatgaccctttcagaggcagtatgatcttgtgcagatacccgtctgcaatatgtgtgctgaacagatgtgaaaattatttagtcactggcttactgcttgacaccttcattgctctgttgccctgactgtgcttgtcctagaatctggttgttgtcctctttgtccataggagcatatgaaggtgggagtttttgaatttgaggacaaacatttgttacctttaatactacattgctttcatactcactaaaaactaacctttgcatagtatgcaacttgtatagcttattaatcttcaagtctattaacatataatatggttaaagaggcttaataataaaacagaatgtagtaaactactgcatttaaaaatttcccaccaattcctactttaccagcatatgtttgatggttaagggggaagtgatttgaatatctcaggatttgcagagactttgcttttacctcttctttcattgtagcttggtcattctcaaatttgagtttctaaggacttttaaagtgttacgtatgctaatccatgtatacattatttttatgattgattaaggacttttttgggaagagttgtggctatacatgatttttacctaatctaatcattttagattcaaactccttgcataaaatgtagctctgcttagcactgctgccattagcttatttctgctggcttagagtgacgtctcggctagttcctgtgttaagataatttaactggtttacattttcttttttatgatgtgtgagttctttctgtctttctcatctttacctttgacatgtcagagacactgttgcttagttattaagaacagactgtcagccgggcgcagtggctcatgcttgtaatcccagcactttgggagcccgagaggggcggatcacctgaggtcaggagttcgagaccagcctggccaacatggcgaaaccccatctctactaaaaataaaaaaattagctgggcttggtggtgcgtgcctgtaattccagctactgaggaggctgaggcatgagaatcgcttgaacccaggaagtggagattgcagtgagctgagatcacaacactgcactccagcctgggcgacagagcaagaccatctcaaaaaagaaaaaaaaaaaaaaaaaaaaaaaaagaacagactgtagccagctcttaatattaagccagactgtaaaaccaactaccaccatttattagctatataactttgataatatctctgtgtcttagcatccttattaaatgaagatggcagtggtagtcctttctgaagattaaatgaatcagtatatgtaaagtggtcaactttgtattttagtattataataattattagatatgatacctggcacaaagtagtaattcaggtgtttttttgtgtgcattagtgaacaagtaaaaacaagtatatttcttgaatataatgtatagaagtaattttattctttttatctttaagttagaagaaaaattaaagtatattccaaaggttagataaatgcagtgtgtatgggaatcccttgagtttttcagtaaaattctatttgggtggctgtcaagtccagtctgcatagtcttgacatgtcttggataagatccttatactatcacttttcctgtcatggacactacaaattatattgaatcagaaatctaatttaatccattcttattcaattggaagcagtaattgctttcaatttaatgggattggattcagtattagaaattttgatgttccttcaaacttaatacagtatggttatatatatttccatttatttgtgtgtgttcctgtgccctcgcagagagattatcttggagtattacttgtattcacttgagttatttgcaacggttggtaaagaggcatattgtaagggtgggaatgagagtggcattctctttgttttttttcttttctacccatggaataatgaagagagaaataataagggccttcaaaatgggatttccatccactcagaaataaggaaaggaaatttagagtctctggagaagatctggaatgctatttactcttgagggtagacagcatccagccctactaaagatgaaaaaaggagagcctggggatgaaattaaatccatcaaaaaattcactgttggtcaggcctggtggctcacgcctgtaatcccaggctgaggtgggcggatcacttgaggttaggagttccagaagagcctgaccaacatggtgaaacctcgtccctactgaaaatacaaaaaaaattaatcggctatggtggtgggcgcctgtaatcccagctactcgggaggctgaggcagaagaattgctttgacctggaaggtggaggctgcagtgagccaagatcatgccactacactccagcctgggcaatagagtgagactccatcttaaaaaaaaaaaaaaattcattgttagcatgttatttcaatctttcccggcaaatcatacttagagacagctaagtttatcaattctcatgtcctatacggtgctttttcttgaatatacggtagacaagaggtaaggcctaatgggtgaagtaactacatttctgagttagtgtctaattgtttttgatcacctagttccatttgacagaagatgtagtgcttatggctcatcccattgactctttctctgctttcactccttcagcagtgttttcagtagcctttttggtgatcttattgacttgtcttttttctgatgttctttttaattgaattgctatatgatataagatggaatgattgtgttttaaccatgatcttcaagtctgctgtgtaaagaactaatgattgcagtttgagtaaaattcttagtaacaagtgaatcaaagataaagatagatcattgagaatattttttttctctccatgaggaagttcattattagctagcttacaaaaatgaaggaattgtgagagtgttctggaataaatgttatggcttaataaaactattcagaaaatcactgaacaatacaaaagtggaagacattgaaaatggtatatggacacatctaagatcaaaattaagccagagaagctttagggagagtatttgaagcttatcatttccatttgtaacggctttttatattgtggtgtaaaatcatgtgcaagccataaacaagggcttttaaaaatatttttgttaatttttttttagttttatagagatggtgtctcactgtgttgcccagtctggtcttgaactcctgacctcaactgatcctcccatctcaaattccctagtcactgggattacaggcatgagccaccacacctagccaacgagggctttttttttttctcattaacatagagatatgaagaatactatattggattaaaagtttttgcatttgtgaagtgtaagcagctgtgtgaatgtagtcaatgtgtattcttcatttaataaacataagtatcttttcctttccaaattatacaaaaaatactaaaagcaatcaaacgatttttacagaatcttaactaatataaaaatttgttcattgcttataatacagaataattatataacttggctcattatctaagcttaatgaattaatgttggaatgtaaaaacgagcaattttaagccagcgatggctcaatcatttttaactgagggattttgggatcaattactaaaatgttctgagcctcagtgtctttaaaatgtaatgatgctctattaatctcatgaaattgaagtgaaaacaaatgtgaggtaatatgtttttggaaatatttataagtttaaaaatagcctgcttggtacttgtgcctgtaatgctagctactcaggaggctgagacaggtgaattacctgaggccaggaatttgagtctgtcctgtgcaacatagcaagaccccatctccaaaaaagctaatatatttataaagcttaaatgttataaaatgataaactgatggtttttgaattctttgctctactcacctttcatctgttaaagatgtttttgtacaatttagctcagttcctaaatataccaaaagatggcactgtttacctatgtttaatattttaatttgcattttttgatgaaaaagtgtgttgaatgttttatctacaaatgttttaaattgaggttatttttttacatttaattttctgttttgtaaatggatctttaattcatgtaaagtttactaggaccaggtttcatttttattttgaaatggtttggaaattcagatatttaacaatcattttgtagatataaactcctgtgtgatccattgtaattaatgataaaaccttgtattaatgtgacagctaatgtttcatggaaaacctagttgcttttgtataacaaaaaccattaaattttttaagcctctgaaaacagtccagtgattaaaacatgacagccacaaataaattatttatgtggcttttaggtcacactgcccaggtttattcattttagaaagttattttatcttaaaagtacctttgaaaatgtagcaaaacctttcattgcttgaatttcctactcacagttgtgtgatgagaggagaatctaggtccaggtcctgcgaagagcttctctgggtgagaaatgcaaaaattagataatatgaatttgacttgaagtgagggttatttatatagcaggatgtggtgaatacacttcccatacagttagacggaaacctcctgattgttcatttatacagcctattacatccaatgtagtttatgacctagaaagagaatacaagtaggatatttttttatcccatcaaagctatctatatatatatatatttttaaatgaacagcatttgtcagtgatttttacaggggtgaaaaagcacaagacagttccattactattataaaatgttttacttttgttgtgggggtaagtttagaagtccaagatataataatttcagatgtgcttctactgtttcctttacttaaaagtagggactattttgaggcaatataatttgtatgtttcagtttttatttctctctgaaaatcactttttagggtaccatgccttggaaagaaagtttacatttttttccgttaaaaacccatcctcctaactctgaaatgactgtctcagttactaaatgtatatagcttgggggaagtgaaggcacagttggcagttagaggtttgtttttatgttcatgggagtatatgtgcttatatttaaatgttcactcttctagcagggtttgttgatgttagtaatatgctacatatgcgatttgtctgaattgtttaaaaatgcataattacaggaggatttgattattcagcaacagttccagtagctaaagactatcatatagatattttcttccagtatttgacagtggttctgtgagctatgagtagcataaaaaataaaaagaagatactgtgactctttaataccctagaggccgtagtcttaggatattcttactgtagagatgaaaaaacagggcttcattaacaaactgaactgctatttcacctcttttagtagatgtgtaattctgtgggtttggtaaataacaaaggcttttttcctaaatgatttaatgctttcagatttttgtgggaaaattagaaaaagcaaaaatgcactcagtgattttttttttaaacccctttgtttctggacaaatggacaaagatagttaagtgtcccaaaaatggttttaacaggcttccctctacaaccccatacataccctggctgtccataattccaattttgggtaggtagtaaaatgtgatattagactacgagtattttccctccaaataatacttgtgattaaaagaaatgcaatcaaatagcattatatattcgttatgaaagaaagatctgtcatgcagattttgcctggttcctttagatgccttgtaataatgtgctaatttatgctgatgatcttgcctcatgacccttctgtgtggcctagatatgttaatatgttatagctttttaatttcgatcctctgtgttggttgaatatgcttgttagtccatagtgccactcactagtctgtgtcaagaactgaaaaagaacaagaaaaatgtatctcagaatcaatttctttaagcatgtatcagtaatggaggaaattataaaatatacataattttaataggactttatgtctgaacattcattgaaaatagtaagcactctaagtactgtaagcttttaattaggaaagagagttgggtcattggttttattaagcaagggcttattaacatcttttgattttttttcttgatttttgtttaatatcagtgagaaaatattacaagaatgaaaactagacatcactggcagtttttactttattgcatccatttttctgttccctaaaccttgagggttatgcatctaaagattcccatggtaggaaaatactgtatgtggttcataaattcatgaccttaaggtagcagagaccaaggcctaaaatagatgggagaactcaactgtttaaaaaaatttgttaaaataaaaattccatagaaggaaaacaatttatgtaccttaaatataattcatctttattatctttcctcatctacagaagcttctccttattacttatttgtgttctttctacagagaatatactaggaggggtatttttccttatttttagctcttgatctgaaagtgtaatgttcttttcgctttgtcttgaaattgttgcctccccatttttgggtctcatctggatctgaaagacattgactgactcaaatatccgaaaaacttggtaactttcaaattggtatacgtggcataattaagaatatgttggtgcaaaagtaatcgtggtctttgccattgaaagtaatggcaaagaccacgattacttttgcaccagcctgtatttcacaaacgtctctgtgcctgtgattacttctctctaaaatggtttatggagtagttgttatgattaataaatggttgataaatactagctattatggtattaagcattaataaggaaaattcactattacatgtaaatgttttgagtccctgaaattaactggcaacttaatgaaatttgatttaagcacacatttagtccatttcaatctatttaaacgtgtttctctcttgcacatctttttctgatggagagcgtgagttaggaaatgagccaaaataggatatataatggatagcctcttttggtagccagtcagacagaatggggtgatgtcttcatagaaggaatatggaattaggagttggaagatttggggtcttgctccaaagatcactttgattgttggtgaacttatttatctagtctcagctttttaattaattaattaattaattattttaatttagagacgaggttttactttgtggcccaggctggagtgcagtggcatgatcatagctcactgctactttgaattcccaggctcaagagatcctcctgcctcagcctcctgagtagctgggactacaggtgtgcaccaccatgcccagcaaatttttttttttttgagacggagtctccctctgtcgcccaggctggagtgcagtggcgcgatctcggctcactgcaagctcctcctcccgggttcacgccattctctcacctcagcctcctaagtagctgggaccacaggcgcctgccaccacgcccggctaatttttttgtacttttagtagagacgggggtttcaccgtggtggccaggatggtctccgtctcctgacctcgtgatccgcctgcctctgcctcccaaagcgctgggattacaggcgtgagccaccgtgcccagcacccagctaatttttaaattttttgtagagacggagtcttgccattttgcccaggctctcctccaactcctggcctcaagggatcctcccacttcagcctcctaaagtgttgggattccaggcgtaagccactgtgcctggcctattcttagcttttaaattctcgtctatgaaataacgcatttgactgttccaaaagtgtgggggacaggtcatcttctttcacatgcattgtcttactttgtaaggtaaataaagtactatattaagaaatgtgggcctggcacggtggctcacgcctgtaatcccagcactttgggaggccgaggcgggcggatcagaggtcaggagattgagaccatcctggctaacacggtaaaaccccgtctctactaacaatacaaaaaaaattagccgggcgtggtggcgggcgcctgtagtcccagctgcttggaaggctgaggcaggagaatggcgtgaacctgggaggcggagcttgcagtgagccgagatcgcgccactgcactccagcctgggcgacagagcgagactccgcctcaaaaaaaaaaaaaaaacaaaaaaacaaaaaaacaaagaaatgtgaggtgtgaaatccttcttgaacatttttaacttcactcctccctatgctgccactctgccccctcatcagactcttccttaacacactgctgtgacccagattgtctttatttcttcttgtagcacttgttagactctattgcaattatttatgtatttgtctcattagactgatcttgagtacagagatggccctttattcttgtattcaaagtacctaccaccatatttggcttataataagcctcagtgtttgttgaatgaatttatatcaatatccatgccattcatgagaaacaaaacttattatatagagcatagaggtggtttctaattcgtgttgctcttatttttactgttagatgtaaaacgttgaatgatttgttaccacttggcataattaaatttagcatttttctagtttaagtagttcagtttttgagacacttttatgagcctcactatattaatggccttattggtgctttacagattttgtgattcatgggcactgtaagtataaatttcatgcttacagcaattgaataaaataggcacattgttctttgttagtttcttcagttggttcttttaattttcctgttcttactggtgattccttgaggcatctggccagtgttgagtatttcttcctgactcatcatcccttctgccacctgccaaaggaatgcttttactttggtcaagagcatttcgagtgagttagatttcattattggtgtaggctatggaccacctgataagtctaagcatgtcatactaattagcattgactgccagccaccataatgcttaattcaggtgctatgctgttttaattctaaaggtgttgtgaagtatggaaaaatcctttacctgaatatgaaactagctactaaatttggagttctctccctacccctgcagcattttcctttgtgtgaaatttcagttgattatattcaatttacttttatatagtctttcagaatcagtagaatttttttccttagatatatctaagtcactcctttttgagatgatttagaaaagaggaaattgaggattggaagttaaaaagggagaaagatggctggtaggtaacatgtagaagttttaacctttcatctcaagagagtgattcttctgggctttaatacgtgtatctgagagctgggaggaagctgtgttggagggtgtctgggacctggtgagacctcagaaaataagagtccatcataaagtaagaaaggcattgatgggacttaaaaatatttgactacagcgaaagctttttatttatttatttatttttatttttaattaattaatttttgttgttgttgttgagacggagtctctgtcgccagggtggagtgcagtggcatgatctcggttcactgcaacctctgcctcttgggttcaagcgattctcctgcctcagcctcccgagtagctgggactacaggcgtatgacaccacgcccagctaatttttgtatttttagtagagacggagtttcaccatgttggccagtatggtctctatctcttgaccccatgatccatccacctcggcctcccaaagtgctgggattacaggggtgagccactgtgccctgccaattaatttatttttttgagacgaagtctcactctgtcgcctaggctggagtgcagtggcgtgatctcagctcactgcaacccccgcctcctgggttcaagcgattctcttgccttggcctcccgagtagctaggactacaggcatctgccaccactgccagctaatttttgaatttttagtagagacagagtttcactgtgttggccaggctggtctcaaattcctgacctcaggtgattcaactgccttggcttcccaaagtgctgggattacaggtgtgcactgggtcagctttttagaatgcattttatctgctgcaagttaaaagaaatttactagcctttgaatgaaactgtagaaggaaaatcctgaattcctagatatcaagggatggttagagaacccccaaaagtgccgtattgatcattacaaaaaaaagggtaaaatgtacccttatagtctcttcatttagtgcaatatctttattgtggtaagttatagattattgataggggcttctatagtttatttttctacttttggtctccttatcctatcttcccactagattaaaaaattctccccaaatatattctgctgtggggattttcagaaatgttagcaccctcactggggaggaattaccttctacctgtatttctggaaggggaagcttatgtgaatctctaaaaagagaattatattgatgttacgaagtaagtactataggtgaaagagagaataagaaaaaactcgatgtttaaaggagcatctattgagttactctgtgcaaggctgaccaactcaccttgtgatcttagtcaagccatgtaatctccctgagcctcagtttattcatatataaaataagcaagttgaactcctctgttccctggttctttgtaaattcattcattcttagatattcatcataagcctgttgtgttatgtattcagcagttgaacaagacagatgcagtcttatccttgtaagaagacttctctttcccctatctctgctgacctgtccttctccctgttctcttatctagtaattggttggataatgaggaagtgaagcaatgtgaaatgcttaattacaaatttggggactctgtctgcttttatggatgaagtggattgacattttggggggaaaagtaccctgtaaaaacatagtttatatatattaaaaatgttattaaaatgaaaaagtgatttatcagttagtggtaaattaattggctgacttgggagtgaaaattatttgacttgggagacaaaattactctctagactgagctagagagtaattttgtctaaattgaggtatagcagatataaaatggaaaagatttatctttgatgttgagtaattttaaaaaatgcatttgagcttcttgggaatagttacccatcttgatgtatttgctgaagatcagatgtaattttaaaaaaaatttttggtagaaaaatgtctttggtataagtcaggcctattatcttgagatttatgcctttattctggaaaattgaaatttttatctcataaaagaggaaaataatttgaatggagttaataaaaatgaaaggagtaaaatttcacttagaaatacagtgaggcatccaaaatgaagaaaaatcccttatttggcttctagatctaaaatgatattctaatctatgcaggttggttcaagagcactttacccctgttggaggcagccaggttagctttattgaatgtaaatctctgacttctcccaagatacccatgaaagcaactaaattcattggttattaggcagcaagagtaagttcaattttctctacacttgtgacaattagaggttggttctagcctgtctaatgcttaagtttcaaggctacctgtatttgagagctgttttggggagataaccttgtaacacatacattttaatgagtacattacttttaccacctgctgaagtcgacttggagtgactactgacctgaagtgaatgcctgtgttcaatattaatatggcatgtctggatccagacagcaatctttcattttgacatgcacatagtcaaagtaaattaatgtttaaaacccaaacactttaagttcagccagtgtgtgcattccataataatccttcagaagcagtttacatagaaatgctgagtgctttcttatactttatttatcatatgtattgggtccacattgcagtacttataacgagatttatccagtgctgtttttgttccttgttttgtggaggctaaagaagttaatttatttcaggatttagtctctgcatattttaagcaaaattatacttaaaaatcttcatgtgcctggcaagatagtagtctaatttcagttatattatttttagatggaaaaaaaaaatcaagctaattgcatactttatttctgctcaaatgatcaccaatttttgaaagtatagtagtagtttaaaaaaagaaaaaaactaggcccagatatagtgtatgtttgtgactacatgtaacaaggatattgctgattttccttttctctcatacataccattttctagtcttgcttttattggttagaaaacattcatggcagatgtagtaatggggaaattatattaacatttaagtattaaattagcttgtagccagagtctccttctaatatgatgacatttagcaagttcaggattttaaggaccatgttgcgcaactcattgttacacatttcctgtttgccttttttgaaaaagtatctgagatctgttttttcagattggaaatttccattgtggatttcaatgttgttgttgtcattttaccttgctggtcagtgtttgttatttatgtattaagaatatgtagtatagtgaccataatgagaatagtaggtgattggagttgtatgcaaatgacagttttcataacacttttgcagtttaatttcaacaaaaacctcaagttatatttattagcaaacatatttcagctaaggagttttttatgctccaaaaagatggcagatggaaatgaacctaatatgtgttcaaagaaagtatgctgcatttatttcaaattgtatctgatacatcagcatgatgatttatatgttgtcttagaattaaagtagatgccatacttttactgtaaaagtcaaaattagatttcttctatatttgacagaatttattttctgttcataaataaatatagtatttggtttaggatgtagaacatcaaataacaactgttagattatgcttaatatatttatcattttctgaattttggatgttcttaacatcagaaaaatatgtcctttacccatacagtgactttagattggatttggaagcattgtacagagaagacctattgttcctattgaataaggatgccgtacagagatgagctttttgacccactgctcttccagtagtaatggatttgcactaatttgagcagagtatgccacttggtcctgtttttcagttgtcctgtgtgatggctggctagcaaaatcaaacatctgcattttgactgtggaaggcagtataactagctggctcatactggttcaaatttgcaacactgatatggttagtattatggtgtcactacctgaattaagtagttgtggctaaattgtttatattatatgaacatattcgttattattctgcatggagaatttttgtcctcatggattgtttcataaagtgttttattagcttggattaattggaaaataagctttttaatatggacctctcccctagtcagagactttgcaaatgatttctacaaaaataaactataaaatagatgatataatggggcctattattcctgatttgattttaatttgcttccttttataatttttccacaataaaacagagcctctcagaaagtaaaaggatgtaatcctagctcagatggtatagggtccttatgtcttgagctattatgatggaaggtacccctatacctccactgatagaaatatgatgggcagacattttctttggtgaaaagtagttcatagtttactgtgatatccactccttggacttactttagaggactgtttactgagggcaaaatatgtgcatgattacatataatcaaggttaatttttatcaagggtcaccatgtttttgctatggtctgacaatcatgacctacattaaaagagccctgtgggtctgtctggtgtatttttgcttgatgtctgggtagtttatttcagatgcttgtcagtttcattatatatttttgtttggggctcttgctggattttcaggtacaccataaaaacagttctctttgcagttagattgtcatgaaatagcttctgttttatggtatgaaaacactctttaatcttgaagggtgagtaattttgggaacattttccatttggtggtgtgttatgttcaaatggtaggttattttgaaataggatagactttgcagctaagattccagatttagttcagttaattcattctttagtgagtttttcttgggaaaatattttggaattttcatttcaaatgcatcctcctcatttaagaaaaatccagatgagtagtttatttcacaatataataactaaataggatttataaagcagaaatttataaatcctttcttttgctgggacaaaggcaatggtgaaaattaaaaaaaaataaagttaggacatttaggtaactcaaagacagaacttaatggctgttaagattggagtatttggttttgtagtttttaaaccatatttaattttggccatatctatcttatttagtagtttaaaggataaacagttcaaacagtaagaaaaaagcagtttgtgttttgtcagttttcaactttagatatcagtaaatcattgctgtagctttctttatcttttgtttgcacaaaaaacctgttagaattatgtctgcggggaccatctgctgtggttcccagtcttgtcagtgtgataagggataagctgtataaacaggggcaccacaaaaaaaaaaaaaaaaaaaaagaaagcaaactgcttttagaagggaaaaagtatccatttaattttataacatagccacagaaattcatatgatttttctcataatctatcagaattgaggttgtaatatattttttcagaaaccacaggtccaagttatttctatggtttatcttcacattaatattatatctttttgattacagggtttctattttggaggtcatagcttttaaaagttcttcgaaaatatttcagtatagcacttgacattgcaatatttttcacattgtctgcttagtttctggatctttttttccctagccattaatttttctttcagttgaatcctcagaaatcatccttttcctgtttcatttgcaaggaggtcatgatgcttcgtaaggaacaaggcagtcatttccatggcaacacactctatcaaaacatcacaaatctgtcgtgccccttacctttaaactctcaaatgctaagaggaggaggtgtgtaaggagcagcattgttcttacagcataactatacgatcacaaggagagggaagtcaattaattgactcaaaagtaccttaagttgacttagctatagacatatatatgtaaggaatttatcttttatattgtattaaacagtgttttgaggatggaaaaatgaacattccaaaactctgatttaaagatcttatttagtgtctgtgagaactgtaaaagaagaataaatagctgagttatgtcatacatgtaaacatgttacacagttactccagtcatgagaagtctacctttgcctggaggccccagcacatgtctctgtcagtcattttggcttaagctaggatattttcagcatgatagtgacacctatcttttaaacaagttccagaattttgtcaattttctttttctttttaaccattaagaggaggtgttagcaagatggcgtgactcctggatatggaataggagaacaattggtgtttcatcattactgaaaattttatgctctttgaaatcaggtatgaagtataataaaaatcaacagttttatgagattttgtggtaaagcaattcttattttattaacttcaagtcttctgcattttcagcatttcattttattctgtagcatttttactcctgggtaatgcatttatttgtgtgacctgtgaagatggtaaattttgcaatgcttagcgccttctgtttccccatgttccttgtagcaaactctatgctagtccttatcatagaacctacctattgtactttaggagtcagctcacaggactgacacctcccacttgactgtagccaccttggaggcaggagcttgcttttctctgtgtgtggcgtggagcaggtgttcaataatgtttgttgagagaacagtggtcagaatgaatggaattagttgtttgtgataatgtttattttctctatatggcacaggtatatatatattttaattttttactgtgtatgtctaaaatgaggttgaaatatgttctccatacccattttgtatttaacaatttttttgtagtgtattttgaaatcttggtaggctatttccttttgccttttcaggcctccatacactcctattacaagaggacttctgtctctgttccacatttcccttcgttgttggcgacctaaccttggtgaccgcaagcgatcggttgtgagagaaagagctgtaagtggggaaggctttccgagtctataggtactacctggtggcagtattaacacattttattatgaactatttgacagagaaaaggattaagagaataaggaccagttatatatcacctactcagatttagaaatgaaacattactgatatagctgcagccctccatgtagggggcgggggttaggtgggagtatatttttcattttcactttgtacctttttgctctacaaaagcttcagacttcaaaagaaatctttccttgctctgtgctttcatagtactaccccaggcctaagtgtattattgaacctgccagtgtattataaccatctgttcagatgtctgtcacctctaccaggctgtacttcatctttgtattttcagtaccgtacataatagctagaatggaataggtgctcagtaagtgcttgttgtgtgaatgactgaatgaatgaataggtacaattcttttctcaaaataccatgttaatgtaggattctgtttagcaaaactatttccttgtctagcccatagttacagggccttggtgctctgatttgaacaaattgaattaaacataaaatcctgtagaacagatgcatttacaagtctctgctcacacagctgctggtctatttaataaaaacattgctgttttgattgggtattcatagcctttctttttgttaactctattagtatcatggtataagcagactacagtctagggaagatgagtggaagaatgagccagtgatcagaactcagagagacaataggagatggatgtcaagaagatggatggggaaaatgttttagtcttaggtgtagttacaataaaaagaacaaatacatgtatttgtcttccctggactatatgtcataaatctctgactccatatttcttatgcagttattgtaaccttccttcccctaaaccacctaagtatgtataacattcctactctaaattacaaaaaatcgatactgatgcatttgctttttaaatttttaaaaattcaggtataatttatatccaataaaatgcatagatcttaagcattcagttgagtgaattttttttcccatttatgcacctatgtaaacactaccccaaacaaggtaggggatatttccatcaccccagaaaaatttttcctacctctctcccatcaaccctccttttcccttcccctcccctctgcagcagccactttctgattctgatttcacttgttcttgggagtcatatgaatggactcatagtatgtacttttatgtctggcttcttttattcaagatactgtttttggattcatccatgttgttgcatgtataaattcgatttgcttctagcaacagaaatgtgtatactagcaatcaaatacaaatttacttttaccttaaagttgagagattgagtagtgcttttttaagaggattgttagtagacttccacagcaactcacatatattgagtgccagtccctacgctcagtgctttacacacattatcttatttaattgtgttttgtgattgtttgtttagttgtttacttaattctctacggcagacatgttcggtgaaagcattgacatctgatgaagaagttgacttggtgtttgacaaaagaaactgtcttgtgatataaaattctgattgttttctcaggactaagtactaagcattgtttatggcaggcatcgatgagcttaaatcatgaaacaggaggaaaagtgtaaaaggacaatggaagagagttactgggtgggaaagaaagaagtgcagtagctagtttagattcgtcttatacaatctgtgatgaaacttttgagacagagtctcgctctgttgcccaggctggagtgcagcagcgcaatctcggctcactgcaacctctgcctcctgggttcaagcgattctcctggctcagccttccgagtagctggcattacgggcctgcaccaccatgcttggctaatttttgtatttttttggtagagacagggttcaacttgttgccctggctggtctcgaactcctgacctgaagtgatccacctgcttcagcctcccaaagcactgggattacagatgtgagccactgagcccggcaaagttgcctttcttcatagaagaaagttgcaaaatatacatgaatgaaagtatattacatacaatacggatgcctgaaaaaaagcatatgtaaattgtgcttagcctctcaaagatgcttgtaatcagtgcccttatttttgttcagaattatatcaacctagttttgagtttttacatatagcttttgttttaccagcacatatgtaatacctgttatggtgccagttcattgtcctaattgctttatgtatattaattctcaaaactctgtgaagtgggaattttttctgttttttagtccctgttttccccatgaggatactgatgtaatacgaagttaaagaactggaccagagtcacataggtagtgcaagtggggctggaattctaacctggctggtctgatttcagagcccgtgctcttaatcactgcaccgtgtgcctcagcctcccctctccctaacatgctcctcattcgtccttgatcctagggatgatgctggttgagtatttcaaggtttgtaaagattgacagtatcaaaacagatgtagcaactgggactttgataatttctataattcacaaaatagatcttaaaattgcatagttctgttttttgtaggggagggaaggatatgtaggaagggatgatttataatttgaaatctggcagcagtagagcacgtaccttaagcctcagcaaagctaattacataaccaattttgtgcttattcaaggctgtatttatagtagattggtgtttctgggctagttggtcgtagaccctgggagtgagagaccatagggacggtctgtgaatgtacgtatgtttgaattaggcaatggcaattggaagtattttattaccacatgaggtcctggtactcagattgggcacacctgcagtaggttgttgacatttgtgaatctaacatttggggtttcaattattttcaagcccccagaaagtccatgacattcagtagtttgttatgaaaataatatcagtttcatagagttgtggggttctgagaattaaataaaaataatgtgtgtaggcgttagctgctggaaggctggaatacagattctagtcatttggtgagtgagtgaacctagcagaggtcctcccgtgtctgcttgtgacattctgcatttgggagtctcaggatgcatcagtgactgtgctgtcggtgcactattatggccacttctcatccttgctggactgtgagtcttctctagactcagggcttcagagttacttctgcccctgtgtccttcatggaacacttactttttacttctgtttggtctttcaatataaagttcctttatttttaattaccaaacttccctctccaggttataagtaaggtggtttttggccatcacctttcttagctatgggttaaagcattctgggtactattttctcctttttatcaccatgccatagcccttgtgtctctcccttcaactcatggttaggttggtttcattggcactttacttttttttttttagatggagtttcgcttttgttgcccaggctgaagtgcaatggtgcgatctcggcttactgcaacctccatctcctgggttcaagcgattctcctgcctcatcctcctgagtaactgggattataggcatgcgccaccacgcccggctaattttgtatttttagtagagatggggtttcttcatgttggtcaggctggtttcgaactcccgacctcaggtgatccgcccaccttggcctcccaaagtgctgggataacaggcgtgatacttttaatttttaaaccttaaaatacattattaatttttccaagagaagccccgatatttttgtagcttggcctccagagcctcagttatccctgatgtagtagatcatctctttgcttccaactaaagtggagcattggatgttgtttgttaaggagtgattttcccatttactaactcataaaatttgctgactgtgttttttggtaagaagtcttataatgctttcaatttcataagagtcattttcatagagtccatgcaatatacacttagagtgtaaaagatactgagttagatgctgtaggggctccagaaatgaagtcctgtctttcattcttacaaagtgttcatccttttaagttccttgttaatgtttggggcaaactaaatataattttttggttagactttaggtaaatatttgaagaaaaattttatatgctatattaaatttttattttatcacaagtttcattaactttcacttttaatgccattctttatgaaatgtcagtgttaaagtgaccccagtagtgtgacaggcaaaagggtcagtaatgatggcttctttagtagccttcagaactgagcagtttgagattaacagccaatatgaactgcctgcagtaatcattaaaatataatctccagttttggtatgattttacgtatctataatttataataaatgtcttgaagttgcaggtttttttcctttgcaatgaatcaataaattatgtcacaacccttaaccccaagtttttgctttagcaattcaggataatgccaaaaacttacttagcttttagtctgtgccaggcattgttctgaacaaggtacatacaatgctgtcttgtagaccctggatttggaaagcccccaatccctttataaagcatatgtataagttgtatagataagtgtattttcaaaagtaaacatataaaaattcataattgatatttgaggatcaaatattttcctcatttatgtatctaacccacaaaaatttaattgtttataagacattttatggagacctttacatttatatgaagtaaaatttaatatgttccttaactatccaatatatttgagtatctgtgagatatgctatgtgctgagggatacaattaaaaaatagaaaagatttgattcttgtctttattttttcaattatttcaggtggcaaacacagatggtcacaatataatgtgacacctccattttcccaatgagaatattaaataaattgttttgactaacttgaatatgtaaactttagagatgaagatgaatttctgtatatttatttaagttatacatacatatttaaaatagcattatatgagataattttcaaatgtaactcttctctcctggcttttcatgaagcaattttatctaaactcttcaaatgcatctttgacatatgagggtttttttcctctctagaacctctttttgagttgtctgacacagttttctacggttccatttgaattgtctgaaatccaacctattttgaatctatttacgttgtggtcactggaaattttctctcaggagcccctccattctcattattaaagatcagttggttttctttttcctcctgtagaagcatgtatgttgatctctgtagtgtaggcacttattataatacttaaaaaaagtcatttttgcaaggcttgtttacaatgaaatccaatatttgccaatgtgaggcaatatccctaggagttaaatctgtgttaaatctcatcgcagcttttactgcaatttttactgattcagatgattgtttctgggggacttctctaagcttccacagatcctgttacttagggtaatgtcttctccaagtgatactctgttattcaaagtaggactggagagagtaaaaagaggttctggtaataagaaagactttctatggactttattaatagaaatagaaaacaatttcctattttctgagggattttttttgggaaaagtaaactttgccttacacttgggcatttgttgagttgccagctaacatctcttagcggggagttggtagataggttctatttaacccagtgtttttcatgctgttctattcaccactgcatactgctttgccttgccgtgaagtgtactctttttacccaattcctcattttcatatttctgttttcatagtatcttgttagacttttacttcttgagtcagatgaagaaaacttaatcagtattgatgtcttcagtatcataaatatctgtaactcttactttgaatgtaagagtaatgttctgattactgctaagattctaccaaattgactttcagtacatattgatgtatttctggaatgaatgttcctgtgatcttggcttgcagatgaaaaccttaatatttgaatcagactggtgcaatgtggaaagacaaaatacacacttgaaatatttgcatgataatctacggaacaaaaacatttagtgggagtggtggtagaacgtttccaggatcaacacttgaatgctgtgagagaactatttttttttttaatggatggcaggtggcagagttgaaaaacaggtttttataatggaaatgctaagagtcttagctataggagtatgaatggtattgttacaatagatataatagatgtattgcattatcttatctcatcagacacttttgttagtaaaagcgcccccccccactagtttcagtctgctcttgcagagaatcactcctctcaacaatttttgctacttacaaaatttttgagattcaagatatctttaatctgtcgagtttcagcagatttaataagcataaatttattttattaaaaatattttaagtcaggaaagtaagtataggaaacagaccagatgtaattcagattacaggatctggatttgcccctttaatgaatgtcagctatgctggcaatattctgctggtttcctttttttttttttttttaacattactactcatatttcacatttgatttgttttcaatatccttactcttaggaaggggcttaggaaattgaattacattttatatgtttagttcctaatctcattcttattttaatacctgttcagattcttaaggctttttgtaaataggggtctgtggtgtctgtaagtctgggggcctaggagggagtctcacacaggagtccggtttgatcacagtggatagggtactctacagtgtgcttaaaggcaagggggctctaagaaagagcagccctggtcagtgtgttctgagaaagcagggcagtgtctgagaggtgagttaaaataggagtgagtagtcaccattttgggatattagacaggaagtgctttctgtacatgcaggctggaaatgcacacaaccctcctgccccatccgtgagcagtccagtgtggggagaggaaggaaggtgggatgtggttggtcataactgtgatcccttttcttctctataatgctgagtgttcacaattgagaactgactggtgagtccttggtgagttaaggcttaagctgaggtccctgggtagttaggtagttctaagaatgtatttgttcaatagaacttttgaataacttcacttagctagcttgttagtgctaggaacccaaagatgacaaacagcccattcctctgaaaaactgtgactctggtgaggtgcatagttatttagacctgccggatgagaataccacttttccccgcaccaaatctacctgctggagtgaatttatttcatgtagactctgaggtccctctgttgcttttgataacgtgctctcatctgaggccagctccgttacttgtatactcatcctgtctcccccgccaaggtcattgctcctgcagttttctgctttctctgttggatcattttccttctttgctggatcattcctatcatcaaacattctgtgatatatcctaccttaagctaatcttgtttctttttttttttttttttgagacggagtctcgctctgtcgcccatgctggagtgcagtgacatgatctcggctcactgcaagctccgcctcccgggttcacaccattctcctgcctcagcctccccagtagctgggactacaggcgcccaccaccatgctaatttttttttatttttagtagagatggggtttcaccgtgttagccaggatggtctcgatctcctgacctcgtgatccgcccgccttggcctcccaaagtgctgggattacaggcgtgagccactgcgcccggccgataatcttgttttttgacaccacattcttactctccaacttcctgataccacgttcttcctctccaactattccatttttttctttctctgtaatagcaaaattccttggaaggacctgctgcttctctttctgtttctagttcactctacggaggcccttttacttgaaagtgctctcatcaagttcaccaatgacctttgcttggccaaatgcaaatgccacttctcagtccttatcttatatagtctttgtttgttagcatttgccacagcttttcactctttccttctggaaatactgtggccttctggacactactcccccttgcttattggttctcttcctatttcactggctgccccttcagtcatctttgctggttccttcttatcataccgaaatgttggagcatccccaaggcactttgttttacttttccacctatactcacttatttgggtttttatagagtcccatagcttttaggtactttctctatgctgatgcttttttttttggaaccctgggctctctgcttacatatcatctgaatttggatctttaaaaggcatgtctatttaccatgtccaaaactactaatctcccccacaaatctgttgctccatgttcttcatatctcagtaaaaggattctgagtcttttcagttgcttgagccaaagactttggagtcaaggataactacttgtttccacatcacacactgagtctatcagcaaatcctgctggctctacctttaagcatatccataatcctatcatttttatcaccttcacttaggctaccactgtggtctaagccagcatcatcttgcctggattataatagttacctgttttatctcctagcttttccctcaaccatctgttttccacacagtgatcagagattcttcgaaacctaagtcagattattttacttttctgctcaaaattcacaatgctgtctagtacaactttctgcaaaaatggaagtgctcggccaggcacagggtggctcactcatgtaatcccagcactttgggaggccaaggtgggtggatcacctgaggtcaggagttcgagaacagcctggccaatgtggtgaaaccccatctctactaaaaatacaaaaattagccaggcttggtggccagtgcctataatcccagctacttgagaggctgaggcaggagaatcacttgaacctgggaggcggaggttgcagtgagccgagatcacgccactgcactccggcctgggtgacgagtgaaactctatctcaaaacaaacataaaaaaaggaagtgctctaatctgtgctaatatggtagccactggccatgtgtctgttaagtacttcagatccggctagtgcaactgaggcactgaattttaaattttattttaattgatttaaatgtaaatatccacatgagtggaagccaagatttatatcatgttctgaggtttacaaaggccagatgaagtgaacaccttttctacttctcttgacttcatctcctgctaccactgccgccctcattttcttgctcttctttgaatataccaagcatatgcttgcacttgctattccctcatgcctggaatgttcttcctccaggtgtttttttttttttttttttttttttgagacggagttttgctctttttgcccaggctggagggcaatggcaagatctcggctcactgcatcctctacctcccgggttcaagtgattctcttgccccagcctcctgagtagctgagattacaggcgcgtgccaccacgccccgctaatttttgtatttttagtagagacgcggttttgccattttggccaagctgatctcgaactcctgacctcaggtgatccacctgccgcagcctcccaaagtgctgggattacaggcatgagctaccacgcctggcctccttcttttcattttaggggatgagagttcgaagctaacagataataaaacttataaattatctacaaaccaagaatctgaattgttgaaattttcactttacaagagaagatctagttaggtttatatgataatcttgaactgctacaaaacagatgctgtgggctgggcatggtggctcatgcttgtaatcccagcactttgagaggctgaggtgggaggatcgctttagcccaggagtttgccaccagcgtgggcagcgtagtgagaccctatccttacaaaaaattaaaaaattagctgggtgtggtggtgcccacctgtagtcccagctactctggaggctgagatggcaggatttcttgagccccagattttgaggctgcagtgagccatgatcatgccactgtactccagcctgggcaacagagtgagaccctgtctgaaaacaaacaaacaaacaaaccgcccccctcaaaaaaccaactcaatacaccagaaccaaaaaccaaaaaaaacccccagaagttgggtactgtggctcatgcttgtaatcccagcactttgggaggttaagttgggcagattgcttgagcccaggagttcgagaccagcctgggcaacatagcgagaccctgtttctatgaaaaatataaaaatttagccaggcatggtggcatgcacctatggtcccagctgctaaggaggttgagtgggaggatggcttgaagcctgggaggtggaagttgctgtgaggcaagatcatgccactgcactccagcctgggcgacagagcaagaccctgcctcaaaacaaaacaaaataaaacaaaaacaccacaaaaaccaaccaaacaaaaaattgttgctgtgggaatatttgatgggtttaatacttgttaatatccagtagagataattaaggctgatccttgattccctttccctagcattttattgtggttcatttaggtgttctcaatgttgagtgaacttttcaaaaatactcttccttctctataacccaaagagtatattcttcaaagctaccttctacatgactccctcacccaaaaattcatctttgtttctagcagcctacgctactcatttctttgagcccacctttgaatttaggacttgtaaaattataaacatttataaatgtttgatctctatgtccatggaacagctttaaaaatcttctttaatctctgagatgaggcagtcaagaataaggcatcttcgattacagaatctctttgaagttttctttctatttcaggttttccctctagcactcctacgttcggtagctctaaggtggatttttttaattaatctttttcctttttgcttaggtatccttggcagtctttcaaaagttaagaggcaacattagtaaaattatactttcaaactttatcattttcgaactctgtttctctagtaagttaatgagctagagacctccttttaaaataatctcatctattttacattttaatgctgtttctgttgtagatattacagtcctaaaaatgtgttattttcttagagtagactggaaagctcaaattaatcaatatgtctccagcctagctaccatccatttctgttttataggattatatacttgtttattttataaaatggaaagtttgaaatcttataatattttcatttatggttttatgtgaatcaaacagtcttggttcaggtgatttaaaaatatcactacaaaaaggagatatcttgcttatttttcattcatgtagtcctgtgtgaaattattggtggtctttctgtctccgtgaacatctgcagccacacagagaaattttatttgccttttgttatcagattcacatattatgaatgttgaggctagatatcattgatatcattgattagaaccattaaaatactaaagatactagtaaagaaaaagatactaatgacaaaaaaatactaatcttgcatattaatcttgtttttacttcagtgttagtaaaaacactagtaaaaagcagttagttacttcctttttattttgtatttgacattacacacacatgttctgcacgttctgagaagaaagtgtcagattgcttcctgtttgagtttagatgcaatcgctagtcttgctgaaagccaatgaaattgaaaggcttagctttgtaagtagaatttctgtttctttaactctatagttgataatattgtttctcaagtttcctttggtaggtattctcagggaacgttccaggatcttgtaatacttcttgtttgattagaaaatgattcattacgtgcctttcagctctttaggaaagtggacggccttcacatcagtgggattgaattcagaaaaagaacatactactaaaagtacttttgtaattattttattagtttttctcatattattagtttttctcatatttcagtgaaatttcttatattattagtttttctcatattcagtgaagtgctaaaaatgatgtccaaatttatgtttaaagtttcacagagttatacactgactttaaaattgcattgctttattttaaggattagagaaatggtagtgcacgggttaagaatttgggtgatggcaccaggctgtgtaagtccaagagccactttgcttgccatgtgactttgagaaagctgttccatctctttgtccccagttttctcatttataaaatgaggataatagtgcttattccatatgacagttataagtagtaaatgaatttaaatgaaaatatttaaggtacttaaaagtgctcatataagtagtaggctgcttattgtattgtactaatattaatgaagtattaacagttgttaatactgtgttttaattcttgctctttcatttgatagtcatatgactgtccccaggttactttactttcagtctcatttttcatctttaaaaacaagattatattatgttgtatctaataaggccatcatgatgattctagactagatatgcaaattacctactatgcacagagtaagggcaccataattttatttttttgtttttattttttatttattttattatactttaagttctgggatacatgtgcagaatgtgcaggtttgttcaaaacataggtatacacgtgccacggtggtttgctgcacccatcaacccatcatctacattaggtatttctcctaatgctatccctctcctagccccccactccccaacagcccccggtgtgtgatgttcccctccctgtgtccatgtgttctcattgttcaactcccacttatgagtgagaacatgcagtgtttggttttctgttcgtgtgttagtttgctgagaatgatggtttccagcttcatccatgtccctgcaaaggacatgaactcatcctttttatggctgtatagtattccatggtgtatatgtgccacattttctttatccaatctatcattgatgggcatttgggttggttcctagtttttgctattgtgaaaagtgctgcaataaacatacatgtgcatctgtctttattgtagaatgatttataatcctttgggtgtataccgagtaatggggttgctgggtcaaatggtatttctggttctagatccttgaggaattgccacactgtcctccacaatggttgaactaatttacactcccatcaacagtgtaaaagcgttcctatttctcgacatcctctctggcatctgttgtttcctgactttttaatgatcgccattctaactggcatgagatggtatctcattgtggttttgatttgcatttctccaatgaccagtgatgatgagctttttttcatatgtttgttgaccacataaatgtcttcttttgagaagtgtccgttcatattcttcgcccactttttgatggggttatttttttcttgtatatttgtttaagttctttgtagattctggatattagccctttgttaaatggatagattgcaaaaattttctcccattctgtaggttgcctgttcactctgatgatagtttcttttgctgtgcagaagctctttagtttaattagatcccatttgtctattttggcttttgttgtcattgcttttggtgttttagtcatgaagtctttgcccattcctgtgtcctgaatggtattgcctaggttttattctagggtttttatgattttaggtcttacgtttaagtctttaatccatcttgagttaatttttctataaggtgtaaggaaggggtccagtttctgttaggggtccagtttcagttttttgcatatggctaactagttttcccgacaccatttattaaatagggaatcctttccccatttcttgtttttgtgagctttgtcaaagatcagatggttgtagatgtgtggcattatttctgaggcctctattctgttccgttggtctatatatctgttttggtaccagtaccatgctgttttggttaccgtagccttgtagtattgtttgaagtcaggtagcctgatgcctccagctttgttcttctgcttaggtttgtcttggctatacgggctcttttttggttccagatgaaatttaaagtagttttttctaattgtgtgaagaaagtcaatggtagcttgatggagatagcattgaatctataaattactttggatagtatggccattttcatgatattgattcttcctatccatgagcatggaatgtttttgcatttgtttgtgtcctctcttatttccttgagcagcggtttgtagttctccttgaagaggtcctttacatcccttgtaagttggattcctaggtattttattctccttgtagcaattgtgaatgggagttcactcctgatttggctttctgtttgtctgttattggtgtataggaatgcttatgatttttgcacattgattttgtatcctgagactttgctgaagttgcttatcagattaagaagtttttgggttttctgaatatacaatcatgtcatctgcaaacagaggtaatttgacttcctctcttcctattcgaataccctttatttctttctcttggctgattgccctggccagaacttctaatactatgttactatgttgaataggagtggtgagagagggcatccttgtcttgtgtggtttttcaaagggaatgcttccagcttttttttttttttttttgagacagagtctcaccctgttgcccaggctggagtgcaatggtgcaatttcggcccactgcaaccttcacctcctgggttcaagcgattctcctgcctcagcctcccacgtggctgggatcacaggcatgtgccaccatgcctggctaattttttgtatccttagtagagatggggattcaccatgttggatgggctgtctagaactcctgaccgtgtgatccacccgcctcggcttcccaaagtgctgggattacaggtgtgagccgctgtgtttggcctcagcttttgcccattcagtttggtattggctatggatttgtcataagtagctcttattattttgagataggttccatcaatacctagtttattgagagtttttagcatgaaggggtgttgaattttatcgaaggccttttctgcatctattgagataatcatgtgttttttgtcattggttctgtttatgtgatggattacatctattgatttgcgtatgttgaaccagccttgcatcccagggatgaagccgacttgatcgtggtggataagctttttgatgtgctgctggttttggtttgccagtattttattgaggatttttgcatcaatgttcatcagggatattggtctgaaattttctttttttgttgtgtctctgccaggttttggtatcaggatgatgctggcctcataaaatgagttagggaggagtccttctttttctgttgtttggaatagtttcagaaggaatggtaccagctcctctttgtacctccagtagaattcggctgtgaatccatgtggtcctgggctttgttttggttggtaggctattaattactgcctcaatttcagaacttgttattgctgtgctcagggatttgacttctttctggtttagtcttgggagggtgtatgtgtccaggaatatatccatttcttctacagtttctagtttatttgcttagagatatttatagtattctctgatgatagtttgtatttctgggggatcagtggtgatctcccctttatcattttttattgcgtctattcgattcttctctcttttcttctttattagtttggctggtggtctatttcattaatctttaaaaaaaaaaaaagaaacccagctcctggattcattgattttttgaaaggttatttgtctctctatctccttcacttctgctctgatcttagttatttcttgtcttctgctagcttttgaatttgtttgctcttgcttctctagttcttttaattgtgatgttagggtgtcaattttagatctttcccactttctgctgtgggcatttagtgctataaatttccctccaaacactgctttatctgtgtcttagagattctggtacgttgtgtctttgttctcattggtttcaaagaacttattcatttctgccttaattttgttatttacccagagtcattcaggagcaggttgttcagtttccacgtagttgtgtggttttgagtgagtttcttaatcctgagttctaatttgattgcactgtggtctgagagactgtttgttatgatttctgttcttttgcatttgctgaggagtgttttacttccaattatgtggtcagttttagagtaagtgtgatgtggtgctgagaagaatgtatattctgttgatttggggtggagagttctgtagatgtctattaggtctgcttgttccagagctgagttcaagtcctgaatatccttgttaattttctgtcttgttgatctgtctaatgttgacagtggggtgttaaagtctcccactattattgtgtgagagtgtaaatctctttataggtctctaagaacttgttctgtgaatcggggcgctcctgtattgggtgtgtatacatctaggttagttagctcttcttgttgcgttgatccctttaccattatgtaatgcccttttctctgtgtcttttgatctttgttggtttaaagtctggttcatcagagactaggattgcaacctctgctttttttttgcttcctatttgcttggtaaatattcctccatccctttattttgagcctatgtgtgtctttgcatgtgagatgggtctcctgaatacagcatgccgacgggtcttgactctttatccaatttgccagtccgtgtcttttagttggggcatttagcccatttacatttatggttagcgttgttatatgtgaatttgatcctgtcattatgatgctagctggttattttgcccattagttgatgcaatttcttcatagcattgatggtctttacaatttggtatgtttttgcagtggctggtactggtttttccattccatatttagtgcttcattcaggaactctagtaaggcaggcctggaatctctcagcatttgcttgtttgtaaaggattttatttctccttcacttatgaagcttagtttggctggatatgaaattctgggttgaaaattcttttctttaagaatgttgaatattggccgccactctctgctgacttgtatggtttctgcaaagaaatccactgttagtctgatgggcttccctttgtgggtaacctgacctttctctctggctgcccttaacgtttttttcttgatttcaacctttgtgaatctgacgattatgtgtcttggggatgctcttctccaggagtatctttgtggtgttctctgtatttcctaaatttgaatgttggcatgtcttctaggttggggaagttctcctggatagtatcctgcagagtgttttccaacttggttccattctccccatcactttcaggtacaccaatcaaacgtaggtttggtcttttcacatagtcccatagttcttggaggccttgttcattccttttcattcttttttctctaataatgggttatttcattaagttgatctttagtctctttagtctctgatatcctttcttccgcttgatccgtttggctattgatacttgtgaatgcttcttgaaattctcatgctgtgtttttcagctccatcaggtcatttatgtttttctctaaactggttattctagttagcaattcctctcaccttttttcagggttctttgcttccttgcattgggttagaacatgctcctttagctcataggagtttgttattacccaccttctgaagcctacttctgtcagttcgtcacactcattctctgtccagttttgttcccttgctggcgaggagttgtgatcctttggagaagaggcattctggtttttggaattttcagcctttttgcgctggtttttcctcatcttcgtggattcatctacctttggtctttgatgttgttcaccttcggatggggtctctgagtggacgtcctttttgttgatgttgatgctattcctttctgtttgttaattttccttctaacagtcaggaccctctgctgcagggctggtggagtttgctggaggtccactccagaccctgtttacctgggtatgaccagcagaggctgccgaacagcaaagattgctgcctgttacttcctctggaaacttcgtctgccagatgccagccggagctctcctgtatgaggtgtctgtcaaccccttctgggaggtgtctccaagccaggaggcacgaggatcagggacccacttgaggaggcagtcctgtcccttagcagaatttgagcactgttctgggagatctgctgccctcttcagagccggcaggcaggaatgtttaagtctgctgaagctgtgcccacagctgccccttcccccaggtgctctgtcccagggagatgggagttttatctataagcctctgactggggctgttgactttctttcagagatgccctccccagcgaggaggaatctagagaggcagtctggctacagcggctttgccgagctgtggtgggctctgcccagttcaaacttcctggcagttttgtttacactgtgaggggaaaaccgcctactcaagcctcagtaatggtggacatccctccccacaccaagcttgagtgtcccaggtcaacttcagactgctgtgctggcagtgcgaatttcaagccagtagatcttagcttgctgggctctgtgggagtgggatctgctgagctagactacttggctccctggcttcagccccctttccaggagagtgaatggttctttctcgcttgcattctaggcgccactagggtatgtagaaaaactcctgcagctagctcagtgtctgaatggctgcccagttttgtggttgaaacccagggccctggtggtgtaggcacccgagggattgtgaagaccatgggaaaagtgtagtatctgggctgaagtgcactgttcctctaggcacagtccctcacggcttcccttggctaggggagggagttcctcgatgccttgtgcttcccaggtgaggcaacgccccgccctgcttcggcttgccccccatgggctgcccccactgtctaaccaggcccgttgagatgagcctggcacctcagttggaaacgcagaaatcacccgccttctgtgttgatctggctgggagctgcagaccagagctgttcctatttggccatcttgccagccacccctttatttttattttttatttatttttatttttattttttcagacggagtctcgctttgtcgcccaggctggagtgcagtggtgtgatctcaactcactgcaacctctgcctcctgagttcatgccattctcctgcctcagcctcccgagtagctgggactacaggcgcctgccaccacgccttgctaattttttgtatttttggtagagacggggtttcaccgtgttagccatattggtcttgatctcctgatctcacgatccgcccacctcagcctcccaaagtgctgggattacaggcatgagccaccattttttatttttttgaggcagagtctcactctttgaaccaggctggagtgcagtggcataatattggctcactgcaacctctgcctcacaggttcaagtgattctcatgcctcagcttcctgaatagctgggattacaggtgtgcaccaccatgcccggccagtttttgtattttcagtagagacagggtttcactatgttggccaggctggtctcaaactcctggcctcaagcaatccacctgcctcggcctcccaaagtgctgggattacaggcgtgagccatcacacacagccccataattttattaatagtagttgtagttcagtttttataattttctctcctgaaaaccctgccggatacccattttcctttttgtttaatctattgtaatatttaactgtatcctgctaaattgatatctagagagtttctaaaaggaggaactcttgggattcagggctttagacacgattgaaataaatgtctttcttaattgcagaccgtgagagaaacgtggtggtgatcattaagtttccactactgagtgttaaaaaaggatgtgagtgctgagccaacattttctctctcttttatctcctgttattccctcctctctgtccattaatatctgttgtgaggtggttatggcagctggagttatagtgcggacatgatagtgctgtaataggaactgcagtcctttcattttatagtgatggcatgggagccacggaaagctgtaaagcattggagggttacaagagttccagaagtactgtaagaaacctgaagttgcatttccttacattcttatatttgtgatggttatagttagaaaaatcactggaataatttggagtctagggaaagctttggtgtgggctagttttgtatgaatatttacttttgttaatattacataccaatttttgtttctaaatggaaaccttagcttactgagcttcacattgattttgaggactgtgtagtggtgattgaaaaataggttacagccattttggaagagagaatacactggacttttacatgaagtatggcatacgatacatatctgacacatcttgctaaaaagcaagtccttaatgacatgacctcccatcttgagcatagacacatgttttaaattcataaatgatggcctattgagagatatctattgtgttcattaaaatatacatatgaaacgaggatcaaattaaacatttcaagtagctaattttatcagctcttaataattaattagtttttagcatttagaatgaaggtaattaaaatagatttactacatgctataagatttctgcctctggaagatgaaaggggacatttatttttcatatgcttaaacattggcgtttttgcttttgttctatggggattttgtatgtaacaaaaaaacttactgagttattttattatgaaattttaattataaaatatctttaatgctttttagtcggcctaaatttaattgtagtttgttggaatgttacaattttattttaaatttctaaagttaatataaaagtcttttctgctactgtggtgtattgttatatcattttatttatatttttataatttgatttttaaagtgggtcatatctttacatagttcaaaatacccaaaatataaaggcaaaagtttttttcctgtctggattccttatttgcttggttctcctataatctccaggtaaaaacattagtttcttgcatatccttccagagtttatacaaatgcaagtagatatacgtacatattataagttttttcttttatcacattttaaaaagtataaatccagagatattaagtaatagataataagtgttagatgtcagataataacttgtaaagaataaagttgcattattgttatacttggaaataaaataatttaattacatgtctctctccagttatttcaggttgagtgtacgtttgcttcgtcttcaaagtagaaagttcctggagaagacctactctttctggaactgtttttgtttgacccatgctatgcaaacttactcattcatgcaaacactgggtgctttatgcaaatattaccacctgtattttttatttgtgtttctcaaaggagttttggcaaaatttgcataatgacttggctcatttagctttgtgtattgttaagagttcaaattctgtggatatgaaagtttacagtgtataccaaataaaaaggtcgtgtggtaggcagtgttctcaggataagcctgtgttaggtattcaaatctaatttgcatattggatctagacctatgactattaactccatttacagttgataaaaatttgcataaaattggtcatcttgatagcttaaggtatactgagcaaaatgttaactccttgggtagcatgtgtgactgtatgattgtcaagatgaaagttaatctaagcacatttggtttactgataatcatttctagaaatgagctgtagtatcatgtcagaatgtcagaaacatgtctgacaatttaccttttcatactagaaatggtggatgacatgtttcaaatcctggcagctgtgctgtatcaaatcctccctatgtgaatatcatgcttggtacttagatagtttaggagcagtactgtggcttgtgatttgttgtataattctgaaagaaaatatattaattttgtgcactttatattggctcttgctttattgtagcctttatccattaatctgctactgatggataatttctcaatcatttggtcctttttgtaatggctatgtggagttggcaattctttttattaaatattgcatgactgtatatgtgttaataatttattggggtagtgagctgatataaatctctttttagatgaagtttttggctatttacaaaggttgattactttttagaacagtgattgcctcagatttgcaaaggttgaggaaaagcacacctcttattttacctttttccatttgtggttaaacctattgtaaatatattggaagggttttaggcccttgaagacgcctctgtatttgaacagtttgattctgtcaatttcatttaaatcattattttttgtaagacctcaggataaataccacttttgaggtagtgactgaacaaacatgagttcttgaatagtttctattaaaatgttttttttaatcctatgagtggtctctgtgccttttaaaataagattttaaataagatgataattaatactcaagatatgatacttttatttatagtgatttggttgccttgatcatatttaatgatgatttaaaaaacctggatggagagagagatatatatgtatacatatatatatatatatacacacacacacatgaatgataaattattctgtaatattatttatacattcattgtttctagctagcaagcacccttagtgtatttaatgtattagatttatataattcactctatgtacaatattagattaggatgagaattatatgaaatgaggcatgccactatcaagtctggcatgtttttgttaccaagttctgagtgctgaatgagaaacagtcatgtatttactcagattgatcccggatcccctgagggaattggcagtttcctctggatggcattgctaaatcttcagttttctttcttcctcgctctctctgtggcccatacttaggtcagattactgagaaaatcagtgttattgacgaatgccttgtacatgattataaaagtctcaatacctctgagaaagatcagaaacacataattaaatgcaaatagggtaacttatttaattttgagttaattatagcttcatccaatgtcattgattactggggcagcacaacttggtgtccatctagtacagatgatagtgattcttattttttcttttagatatattaatgcttgactttgaggataacacatttttaattcagaactagtgtttaagttttttgttgttaagttttaacaaaagtttttcttgtgggcatgggaatggtaagtagtgattaaagttttgaatttaatggatataaggaagaaaaataaactgagaattgacttacattttttcttggagaggaggggattcagcactctcagagcctctcctctgttagcgtgctggtagttgatgaggatgaagttgatgagatgagcaagaatctggaaggaccaagcataggtatactaattacacagaactttaaaaatccgtgtatgattatttcattgcattgtagaattgcagatgagaaaagaatttgcaatatttaactcaaatttgttttatagctaaaataaccgaggcccgcagagattgggagatgtgtgtgaagccattgaatgagttactggcagcctagaatccagatcatatttattcaacctaatgccttcttctgcattattctctttccatgtttatttgttatacatacagtagttgttattggcttgctagatggttatgtatgattgagaaaggaggtaggaagacctaatgaaaagtttatttcacgattctgctgaagacttggtctgctgacagttaataatagtagctaatataacattgagaacttgctgtgtaagggacactgtgcaaagagcttcatgggtacttacatgtaatctccacagagttctctgaggtagatagcagtattataatactattttgtagatgcaaaaaccaagtcttaaataggtgaagtaatttgctaaagatacttatctactcagtatgggggcacatatttgaactcctaccatatcccattctgcttccctttatttatcagtcagcatataagggaaggtctttgaacagatccaaagcccttgtcagctctcatgtccagtgactactggaatttaagttttttccctctttttctaagaaaatttttcttttcattataatatgaaaatcagctaattgaatctcaccccagatttcaagggattggactccttcatgtcaagtttattctggatagtctctcagcccttagggaggaatggggttagcttgctattattgcttgctattatttggtcctcaggattttaggcttttacgtcgtggttagtggtttatcaaccatcctgaaaatggcataattatagtcttttgaggattgatggtagatgaacaggttacctgatttacctttccttgggaagttggaacacttgcctacctcttgcctttccatattttcttctttctccatgattcctcagaggttacttacttactgattcagcagcctcacttggttgttctttgattccctgggatatcagttttctgggctgggtttggagcagtgaggcattctttattcttcttacccactgtggcctctaattccttttaaccatattcattgtatgcttttctcatctgaagaagatggtcacatccagtttctcagtgtgaggatgaaaaactcactggtaatttttgttttgggtctccttattgattaggactctagtcctgtcatactgattaaatctcagaagggtatagatgtagggagtggaatctgcttgttcccactgagttcggaaacaaggaggatactgtgagcaaaggtttattcagtgatttttcttcctcttctactttttctttttctgtgtattatttggttctggcaagtaccaataaaagaatcaccgtgcagacctctaggattttagagcaaatttgtgccctctctgctgataatgattcttcttttgagaaacagttcctggcttttgactttgctagagactgaacacctactcatgagatctcaggtgaccatgtggctgagtttcccatcatgaattggctgttgtctgacctgtttagccataggttgggaacaagcagcagctatctgttattaagtgaaaatggtatataagagaccaaggttgggcaggtccagataatataagtaagttaaacgagctggtggctcagactcctttgataccaacttctgttccattgcttccactccttcactccatgtgtatggtctcctgggatgttccttatggaccatttgagtgaagaagaaaatttgagcctagtttataagtgggtctggatgatatgcaagtgttactcagaagcagacacggaaacactaaagccccacaaaagactcaccatgaaggacaatggtgaaggaagatcttcccagtggacagaacttctgtgcattatattttgttgcctactatgtctgcagtaggagatggccagggacaaagatctacattgattaatgggcagttgctaaattttttttttttttttttttttttttgagacggagtctagcttagtcacccaggctggagtgcagtggtgtgataccggctcactgcaacctccacctcccgggttcaagcgattctccagcctcagcctcccagatagctgggattacaggcgcttgccaccacgcccggctaatttttgtatagttgctaatgttttatcttggtggtcagagacctggaacaaacaggatgtgaagactggtgacaaggaagtctagggaagaggtgtgtggatagacctctctgaatgtccacaaactgtgaaaattgagtgccatgtgaatgcctgttaaagggcatctactgcaaaggatacttgctagtgagctggacagaacaacgtgctgtgtgcatgtcagtcagccttttattcacccacattagggcttgctcagtggacccatgaaaaggtggctatattggcagggttgggagctcttcatgggttcaacaataaggtctttccctttacaagactgattggctactgttattgctgagtgcctaatcagccaactgcagagtccaacattgagtccctgatatggcaccattcactgaggaaccagccagccatctgctagtggttgattatattggacctcttccatcatggagggggcaaagatatattctcacagggctagtagcatattctgcatatggatttgctttctctacctataatgcttctgccagcaccaccatctgtagactcacataaaactttattcactgttagggcattctgcattgtattgcttctgatcaagaattccttctctagcaaagaaggtgcggctatgggctcgtgctcttggaattaactggtcttgccccataccccgtgatctgaaagtggctagcctaattgaaaggtagaatggcttactgaatactcctaatgctaattgaaaggcagtaccatgaaaggatggggttctgttttacaagatgtagtatacaatttgaatctgtgaccaatacatgtgctgtctctttgactctgggattcaaggggtaagtgagagtagctttgctcattgttacacctagtaactcacttgcagatcttttatttcctttcttggaaatactgagctttgctgagctctggtttggagaccttggacttcaaggggatagtgtttccactagaggatacaacagtggttctatgagattggaagatggggctgcttcttggccattttgcagtccttacactactgagcaaatactcagaaagaggagctaatttagtcactggagtaattgatactgataaccaaggggaaattggggatttgatacactgcagtcaaagagacaatatctgaaattcaggggattctctgggcacctcttagtacttccatccccaacagtgaaggttaatagaaaataataccagccaaaaaagggcaggatgattaatggctcaaatatttcaagaaggaaggtttgggtcactccaccaggtaaagaactcagagcagctgaggttgtttcatctctggagctttgatctgggtcttctttttaatatcctcgagttctatgcttaatttttgggtacactaataatggttataataactttttaatgatttatctattctaacatctgtgccaattctgggtcagttcttattctccaatttttcttctcattatgggattcctttttcttattttttacatgcctggtactttttgataagatgctaaacattgtaaattttacctttttggttgctggatatttttgtgttcttataaatatttttgagctttgttctggatgcagttaaattacttggaaacaggttggttctgttcagcatgactggagccatgctcagtcaagggctaattattccctgctactgaggcaagatccttctgtgtgctttactcagtgccccatcagtcgtgaaattttcatgactggctggtaagaacaggcattatccccagtactgagtcagctctgggcgccgttactccattcttttgaggtcattctttccccagctttggttggtttcctcacatacatgcactggtcaatgctcagctgagtactgtaattactcctctcaagtactctgtcttacaaactctagcaagccttgatttcctcaaattcttaactctgtcttagtgcagagtcttctggactgactgccttgcacaactgcagccaagtctggaaactgacaaagcagtaagctggggcaattgtagggcccacttcatttgttttccgtctctcaggggtcactgttctgcattgtgttatgttcaatgtcttgaaaaattattgttttatatgttcggcctgttttttggtcgtttcatgtggaagcttttaatgttaatgttatttctgagaccatatatttatataacattgaattggataagattaaacagaagaaacattatttagaaagttaaaaaaatttttctgcgtgagagcctgttgttagttatttagaatcacttcttaatcacagcaagatactttgttttattgaagatttgtttccctctagattttctccttattaaatagtagaacatagagaagagaacagttaaggtcggccggattgcttctgcaggtttgtgtccatagagaagctgaatgtgtagaatttcaagaaggtaattgagaagtccgggagtagagtttatctcaacaccaaaagaatcatttttaaataaatacagggtgagaaaagtgaagaatcaaaagagtagcttttgaagcacagtattcctaaggtcttgttttaaggatatgtttctgtgtttgttttttattgatttgagatcatcttaatgcgtgttagaaaatttatcaggctgaacgagttgatcctaaaatgctgcagaaaagttggatgtgaaatgggaaagaaaactaactttcatgagatgcttcgtaaaatctatttcaattcagggtgaaaattgcaaaactgtctgccaatgcgtttttgatggacattctggctatttgtgtgagtcttctgcattgaggttttatttattgagcttccttttgcttcactctagaccaggtggtttacatatgttatctcatcttgtccttctgacaaatcctgtgaggtatgtggtgttaatctcattttaaagatgaagattttcaggcttatagggtttaggtagttgacttaaggtcactggtagtaagcagggattatggctgggtctttgactgctaggcaagtattaacacctcatcacacacatgggctgctttttctgaaggtagtaggtggagatttctttccttgagtaaaagggcaaaaaagaaagaacgtaaagtagtttttagaagtagtttcttctggtcaccaaattaacaggaaaagggaaacttgtctaacctaggtgttgtgttttccccattattctgactacagtaatttctgttgaaataaccacagtcattttgttgaaaagccatacgtgtttctaaataaaatagttacataattttaagtgcatattttaattaattacacattcttttaaattattcatagactatcatagatttttatatcagttggcatctggagtcacaatgtaaatattagaaaaaagattcagaggacctttttcccaaataaaatcatgtgaccctaaagaacaatttaaataacactataaaaacagagttatcaggagagggagtggtggctaccgatatttaccattttttcttggtggggatttataggaatagaatacagtcagttcctctatttatttatttttgtttgtttgtttaaacccgttgctgttgtgtcattaagaatgtaaaataatgagatagcttttttcttttttcttttttttttcttttgaacaagtctcactcttttgcctaggctggagtgcagtggtgcgatctcagctcactgcaacctccgcctcccaggttcaagcaattctcctgcctcagcctcctgagtagctgggactagaggcatgtgccaccacacctgactaatttttgtatttttagtagagatggggtttcaccatgttggccaggttggtcttgaactcctgacctcaagtgatccacctgccttggcctcccagagtgctgggattacagacatgagccactgcacccagcccaaggtaactcttaataaatacagcaatagctcagggtacttacatctgagtgtgttctgctgttcctgaaataaattaacatatgcatagtaaactctaaagttatcaccatttgggtacatagaagtttactgaggaaagaagtttagtgtctgtcatataaacagcattattatccttggtaatgtctgaagtatacagccaaagttgagaaagtttttgaactaataaaaatatattttcattgattatgagagtgaaattggtacatgtgtaatttatatatatataaagtacacaagttatctatatatagtttgtatacttaaggaaattgaaaatttaagaaattgaaaatctactactttttagtactttttaggtttctttccagttctaagtgagtgtgactttgtataactgcattgtagtatgttctcctctatgcaaaaataaacaagtaaataaaacccagtgttatatccttgacgaggacactattttgttgctgacatatggttagtcatgagttgtattcagtaccataccttcctcatttagcagcaccatctgttaaaactatggctgataccagtagagaggaagccaattatttttgagtttgtgagcatgggataaatgcgaatatgtctgaagttgcccgcagtcaaatcctttacaactggtgtagtcaaacaattggaggtagtgctaccttggggaaccaggtcaggaaagaacatgataatgcttgttcggcatctttctctactcttagcaagggtgatgtgttataaaattaaataacacataattaagttattaaaaagatttgcatgatatgctttgtttttaaggctctcaaactattggtgtttgtggtttgtgactgcagctggcataataagagttggtaaaggtcttttcacaatgaggcaaaacctttacaggaatgattttcttcataggctttttatggatttgggagagtattgtactaataaagttaagcatgaagttattagacatttatcattgatttcatgtctgtgtctttatctgtgttacgaatgctttggactgcacatatgggaatatagcagaataactggccttggagggacattgggtttttcaaaacagacctcttatctgtgtgtgtgctggcagcaagtatgtatttttcgatttccacctggactcttggagcacctttttattttcttcttctttcttccttcttccttccttcttcttcctccttccttcctcctccttctcctccttctccttcttctccttctcctcctcctcctcccccctcctctctccctcctccctctcttttccctccttctcctcccttcttctccttctccttcttcttcttcttcttcttcttcttcttttttttttttgagatggaatctcactctgtcacccaggctagaatgcagtggcacagtctcgactcactgcagcctccgtctcccaggttcaagtgattctcctgcctcagcctcccgagtagctaggattacaggtgtgcaccaccacgcccagctaatttttgtatttttagtagagatggggtttcaccatgttgttcaggctggtctcaaattcctgacttcaagtgatctgcccaccttggcctcccaaagtttattattattattcatcttaatgttctccttaatattgggaccatattctgctaaatgaagcatggtatatatgatttttcctttttctagaggtttatctttggaaaattttattttcttttaacttttatttttacttcaggggtacaagtgcaggtttgttacataggtaaacttgtgtcatgagggttcgttgtacagattacttcatcacaggtattaagcccagtatccgttagttatttttcctgatcgtctccctcctcctgccctccatcctctaataagccccagtgtgcgttgttcccctctatgtgtccatgtgttctcatcatttagctcccacttataagagaacatgcagtatttggttttctgttcctgtgtcaagtttgctaaggataatggcctccatctccatccatgtccctgcaaaggacatgatctcattcttttttagggctgtgtagtattccatggtgtgtatataccacattttctttattcagtctcccattgatggacatttaggttgattccgtgtctttgctattgtgaatagtgctacaaagaatatacacttgcatgtgtctttataataaaacagtttatatttccatggatatctgcccagtaatgggattgctgggttgaatggtatttctgtctttaggtctttgaggaatcgccatacagtattccatagtggctgaactaatttacattcccaccaacattgtataagcttttcctttttctccccaaccttgccagcatctgttattttttgactttaataatagctgttctgactggtgtggaaaacgtttttttttctttttttttgaagtagtgacaactttgaaattatatttggctctgtttttgcccagtcttccctctcctcttccctcatgcacaaacttaccataggaccaataacccatatcaggccagactttcccttccctcactttccctccttttctcttattttcctttctgtaagtaaatcttatccaaaacaggaaacaaacattaataaaatataaaaggcagggagacaatggcaacaaaattctactttaggctagaatctaattcttgagtaattctttcagaaaagatctgggtggtaaattctctgtgctcttgcacaactgaacatgtttcatacttgttggaatgagtctagtttttgaaactttaaaatattttttagagacaggatcttgaacttgggctcatgtgatcctcctgtcttagcctcctgaatagcttggactacaggtgcacaccaccacgcctgactagaatgggtctaaatgtttagattcaaagtcattttccctcacagctttgaggcattccttcctttagaatttattctaatagttaagaaatctggtggccatctgttttctttctctgcaggcatcttttgtttttcatttttcaaaaacttttaggcctttatttttagccttagtcatctaaatatcagaaggacattcctggtgtgaatgtctattcagctacttcatgcttagggctctagggattctgtcaatctgaggtttcgtgtcttagccctggaaaggttttaagtttgtccttaatttccataccttcattttctttatgttctccatttctggcaatcctgttatatgtgtcagcttttgtggactggtcctttgtgcagtgatccacctgcctcagcctcacaaagtgctgggattacagatgattttaaagtgatggtgttatttttcaggaggctaactctattattggtatatgatagatggggaagattttacctgtgacccagaatgaacatgtttgttatgtatttcagtttaaaattaataatgtgtgtgaccaagacactggtgtttactattactgttatgctcttggataaagctaagaatattaaaacttgaaaaaattaatacataatatgttacatatttgtgggtacgtgtaatattttgttatgtgcatacaatgtgtaatgattgagtcaatatttggggtgttcattgccatgaatatttatcatttctgtgtactgggaacatgtcaggtcctctcttctagttgtatatttgaaatatacaatatattgttgctgtctgtagtcaccctactcggctatcaaacattagaacctattctttctatctaactgtatgtttgtacctattaaccagtctctcgttatccctcctagtccttggcacatccccttcccacttgcgatatctattattctattctctacctccatgaggtcaacatttttagcccccacatgagtgacaacatgcaaaatttgtctttctttgcctggtttatttcacttaatgtaatgatttccagttccattcatgttgctgcaaatgatatgattttgttctttctttatggccaaatagcattccattgtatatatgtaccacattttctttatccatttttctgtgacagacacttaggttgatttcatagctttgctattgtgagtagtgctgcagtgaacatggaagtgcaggtatccttttgataaactgatttttttttcctttggataaatacccgttagtgggattgctggatcatatggtagttctatttgtagttttttgagaaatctcaatactgttttccataatggttgtactaatttacattaccaccaacagtgaacaagagttcccttttctctgcatccttataagcacctgttattttttgtctttttaatagtagccattctaactggggtgagatgatatctcattgtggttttgctttacatttccctgatgattagtgatgttgagcatttttccatatacctgttgtccatttgtatgtttcgttttgagaaatgtctattcacatactttgcctgtttcttaattagattttttttttgctgttgagttccttatatattccgcttattaattctttgtcagaggaatagcttgctaatattttcttcctttttgtaggttgtctcctcactttgttcctggttttcttgctgtgcagaagctttttagcttgatgtaaaaccatttgtctacttttggttttgttgtctgtgcttttgaggtcttaatgataaaatctttgcctagaccaatgtcctggagtgttttccctatgtaaaatcacttttttgaatggataatttgttgaatggcacaaaattcaaagggaaccaaaacccatacagtaagtaataagactccatccatctgccgtctgcttcagctaagtatttgtgaagaaactcattgttgcaatttctacacacacacacacacacacacacacacacacacacacacacacacacacacacaaagggtatggatttataagaataaatgtacacacacacacatatatatatacatacataatgttttttgctttctccttttacataaaagttagcatataatacacatgattttcatttaactatttaggttgttgcagaagtaattgcagctaatatatgatttggttaccttgttttatcagttcatcacaaaatttctttctttttttttttttttttttttttttttttttttttttttttttgagacggagtctcgctctgtcacccaggctagagtgcagtggcgtgatctcagctcactgcaacctccgccttccaggttcaagtgattctcgtgtcttggcctcccaagtagctgggattacaagcatgtgccaccatacccggctgatttttgtatttttagtagagacagggtttcaccatgttggccaggctcgtatcaaattcctagtctcaagtgacctgccctcctcggccttccgaagtgctgagattacatgtgtgagccaccatgcctggctgcgacaaagtttcttattttattttttgaagtagtagtatattccattttgaggatatgggatatttatatacagtaaatatttatatatttatatataatatatattatttagccattccttttattctagacatttttgttgtttcttttcttggcttttgctaataacaaaactgctacagtgatacccatgtctttgtatttatgtatcattttgcatatgcataaatatatttttagactatctggaagtgtaattactgggttaaaagttgtgtacatttctaattttgatagatattacctaattgccttgtgtagagattatattaatttatgctcccatcaacaacatatatgcttgctggtttccccagaaccttgccaacatagttctatgtatcatgagttttttttgatctttgcccatctgatgaatgaaaaatgggatctcagtgtcttttagtttgcatttcttacaagggtgattttttgtttcattttctgtgacctgtctgtatccctttatcatttttctgttgggtgacgcttactgatttgtaggtactctctatttgggaaatcaacccttcatgatatgatttccagatttttccccctttgctatatttttatgttgtttatggttgctcttgccatgaagaaaataattactttttacatagttcactttatcagtgttttcttttactccaaggtgatgatggtaattctctgattgtttctgctgttactttaatggtttcattttcttacatttaaatctttgagttacatgaaatttattttgatttatgcatcattgatggttccagctctccttcccctggatgactagccatttctcctgataccatttattaatttatcttttctcctttaattcgaatgcatctaccaaaagctaacttactaaatgtatttgtattccttctctcatatttaagagttatgtttgttcagtatgaaaaagttcaaacgtacccacaagtagagggaatagctcagcaagacccccctacttatcacagattcagtaattaagatttatctttttttccttttacttatgtttttgctgaagaattttaaagcaatcccagataacatgtcatttgcctcttagtagttctgcgtgtagctttaaaaatatggactttcaaaagataatcaaatatttgactttttttgtttattatactttaagttttagggtacatgtgcacattgtgcaggttagttacatatgtatacatgtgccatgctgatgcgctgcacccactaactcgtcatctagcattaggtatatctcccagtgctatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgataatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgctaaaattttctcccattttgtaggttgcctgttcactctgatggtagtttcttttgctgtgcagaagctctttagtttaatgagatcccatttgtcaattttggcttttgttgccattgcttttggtgttttggacatgaagtccttgcccatgcctatgtcctgaatggtaatgcctaggttttcttctagggtttttatggttttaggtctaacgtttaagtctttaatccatcttgaattgatttttgtataaggtgtaaagaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtactagtaccatgctgttttggttactgtagccttgtagtatagtttgaagtcaggtagtgtgatgcctccagctttgttcatttggcctaggattgccttggcgatgcgggctcttttttggttccatatgaactttaaagtagttttttccaattctgtgaagaaagtcactggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatatttgactttttatggccaggagcagtggctcatgcctgtaatcccagcactttgggaggctgaggtgggcagatcatttagcccaggagttcgagaccagcctggacagcatggcgaaaccccgactctaccacacacacacacacacacacacacacacacacacacacacactacaaaaattagctggacatgatggtgtgcacctgtagttttagttactttagaggcttaggctggagaatcacctgagtgcacgaagttgaggctgcagtgagctgtgattgcaccactgcactccaggctgggtgagtgaaacctttctgtctcagaagaaaaaaaaaaaagcctttttgttctaaattaaagagaaaaaccacggggggcttaatagttgatgtctgtgcttttactggtactcagttgctgaaggtggtatcatattagtcctttaattgcttagagttgtgtcctcatgaaactttctccctgaacttgcttttaagggagatctgcctctgtatgccatggtattggaatgttttattagtgtagaagtgtctagatgattttcctagggggccacttaatgagcagtctgtgtgtaggccctatgaataataaaattgtgatcagtggttaagtatagccaaatgtatggataggacctagggaataataaagaagtgcttcaaatgtagcttaaaactatttttttttaaattttactttaagttctagggtacatgtgcacaacgtgcaggtttgttacatagatatacatgtgccatgttggtgtgctgcacctgttaactggtcatttacattagatatttctcctaatgttatccctccccctgtcctccaccccatgacaggccctggtgtgtgatgttccccaccctatgtctgagtgttcttattgttcaattcccacctgtgagtgagaacatgcggtgtttggttttctgtctttgtggtagtttgcttagaatgatggtttccagattcatctatgtccctgcaaaggacatgagctcatcattttttatggctgcatagtattccgtggtgtatatgtgccacattttcttaatctggtctatcattgaaggacatttgggttggttccaagtctttgctattgtgaatagtgccgcaataaacatacatgtacatgtgtctttatagcagtatgatttataatcctctgagtatatactcagtaatgggatcgctgggtcaaacaatatctccagttctagatccttgaggaatcgccacactgtcttccacaatggttgaactagtttatactcccaccaacggtgtaaaagtgttctatttctccacatcctctctggcatctgttgtttcctgactttttaatgatcgccattctaactgctgtgagatggtatctccttgtggttttgatttgcatttctctgatggccagtgatgatgagcattttttcatgtgtctgttggctgcataaacgtcttcttttgagaagtgtccgttcatatcctttgcccaccttttgatggggttgtttttttcttgtaaatttgtttaaattctttgtatattctggatattagccctttgtcagatgggtagattgcaaaaattttctcccattctgtaggtttcctgttcactctgatggtagtttcttttgctctgcagaagctctttagtttaattagatcccatttgtcaattttggcttttgttgccattgcttttgctgttttagtcgtgaagtccttgcccatgcctatgtcctgaatgatattgcctaatctatttttgaaagtgtgcataaggcttaatgctagaaattggtaacattttgatcaaattcatgactgcattcttgagaataagcgtgtccaggcatattccctatttgattccagaattataccactaagatttgtgctcagttttcattttatcaattcttttcgttttttttttggatacagggtcttgctctgtcacccaggctggagtgtagtggcgcagtcttggctcactctagcctcgacttcccaggctcagctgatcctcctgcctcagcctcctgagtagctaggaccacaggcacgtgccaccacacctacctaatttttgtattttttgtggagatgaggttttgtcatgttgcctgggctggtcttgaactcctgagctcaagcagtccaccctccttggcctcccaaagtgctgggattacaggggtgagccattgcacctggtgattttttcagtttcatatgagaaaatatacttctatgatagtgacaggtacaaatattttacatagctataaatttcagtttagattatatttgtcaattggattccatggatattatctttcctttctgtttaaactatttaaagctaagctaccctcatatcacttgttattgataattcagatgtatcctcagatttgtactccaaaggcaacttcagaaacttaaaacatggttcagactcttgtgcatctataaaattcttttgaaaaatagaaagccagaggttgcaaggctttagttaggagtaaattcaggagaaccattgtacaacatggtgacaatagttaacaatatatcgtattcttgaaaaatgctaagagagtggatgtaaaagtgttcttatcacaaaaataactatgtgaggtaatgcatacatcaattaactagatttagtcattctgcaatgtatataggcttctaaacattatgttgtatgtgataaatacaattctatcttctagttaaaaaaaatgagaaattatttttgccaaatagccctaataatcaccagatagtcaccaaataccttgcagcaatataaaataaatgcagattttggttatcatttgtatcattcatatatccaatttgactggcaattcttccttttctgaacaaatttcaaccccttaattttctccagtttcatggtgtgtctatgccttgctacaacctgctgaatctcatacatatttgactggttaggtcttccagagccctgcagttccaaaaaagatttaatgaggcacttgtttgtgaattcactagccagtcatttgattaaattaaaatgaaatttctgtgtttcgcttttctatattttaaatatccccctattttctatatgtattcaagtgacttggaaaggttatagcaccatctcttaatgaaggatttttgtggaaagctaactcacacctctcttctttgacttgaataaactgttgtaatctacttttgtctgttttgttcaatataggtaaattatctgtgcaagcgaactcacgtttagagagaatttctcagttttcttcccgtagattctcagtcctattattagttcatatgtgttggttaagtggtaaaacaaggcttgggctgaaagccttattttccacatatacagagccatagcttatactggagaaaagaaaagtcaccttaatcttttggagggaaatgatgaaatctggaatagtcataaccaaacaatgtatatttaacaagatagctcaaagactttctatttttataaatttaacattcttttagaatgattgaatttagaattattgaaaatagcataaattcttaaagaatttaaatgtttgtgccatttgttaagcttctacaatatgctggatctgctcttgtgactttgcatatatcatctttaatcttcacaacgaatctgcaaaataaatattatccacataagatagatgagaaaggtgaagctccagaggttaagtatcttggctaatgccacacagctaatatatgatggagtgaggatttgaagctacatttctgaatataatgctctttcttacttctggacatttgatagtatttgttgaatgcttgaaagatgagaagactagcacacttgtttactgggtctatatttcctgcctgtctaacaccgaattttttttttttctggaagaaaacttttggcttcctaataggtgcatttttttctgttaataattttattttttcaacacttttaaagaaaaattgaataggtagtatggaatgctcctataggtgcctctctttccctgccatagcttctcctattatttacatcttatattagtacggtatgtttgttacaattaatgaaccaatattaatacattattattgaagtccatggtttgtttttatctaatgtcccttttcttttccaggatgccatccaggacaccatattacatttacttgtcatgtctccttagggtcctcttgctgtgacagtttctcagactttattttttttcccctaaagcctttccactctaccttactgctgcctcagatttaccatttgcatttaagtacaattgtaatttgttactgattaccttgagattttttggtggtggtttttcaaagagctttgctactacataccttgacatttttaaggaatccaggtgtccaggttattatgtattctaggatgttcctctgttagaatatatgtagtgtttttctcatgattagcctgggatatgggttattgggaggaagaccatgcaagtgtgctgccattttcaccacatcatatcctgggtatgtattgtcaacacgatttatgactgttggtgttaacctgaaacctggtagaagtagtgcttgtcagttttctccactgtgaagtttactcttttcttccctcccttccatactggaagtcattacatgagcttgcactgaaggagtcggggggttgtgctcccccttttttagagtggtgtatctacataatttatttggaattcttctacacaggagatttgtgtcttctcctgcatttattaatttattcaatcatttatatcactgtggagacatagatatttattttatactttgagttataattcaatactactttatttattttgttacttaaattgatctagctttggccattgggagatgaccctgtcagtcacttccgtgtcagtcgctcctgtgtccctttgcatacctcagtgtttttttttttgaccactttttggcactgcaagatgctctgggctcatcttgcatatttcctgccccagtcttaaaatcagccatttctccaagaagccttgattccttttattgaagagtagtgttagaaaccaacatctggtgctgggtgtgcttattactgaggtgtcatttcttttaaactctcccagtgtcagggaaaaatgtgtatatactaatctttagatataatacatatataaaaatatttctatatgtgtctctatgaagttaaacatgagttcttactgatgtttccagctctaatttattacaactcctaatatttaagtgattttaagaacactttttaagtttatggcagctttattctttacctttttcttttgtttagctttgcttctatatttaggtggactctattcactctcagttgtgtcgtataaggacttctcaattcttgaattgttttaattcttccttgggctgcctaattttttatacacaagtttcccctaccccaaggaaaaaattcttcatggttactatattttctaatttcttacttgtatgtttgaaaattgtattaaaaaaactaaggattggatcctatcagtgagatatttgagaattatatctgttcaccttttaattttcacagtattgctttctgattttggatggatatattagacaaaggggatggagagtagtgttggattgatactgaaatgtttttagttttgcctactctgcttctagatgacagtgttcaaaagcttatagtttcagtttgggtcccttcccaagttaagaacactgttgatgttgttctttgcttattttatttcttgtgtttagttcattgggttcagagagatacaggttcagtgattctgtattgttctgccatctttacacttgatcttagccaaaaggccgagaagtgatattctgctatcttttactttgaccaatattttctttcccctaaagcctttccactctactgcctcctcaagtttaccatttacatttaagtacagttgtaatatctagttgctatctttgctgttatctagtacaactctcattttatagatgaaggagcttaattgattatcatttgcattagaaactgacacactaattttttccccctaattgtctcaaacaaaagggaaactacttttctttgtcaggcttttttcaataaagtatttttatgtctaagcatatttgtggtgactaattatattgtttttgtatggattttttggggaagaaaaatgtacattaaaagtcttctgttagtaagataatgaaagataaatctttgtatttccaaggcaaagcaagcataacttctcttcaaacagattgttttggtcaaatttggttgttgcagaaagcccattcatttttttagtaacaacagataaagagcttaactaaagttgtgatgaaaatacatatacttatttgagaagactggtaatttttgaaaagtcttaagataatcagtataaaagccaactttttaagcaaagaaagtaaactattaagtttatgcaatgattcattttggatatttggaataggatatgacattattatataacatagtttgtcagcttagacttattttgtagcacttaagtgattcagtgttttaagggatttaaaatgtgatcctttacaatacactttcccaaaatcagtgaggaaaggaaattgctatgttatgttcaaatcttgttaaaatcttattgctatagtttacagaagaggtatagtgattttaaaaatatttatgcagtgcaaatgcttgctgtatatgttttacaaagtgaatcaaagttggagggtagttatttaataggggaatatttgttggttcctaagtcatggtttctgaaataaagaaaaatagcagtatgcagtagacctttattttattatcagtctattttgatgtgcttttaatagcactggtgattaaagttgcagagtctggagccagactgttaagttcaaatcagtgttccactatttgtaatgtttggccttggcttacttaagcccaggttcttcatctgtaaagtggggctaatcatgtacttgccttgtagaatccttataaagattgagtgaatttatgcatgtaaatctctttgatcctggcacagagaatatgctcaataaatgatagctatggttatatttttttaaaggagtatgggtttattatttatgtgttttctttgaaggactgataacctttgacatgaggcttattgtagagttcttttcttggtattagatcttgtgcagtttgggagagtttactatttaattcaagcagtttgttttcaaaatttatgagcagacatttggtggtttggagtgactacaaggatgaggaagtataaacagagataggtagtcagttcttggtagatacctttttctttttttaaaaacacttgagaaatactatttagaactgagacccatgtagacagccaccaccatactgttcatcattagccataccattccccatcattagttaaggaaatgcattcgatttttaagttttttcccccctttctgtgctgtctttttttctctcctgaggatgcttcttgtatctttgcttctgacttgagggcaggccaggcagataataagtgtatagctgctgcaccattttatatacatgtgaaggtcctgcttttgatgtaattgggtctctgcttctcttcaccttaatgttcttaacaacttgctaccaccatgagccccacaaactcatatgacttggtatgatctcactgattagatctgatggtagaattaatttaaaaccacccatttttacaattgacgagagtagtgggaaaaaaaaactgtggcatgaacattgagaagcatttcaaattccatgtagatggcatgctactcaattttttacataagcttctgtatttaattttgtataagaacaaatgcctgcggagtatatagaggccaaatttttgtttgtttgagtttactatattcacatcaacaactggaattagggtaggctgtagaatagaaatatcctcttggtaataatgcagcaaaattctgtctgtaaggcttttatgctttttggcacaggtcatatgattgtggtttaggaaatatactcacctcctctcttcatctgttttctgagtcctaatgtgatttcccagaatacctagcacatataattcaaaaagacaatatttgtctttgctctggttgcagtaagataaaactctgaagaattctgggttaagatgttacagaaagttaatttccaggaaaaattactctattggagaaggtatagctctttctaagagtattccatagatgagactggtatctgtttttgtaactctattcttacatattctattccacttcagcaaacttcttttgagtagatgataaaactcttaaattttttacctgggtgctcttatctatcaaatataaaaaagcctttagagaaaaatgtattggtgacttcaaatagtttagtcaatacgcatccattttgcatttttggtgttggttagttgaagaagaatttcaatggtgtgtgttagtcttgtgtggctctcatagttaccgcctgggcagtatgtggaattcactaaatgaattgaaaagttctgaatatctctttaacttatgacaaatccctgaaaatcagtgctttctgatgagtcaaactatataggtagtatataaaaagtcaacatatgctatacgggacagtttaataagcatttagagtatttggctcaaatgtgttctgtgtactttaatcctcttctgtgatttgtaatatttagatccattttccctattgggttaggtggaaataaggcattgacagtcaatgaattgcttttgggtagagctcaacataaaacagattttgctgtagtaaagattatagattatcatcttagaagaaaatgtagactgttatgtgaaaaaaaatggccagattttgtaagattgtaattgggaaactctgcacccctttgaccaattttaacttattactctttcttactagcttaggcttaaaacaataatgctgtctgcaagatctgcctttcttgtgatccccccatccccagccattaaattctaactaggatctatgttttcttctctggagttacttttggtgggtggtggagggtcccacggatgtgaataagttcactttcccctacttcttttattttgtaattattttacttctaagttcacttttgttacatttttttcttccttgactcactgagttagagttagtctcattgttcagaagccctcttcctttataacttctttttttccaatgcctctgttatatgcagaacttaccttcattgcctcataaatattggtgttaggagacatcatccctcatctgtctcattttgcaaataagcttcctgctagaaagttggctagatggaagcagagaccttcactaaaaccttgatcctcctctgttttcccagcacatagtaggtactcaaaaatacatgttgaatgagagaaaggaaatgagatccagagaggctaagtgaagtaatatatgagaatatataacatgtaatgtcatgaatatatgttatgaaagtactaaaaggctccagaaatgttagttatttgttgttagtattagtgtaatagtaaattaccattaataatattttaaaacttattactagatgatatagagatacttttcattgtatgtaacagaatacccaatcgatagtgacttaaactaatgaggattcatttttacattttgagggtagatatctgccaacattgacttagctgctctgtaatggcagggctattgttctgtaattttcttggcctttccttacttgttgcaagatggctgcttctgctgtaggcatcacctttctgtttgaagcaccaggaaagggcatggatcaacaacagcatctctgttttaccagggaaccaaaagccttcctggaagctgtgtagtacaacagtcttccccttaagtcttatggccagactgtttcacatggccacctctatctggaaggaaggctgtgaaagggagttggcttttctagcctctactgtagacggggaagggagaaggagtttggaaatacattctgggtttgctgcaaaatctacctcttcggctagcccaaatccgaatatatccttcttatgaatacattttatagagaattcagtcaccatctctcccggggagatgatacctgttcttatacataattgcatctacttcaaagtccagaatgtctgcttgatacatagttttctccatcaggtctagttgtagcttgttgtcctctggtgacctagaactaagaagacaaatatatacttccagcacatcaaaaactactagataaaggaatgagataactcaaataaatcttttcctttagaaaaggggagaattagaaactcaaaatagtcattggtccacaaatataccatactctgtaggataagaatattgaagatttcctgttgtggcagtgagtgaaattccttaaacaatctgctatacttatttatgatccctgggaggtttcccttggtcacatctgaccagaaagtattgattggtgtagctgtataataagtcaggtagaccagttccttccacattattcttttccgaattgttttggctattttaaggacttcccctttccatataaattttagaataagtttgtttatgcctactgagaaccttgctaggatttttgataggaattacgttaaagttatatatcaatttgagaagaattgatatctttactatgttgagtgttccaatccatgaatttgataagttcctctgataatttggagagactttaattttttcaacacaattttataatttttagcatgtagatcctgtgtatgttttgttagctatacacctaagtatttcattttctttggcacaaagaagtataattggaatggcatttgccttttaaaatttgtttcatttgctgttagtatacaaaggtcatgatttttgtttgtcaatcttaaattctgtgaccttgcagaagtcactttattctaggagttttttgttgttgttgttgtaaattccttgggattttctagatagacaatcatattatctgtgaaaagagacagttttatttgttcatttccaatctatatgcattttatttccttttcttgcttcattttcctggctataatttcttgtactatgttgagtatgagtggtgagggtggtcatccctaccttgttcctaatcttagggagaaagaatttgtctttcaatgagtaagtctgatgttacctctgggattttttggtagatgctctttatgtgtttgaggtaaatcttgtctagttctagtttttttgagtgtttttaccttgaataggtgttggatactttgtagatattaaaaatactatgaagggagactggattattcttttttagctggaaatagagtagtatgtgaattagaatgataaagtctgactgttgtctcaggcatacaatacttaaggcaccaaagacattaactggctctgaatcaacttcatgtatttctctatttagggaaagatttattaacataattacatgtgactattctttcttattttggcttttaaaatagatgttcctttaacataaacatttttaaaaagcatactttgtcagtatctttgtcggttctgccactgatattgttcccataaaaccaacccttattttactttcagggaaaaaaaaaatacttcatgtggttaaagaatcatgttgtatgttttatagtgccttccatgctcttgcaattttccagtgacagctatatattcttacattgcagagcagcctgcctctttagtcttcgtttcaaaataaaaccaaaaagaagaaaaaattacagaaatgttgttaagaatagtacaaaacccttttttttttgttttttgccttctgagtcatttgatagtgagctgtttacttgatgccccatcatccccaaatactttattgtgtgtttcctataaaattattctcctacgcaactacgacaaagccatcagcaacagggaaataacacttaggcattaccaccacctaatcctcagacttcattcatcttattcccttaatgtcctttatggcaaaagaaaggattccctttgaaatgtctctttaagatttctttaatctggactagtttctctctctttacttgcctttatatctttgacattttttgaagagtacaggccagttacttgagtgattgtgtcttgatttggctttctctgatgttttctcatgagtaggttcaagttatacatctttggcgggaagatcttcagaaatgatgctttttttctctctcagtgcatcttatcaagtaacacctgactttgatttgtcctattattggtgatgttaactttgatcagttgattaaggtggtgtctgccaggtttctccactgtaaggttattttttcctcttcgcagttaaatgtattttgtgaggaggttctttgaggctatgtaaatttccccttcctcttcaaactttcacccctcttgaattcctgtgctctgcaccttgctgtccctctataggaatgcccttttcaccctttctggttctaacacccagcaaagaggctcttctgaacctgcacaggccatcctgctgcctgggagtgatacctgcctcactccatttctgctctcctgcccaatatggatgcccttttcacctcctggtctttgacaccccaggccaggctgccttgtcatgcagatgcccatcccattgtgccgcagctctgtcaccctgtgctggttgccccctgtagagatgccccatgttcttcttgggctctgagaccctgtgctgggctgcctgtcttggtggatgctcttaccctgctcatacttttttattttttatttttgagatagagtcttgccctgttgccaggctggagtgcagcggcacgatcttggatcactgcagcctctgcctcctggattcaagcgattctcttctctcagcctccttagtagctgggactatgggcacccaccaccacacctggctaatttttgtatttttaggtagagatttgtatttttagatagagtttcaccatgttggccatgctggtctcaaactcctgacctcaagtgatctgcctgcctcggcctcccaaagtgctgggattacaggtgtgagccaccacgccacgtccctgctcagactttgataccttatgccaaactgcccctctttgtggccagcccagccctccttgtgtctctggcattgatagcccatattgattcaccctcccatacagaggccttcctcatcctgtgtgtgccctgacaccctcttccccttggatgggctctgatcacgtttcctaaggctgctctctgccttcccccagctcagccacctgcttttatcagtcccacctattgtctttatgctgaatttgtctagaagggtagggaggtaaaaggaactgcagtccctcttggtattcttaatcagccccctgttgtttgctttttcacctttttttttttctaccttttcatgaagagtggttagagataatttataacatttgaaatgtaaaattattttcttagaaaaaaccaggtgactataatcctttgaataaatgtgcaaagcctgatgattttggatattttcaaagaaataatccctgaatattggagtgaagacatcccatatcacagtacctaatgtcagatggcaaatagctagcatggaatcagcttgcttcagttcagcctgtagagccaaagatccatcctggcactgccttctggtttccagcttaagacacctctttgcaagtcacaacatctctttctatttctgtttccgcatccataagatgggggttataaatacttaggtcatggggttgttggggagctcagatgagataatgcatttgaaaatgcaagtgggaaaatgctatgcaaatgtggttatttagttctaatttattacctagtcaaaattgaaatgtataggaaattaagtcaagcattttaattgcacttgtgatttgtaggcaaattccctctgagtcataaggcagataaaaggtcggcatggttttgtttttgctgccacttttaagtccattgtgttgtcactattactcaaccaggtaaacactcctcttttgaagttctgcccacctgttacgcctctgtgacatactgccaccttctagatgatttttacctctggtgtacaactgtcctccctaccccagtgcctgttttctgtcatctttggtgacatcagcttcattggccttaacatgagttctttcatgcatctacaatagcttgtggcacagttctgcttgcatatatcactggttagggatctcaaagtgaacatgtctaatgatcaagttacactcttctcccctgacctgctcctccctagagcttccatttatgttactggtgtcactctttgtattagccttgtagattggaaacttttaactcttccctctgtcatctcccatgtctagtcagtcagtaagttcttttatttttgcaaccatctcttctccacttgagcatctatttccccataattaatggtgtattcctttaaatctaatctctgaactcttaaaatagccttcttcaaggcaaatgttagaacctcagcttgccaggtcccagactggtcctctgctgaataattggatgaaaaagaccatggggcctaagtcacttctctgagtcagcccttccggatgaaccagtcagatgttacaggacatgtctccagagacctgtaaaaacctctagatggtagggttcaggcttggggaagaagacttaccatgttaggcccaaactcgtgcctggaagcatctagaatctgaaaggacctgttctgtatagcatgaattccagtatctaaatatagcaactgtaaacattttggtgcattttcttttattttttcttttgcatgtctataattatactgtatgtgttcattcatcacatctgttaaatgaaaacattttaatgatattttagtaagtgcatttttaaaattggtgtgtaacacggatgccccttgacttaggatggggttacatcctggcaaagtgaaaattcatatgttggaaatgtgcttaatacacccaacctactgaacatcatagcttagcccatcctctcttaaatgtgcttgtacacttaaattagcctataattgggcaaaatcatctggcaaaacagtccactgtagattattagttgtttaccttcttgatcgtgtggctgactgggagcagtggttcattgcccagcatctcgagagagcgttgtagtgcatatcactggcctgaaaaagatgaaaattcaaaatttgacacatgggctctactgaatgtatattacttttgcaccattgtaaggttgaaaaattataagtcgaatcattgtaagttggagaccatctttgcttcagagaatgaaagattgctatccatgtttctgttagaacaagaagatcccttccaagaaataccagactctctgtcagagcttaaccccagcttctgctgagagtgtttgtttagtgttaatttttgattgctgacaactagtctgtttttctcctacctcggtcatgatgcctactcattaagttacctttctgctttcttggtctcgcttatttgttcattcatgtatttattcttttattattcattctccaataataatagcatagtctcttctatctcctgagtttggctctgaagacttaaagattgcttagttcatcgagggactatttatttttgaatcgttgccaggatgtaccacgggcccatctgtgggcacatagaaagcagtgccttcctttctgaagagagtagagaaagcttcctgggggaggtgacgtgtacactgctctatgaaagatgagtagcaggagttggttagggcagacaggtggaagatacatttaggcagtgggcacagaaatgagaacagtggtgatggtgtggctccagcttacctctaggtttttgtttttgtttttgttttttaacagctgtattgagataataattcctatgccatgaaattcactcatttgaaatacacagttttcatagagtcaatttaaaacattttcaataccacacaaagacactccacatcctttagctgagcccactcagtcctcctatccctctcagccctaggcaatcaccagtctactttctgtgctgtggatttgtctcttctggacatgcgtttgaggtagaatcagacaacctatgttcttttgtgcctgacctctttcacttacataatgttttcaagattcgcctatgttgtgtgtatcagcacttcatttcttttgattgctgaataatattccattgcataaatataccacattttatttatccatttatcacttgatggacattgggttgtttctgctttttggctattaggaataatgctgttattaacattgatgtacaagtttttatgtgaacacgttttcatttttctggggtatatacttaggagaggaattgctagattatatgttaactctctgtttaacaatttgaggaattgccagattattttccaaagcagccaaaccattttacattttgattaggagcatatgagggttccagttcacgtccttgccaacagttactacttttaaaaaagtatagccatcctagtagatgtgaagtgctatctcattgtggttttaatttgtatttccccaatggctagtgatgttgagcctcttttcatgtgattgttggctatttatatgtctttggagaaatgtctattcagatctcttgcccatttttaaattggattgtctttttgttattgagttgtgatagtattttctttttaattatgaaattggtagttgttttgaccaagtaagtttgctaggtcaaaatctagaagtggttcttatattggagataatattctgcagattaatctaaagatctcttttaagatgtctctttaaaattctatactctagaattggtgccgatcctggaaatgtaccattctgagcagatgacttgtgttattgatttgtgccaaacaactaagggttgtgtataatctgaatggaaagcagatgttttggcagtttgctagtgagtggttttctcttggttagggcctgctcctttactaaatagaactattttcagtgtatcacttttcaaatatttgaataaggaaggagatttttgggggacatacaaatttatggatacaattgaattttttgaacaactttattattttatgtgtagtaaattctcaataacgacttattttctttttcatcaaaataaatgtttaactagctgcaaatagtatgtatcttattgacccagttttcaattatgcatatgtacagattatctatgactattaaaacaaactcttgctttctagtttgttgctagttccctgaattgccttaatggaaaccatagggagaaaggagattattgcaatggtccaggtgtgacatgatggcttatacaagagtggtggtggtagtagtgataagtagcaggtgtatttcacattattttggagataaaatacattgggaattgttggatttgccatggaagatggtgaggggaaaggaatgattaaacatgattccagcaaggtgtggtggctcatgcctgtaatcccagcactttgggaggacgaggcaggaggatcacctgaggtcaggagtttgagaccagcctgaccaacatggtgaaaccccgtctctactaaaaatacaaaattagccaggtatggtggctcatgcctgtaatcccagctacttgggaggctgaggcaggagaatcgcttgaacctgggaggtagaggttgcagtgagccaagactgcaccattgtactccagtctgggcaacaagagcaaaaccccgtctcaaaaaaaaaaaaaaaaaaaaagaagaaagaaaaaaaggatgattcctagggttctggtttcaccatttggggagatgtgccatttatggaactgtagaacactggaagaagtgaggtttagtcatttgcttattaggtctcaaatccaattctctgaccctctcagtcctgttttgtattgcatttcataggtatccttaccatttggcttttgtgagtagatctggacaattggaggcactgatggaagactggagggtaggagtagggagaaggtagggtatttttctccctccctttttactccgggtggtgtcccaggaagtggcagtttcattcctgtggcttcagctgtcagggagctccttccttcctttgtagtccctggtcccaaagggcaactcctgctattctagcccctgtcaaatgatcccagctattgggctcttataatacaggttgagtattttttattcaaatgcttaggaccagaagtgtttttgattttggattttttttttccagattttggaatatttgcattatacacttactggttgagcgtccctaatccaaagatccaaaatgttgaatttcctttgagcatcctgcggttactcaaaaagtttcagattttggagcattttgaatttcagagttttggattagggatactcaacctgtaccacctcttctagtgggtctccccagcccttaggctggtagtagcttcctgctgggaaaagggaggaaagattttcctctatcctcttagggtctttggctgagtctgaaaatcaaattgccaaagacagattaacagaagaaaaacattcaaatttatttaagttttatgtgacatgggaactttcacaaggaaatgaagacccaaagaaacaggtaaactttagtattttttatagtaggtttgaagaagagtggagagccatggagaaatatggtagggtaaaagagtgtgatctaatggtagtaaactgggggaaacatagtaggacctgattttgccagattcttctgtgtcccctcgtcttcagagataaggatgttcctttcctctgggtatagggagggcatgtctcagatgagggtcttacaacctgcttcaggggaaggtcagaaattttcttctaggttttatgacttgtttcaggggagacaagagggacaaggtcagagagaccttcctgcttctgctatttttcagatctcttccatttaaaatactcactatgtcgaggtggtatattttggggtagtgtgctctgagccccatcactgctgttgttcattttggtgttccttcccattccctgtttggagtcttggatcttctattgccatgtaaccacatttctctgttaatttgtatctgttttaatgcttagagtggtttcttttttcctaactagaacctgatgaatacagggtgaaaatttgagagttcaattttggaaattatttgtgtcaagtttagtatttctgtgatgcattccagtgatgttcttaggtgagttggatagtgagctcagatgcgtgtgtgaactagaagtataaatttggctatcatctcagccaaatggtagtatttcaaaccatgggagggatggatgggatcatctagtacacagaagagaagggaatccaaatctaggtcctctgaaactccgagtcctgagaggtgggatgggggagggagatggataaagtagaaaggccagggagagtgatgctgttgataacataaagaaaggattgttggcggggtgaagtggcccatgcctgtaatcccacactttgggaggccgaggcgggtggatcatctgaggtcaggagttcgagaccagcctggccaacatggtgaaaccccgtctctactaaaaatacaaaaattagccaggtatggtggtgtatgcctgtaatcccagctactcgggaggctgagactggagaattgcttgaacccgggaagcagaagttgcagtgagcggaaatcgcaccactgcactccagcctgggtgacagagtgagactccgtctcaaaaaaaaaaaaaaaagaaaaaagaaaaaagaaaggactgtttcactgctttgtgcattctgccaaatgtttatggtgtcagttaccttgatgaaagcagttttagggacacggtgggtagttgagggtcttcaccaaaatgaagtggtagatgagtgaatgtgaggtgacagagtatagctcgtgcatagagagagttctttcgagatgtttgataatgaagggggagtaaacaaatgaggaaggccgggcacagtggctcacacctgtaatctcagcactctgggaggccgaggcgggaggatcacttgaggtcaggagttcaagaccagcctggccaatatggtgaaaccccacctcaactaaaaatacaaaaattagccgggtgtggtggcgggtgcctgtagtcccacctactcgggaggctgaggcaggagaatcgcttgaacctgggaggcagaggttgcactgagccaagactgtgccactgcactccagcctgggcaacagagcgaaactctgtctcaacaacaacaaaaaagaaatgaggagatagcaggaagatgtattaagaaaagctacagtttttatgattgccttttactttaaaaatatttaatttttagaatagtttctaaatgaaagtagaagtcatacaaggaaaagttttcctcttctttcccattaactcttttttactcccttctcccagccccagcatatagccactgctgtgtgtttctggtatacatccaaaaaaattttatgtaaataccagcaaatgtgattatatattctagattttccccttcttatccctagggatagcctactgtatatatttttattgtcttatttttttttctctgaataatatgacctggagatctttctgcattggaacttagaggttattcatttgtttataggaatatttgttctgaaggtactaaaatatttgtaaccagtcattttttacgattacaaataatacctgtatgtttgcagtaggctaacttcttaaaaggtgaactgctaggtctgagaatatgcacctgccatttcagtagatactgtcatattacctccttaagtggcgatctggtatctatgcccaccagcaaagcatgaagagtactgttttctcacagttacatcagtatagtgtgctatcaaacttttggatttttgacagtctagtaagtgaaaaatagtattttttttaaaaagtgcagttttagttttcatttgttaagaatgaagttgaacatctctttgtatgttcaagaaccatatgtgtttcattttttcatgaactctcagttcatatttgttgcccgtttttttctattagctttggtcttttaagtttttgagttttgtatgttaggcctaagggcctgacagctcactgtggctgtaacattgcttgtaagatgggcctggtgagcagtagttttggattggggcatggtggctggatcgtgaagggccctggaaagtccatttggtgtttatataggctcttggtttataaaactttttttgacttacagaaatagtatcttattagagattctttttttttttttttgagacggagtctcactctgtctccaggctggagtgcagtggcgcgatctcagctcactgcaacctccaactccctggttcaagcgattctcctcccaagtatctgggattacaaacgcgcgccaccataagtatctgggattacaaacacgcgccaccatgcccagctaatttttgtatttttagtagagacggggtttcaccatgttggtcatgatggtctcgatctcttgacatcatgatccgcctgcctcggcctcctaaagtgctaggattataggcatgaaccaccgcgcccggcctagggattctctagatgcagtaacttctgaaataattatatgtcaaaatcaatagagcaatttaatttggaatgaggatggggaatattaataatgttcttttctacatggtaagtacaacgtctgtcttgtacctgatttgactatgaccaggcctacttagctatggggtaatagccataattaattttcaatagttactggtagagctttgccagctattatttttcatttaaaagaaaaaatcgtctttcatataatgaacagacttcaagttgacccttggtttcctcatcttatttctatgaagcactcagggggactattttaagagaacaaactcattatataagtaatctccgagaataactgcttcttcctagtagcttctatttcctttagtcagagactcactctacagacaccaccaccatacaaagggccagttcatactcttgagagtttcagaatgggagcataggtactctttgtcagtgtcttcctatcatttctcctctactctttcctccttttcccccctttttctgctcgttctcccagcgctccaaccctagctggcttaaaggaaaatactttatcatgaatcacttttattctttttagaaaacagattttgaaaacatggttactccatgctgagcattgtgtaagtccaaataaagaaaaataaatgaaatgtaaagaaaaaaattaatctattgaccagaatttttattttgttttctttttgttttttgagttggagtctcgctctgctgctcaggctggagtgccgtggtgcgatctcggctcactgcaacctccgcctcccatgttcaagtgattcttctgcctcagcctcccgagtagctgggattacaggcatgtgccaccacgcccaactaatttttgtatttttagtagagatggggtttcaccatgttggtgaagctggtcttgaactcctgacctcgtgatccgcccgccttggcctcccagagtgctgggattacaggcgcgagccaccgcgccgaccattttcattggttttaagaagttatttttcaagttgtaccttaagggtgctttcgaattctcttattaaagcatactctattctcagtttttagtaggcagtcaatgatttgtgttacgtaaataaaccctctgggtatgggtaaacgtactgcacacttaaaatgtttggacttgacttgtcttccagagttctgtggtaaagaaactctcaaaacatgctttttgggttcaagacaatcaaactgttttctctctttgttttgttcttactgaatttttatttgtatcaacctccataccctccttacttaaatccatgaatagactccttttattgttttgtgttgtttcttgggttgattttcaaatggaactgttgtgtaagataaaggtttgttctcctgaatagtgttgatgtgaaccgtgctgtctcttctataatgccaccattatgcagaagcctgcagggggaagggcagattcgtagttgtgagagtctgcctgtgctttagggtaataatcctgcattcattattaatctccctttgcttccatgtctcctgctcattaccaaaggccaagacatgacatgttcaagatcttagaaattttgaaaatagcagaacggctgcttttgaagcccgattgttagtcttagaaatgacaactgtaaggccatgtaatattacttattttagtttttagatattgtctacattgttttttgatcaataggcaaagagccactaatgagccattataatttccttaaattcacagtctctggagtcagtttgtctgggtttgtaatccctgccaaccctctcaccgtgtgattctaggcaagttacttttcttttctagaccttaggttcctcctctataaaattggaataaaaatgaaggtcaacgtgggaggattacatgaaaaaatgaatgtgacaggccaagtttattgctggatatataataggtactcaataatgttagctattatcgttattactaatcagatttttattaccctggatttaaaaataatttttctgtatataaagaaatagtttggaaagtaaagtgtttcaattacaacaatagtttatttcttttgttggtgactattattttcttggttcggtgagtccaaaagcttttagcaggcaagggaaaagtcccttggaaaatgtatatcaggtcactgtttttctgatggatcacagcaggaaaatagtttatgttctcaccttaaaataaaaggaagctattgattccaagctgtatggaaagggaaacttaaaaacatttaaaaagcgttgataagttttttaagggaaaaaagggcaatgcatgcttttaacaattcaaacagtacagatagatataaattaaatattcatgtgtcccttctcaggattaagcattaaaaaattataaaagtagtatccatgcaagtttaaaaaaaaagagaaagaatataaaagatgcacatgaatacaatattggagcccactgaacctttatcttgccttcaagggcaaaccagtttttcatgtatacttctatccattttctttgcttagaacagaatttcccttttttctttttcctttgtaaaacacaaagtagatactagacatattcttctacaccttgctttgtttcttctgataatatcacagagattgttacaaattggcacgtagagatttatgttgctttctaaacaggcatgatatttcagctgcagtcccgtaatttatttaaccagtgtcgttatagtggatatgttggctttttatgttttttgccttgtcaataatcttcaatgagaattacttatttatatatgtttgtgtgtgtgcgtgcgtgtgtgtacacatgtgtatgggtatgtgatgtaagtatcctacaagcacatgtaggagaaattctgacgtgcatatatatttgctagttttttctactttgccttccaaagagtttcatcagcgtagcctgccatcagcagagggagaggttgccagttttcccattcttttgcttgcactggatagtatcgcacttaatattttctattttgatacgagaatataggatctcattttgttttgcattttaaaattatgcgagatcaatgtatatcaggataaattcctaatagatccgagatataaatgcaaaaccatatgtgtattagaagaaaacatgggtgaattacttagtaatttgggaatagaggaagtgttctaataatgactcaaaacccatcagcaataacagaaaagagtgacacatttgctattttagaaataaaaaagtatgaagaaacgataaaaaagtaaaatgacaaactggaaaaaatgttgtgacttctatcatagatatagatagggttgatatcctatgtggcgtatgtgtatgagtaaattaaaatttgagatgaaaataactattagcctgatagaaaaatgggcaaaaaataggtacagatgaaaagatgaaaaacagaaaaaaaaaaaaaaaacactgcgaggggcccttatgcgtgaaaaggtgcccagctcactcataataagaaaaatgcatgttacaccctcactgttgtttttcaccagattggcggaagtccaaagttttcatagcagactccagggtcaaggctgcaggtaaagggcactcacaggccctgctcatgggagtgcaaagtggcacacctttgtggagaagaattttacagtatgtaatggaatttcatgagaatttatcctctgaccccacattcccacctttttggactcgattccaaaagtaatctgggaaacataaaaatgacatgtgtacattgctactcattgcagtactgtttgtaataaagaaagactgtatgccactgccctccagcctgggcgacacagtgagactttgtctcaaacaacaacaacaacaacaacaacaacaacaacaacaacaacaacagactgtaaataataagatattgaaatctagattccatctgtctagcctgaagtttgcagctctccaaaatagatctgatatcccaactttggcattggcaatatttagcttatgtgcagatggttttcagctgcatatcagaggttacgagcactctaaggggttctaacgctcaaatctcgaagtaggtggagttctttcttgggcactctctaagttggtgccttcttcctacctttcccttccctggtccactcttgtccatctgcctggcccttctttccttcagtgcccttctctaatattgcttctccttttaaggcactggaggacctggcatgaatgttctaaggcaagatcagaaggtgttaacctcttagcaggtatttgctctgatgaccagatcatctaaaagtggcagtgtgtttgtatatttattttattatttattccacctccacttatccaaattaatgtatgaaattgggatgtatcttaaaattgataagaacttgcatttaacttctacccctctggaagagtttttgcagagttgatggtgtttctcgtagttgatggcatcttagaagcccaacaatgtgtgcataagggggtaagccatgtggaatcaccattatttattggcaaatagccatagacagttttccttctcacttttcatttttagtgagtttgttttctgtgttatttcataaataaggcctctgctgggtgattgtgggttggctcagagctagcaaatactctaaattgagaaaggaaaagtttagggtattatctttttgttaacaatattaacatttatacagatatctgtcttgaattcttagcatttgacataattaattattccctctttttttcccttctttttttgagacagaatcttgctgtgtagcccaggctggagtgcagtggtgcaatcacagttcactgcaacctctgcctcctgggatcaagcgaatttcctgtctcagcctcctgagtagctgggactataggcatgcgccaccatgcctggctaatttttgtatttttacaaaatacaaagagacaggattttgccacgttggtcaggctggtcttgaactcctgacctcaagtaatttgcccgcctctgcctcctgcagtgctggaattacaggcacaagccaccgtgtctggcctgctttttttttttttttaatttatttttaattttttaaaatcagataggctctttaagactgtaaactccctgagggtagagattctattcacagccgtatccccagtacccagagtacagcctggcacgtagtgaatcctgattgcctattgtttgttgattgactgatttatgcctctaagaggaactatcttttgataatattaaataagatgtcctaatacaaaactgatagagttcagaaataattaagaatctcctggccaggcgtggtggctcacgcctttaatcccagcactttggaaggctgaggtgggcggatcacgagatcaggagattgagaccatcctggctaacatggtgaaaccctgtctctactaaaaatacaaaaaaaaattagccgggtgtgatggcgggtgcctgtagtcccagctactcaggaggctgaggcaggagaatggcgtgaacccgggaggcagagcttgcagtgagccgagatctctagcctgggcaacagagcgagactccgtctcaaaacaaaaacaaaaacaaaaacacaacaaaaaaaagaatctcctatgttcagcgggaaaggaatatttgttgggtgggggggttcctaaaagattatgtaattttttggcattttgacatattcacagaattcctattgattgaggttactgcatcaagtatagtacagtcatgtgttgcttaagcacaggaatttgttctgagaaatgtgtcaggctattttgttatcatgcgaacatcatcaagtgtacccacacaaacctagattgtacagcctatgacatatctaggccattatatggtatagcctattgctcccaggctacacacctgtacagcatattgccgtattgaataccgtaggcactgcagagcatctaaactagaaaaggtacagtaaaaatatggtatgaaaaatttaaaatggtgcacctgtctaagacacttactatgaatggagcttgcaggactggaagttgctctgggtgagtcagtgagtgggtggtgagtgaatgtgaaggcctgggacataccctgcaccctactgtagactttataaacactgtacacttaggctacactaaatttatacaaaatatttttctttcataataataaattaaccttagcttactataatatttttactttatgaaccttttaatttttgaaaacgttttcacactcttgtaataacacttaaaacacaagtatattgtacagctgaacaaaaatatttccttattgtttaagtgtttaaaattaaattttatttacttatggccaggcgcagtggctcacacctgtaatgctagcagtttgggaggccgaggcaggtagatcacgaggtcaagagattgagaccatcctggccaacatgatgaaaccccgtctgtactaaaaatacaaaaagttagccaggtgtggtggcaggtgcctgtagtcccagctacttgggcggctgaggcaggagaatcacttgggcccgggaggcggaggttgcagtgagccgagattgcgccactgtactctagcctggtgacagagtgagactctgtctcaaataaataaataaataaataaataaaaataaataaataattttattttatttatttattttatttttaaaattttatttatttttactttttaaatgtgtttgttaaacgctaagacagaaacatacacatgagcctaggcctacaaagggcaggatcatcaatattactgtcttccagcaacacatcttgtcccactggaagatcttcaggggcaataacatgtatgcagctgtcatctcctatgttagcaatgccttaccttcttctggaatacctgcctcctggaggacctttctgaggctatttcacggttaaattttttttttttttttttttttttgtgagacagagtctcactctgtcacccaggctggagtgcagtggtgcaatctcagctcactgcaacctctgtcccccaggttcaagcaattcttctgcctcagcctcccgagtagctgggattacaggcgcctgctactgcacccggctaatttttgtatttttagtagaaatggggtttcactatcttggtcaggctggtcttgaactgctgacctcgtgatccagccacctcggcctcccaaagtgctgggattacaggtgtgagccactgcacctggccaacttttttctttcttcttcctttttttttttttaaataagtagaaggagtacattaaaatagtgatgaaaagtattctatagtaaatactaagtgataggaatttttaagctccattatactcttgtgtatcaactgtcatatatgtggtccatcgttgactgaaatgtcattatgcaacacatgttttccctttattttgaaaccaatgttggcaaaattccaaagtacaataatttgcattatttattcattgtcatacttcttgaggggtcctatggtaagagttatctagtgacttgaaaatgactgggtagaagaatgtgccaggatataaagctggcatctgatacagatagttcagatggattaggattatctgtcattaggattatttatttattttgagacagagttttgctcttgttgcccaggctggagtatggtggcacgatctcggcttactgcaacctccacctcctgagttcaagcaattcttctgcctcagcctcctgagtagctgggattacaggtgcccgcccccacgcccggctaattttttgtattattagtagagatggggtttcatcatgttggccaggctggtctcgaactcctaacctcaggtgatccacccgcctcggcctcccaaagtgccgggattacaggcgtgagcacctgcacccggcccttatttatttgttttgaaataaactaacaattgctagtttttttttatcattagctagcagacatctgtgacattttcttgtctgcataatatggttctcatagtattgctttgtcatttgaaattcaacattcattcagcaaatatttaaggagtatctcccatgtagcaggccctgtaataagtgctggggatatagttacgagtaaggtgtgagtctcagtcctaaatctttgttaaatacaacagtgaagcttgtttcttgaagctcatttctaacgatcactatggccttccaagctttaggagattggagaagcgccatatgcatgtggtcccacacattgcccctctgtcatcctcccctcaccctttacctacttgcatattgtttagtgtgccgtgacaatttgaatgtctactctgtgcccatcactctgttgggatttgaacgttcaaggagcagcagataaaaatgtattcagtatctcttaaatagtagtaaagacaggccaaaaaatgaatgattttcagtgtacaagaattgtctacacacagtctgttataggaattcagagaagaaagagtactaggatcagattgatagtagaggaatatcactcaggtggcattgggaataatttggaggatactaacaggaggtaggtgaataatcttttctgagttgagtagggaagtgacataattgatttatgttttatataaggcactctggctgctgggtggcaaattagactatggtctgggggtagaggaaatgaatgcaagaaatgagtcaggttagcaaggatcatagtattcagctgataaatagtgtaagtagtttccatgcctttcattgtttcaacattttttttttttagctgggcatggtggtgggcgcctgtaatcccagctactcaggaggctgaggcaggagaatgtcgtgaacccaggagacggaggttgcagtgagcggagatcatgccactgcactccagcctgggtgacagagcgagactctgtctcaaaaaaaaaaaaaatatttttttttgccatgtttataataaaatactgggggaattttttttttttttttagatggagtcttgctccatcgcacaggctggaatgcagtggcataatgatctcggctcactgcaacctctgcctcccgggttcaagcaattctctgcctcagcctcctgaatagctgagagtacaggcatgcccgccaccacacccggctaatttttgtatttttagtagagaccgggtttcaccatcttggcccaactggtcttgaactacggacctcatgatccaccctccacagcctcccaaagtgctgggattacgggagtgagccactgcgcccggtagaattttttggcgtgtgtgccaagttaccagaaactctgatgtgcttaccagtcctcccacctagtgctcttatttgaatctttcttcctaggtggagaatctacacatagacatctgtatgttctcttagttcatgtcatttgatcttagcttctgttcttatacagatactgttgaaggtgctgcagttttcaattttggttttcctttctttatggtaatcctattttaatatataagatcctttcaggcaactgaagtatgcaagaggcaggtggaatagtagcaactttaggtattaaaaattcatataataaatatgatgggtttggattatttgttgcattgccagtgagtttattatagtatataacaatatttaatcaaaatggtgataggaataaaaggcccactttgaggtaaatcattaatttttaaggcagacaagttaggtttttaagaatttctcaagctgaagaatattcagtgtacactctgtgcctgaaaaagcttaacacataatccacaaaggtgaaattgatttgatactcagagttaagattagggcaagtttcactttagtttgtggaaattattagatagtactgtcaagcattgaaagtaaaggaagagaatgcttatcattacattttaagtgaaaagatatagcatagattacacatttttatatttattgttcacaaatatttccatgttctagcaattttctactgtgttgtaattgcctgttcattttactccactgtttttctctcccctaccgcagcaatcccagtgccactggatatttttgaatgattaagtgtgctacttacttcttttttgtgttcatttttttaatagaaaatgcatccgatgcagatttatggctcctgaacagttgcactgtaaaaaacccagctgaagaccactttagaaactcaattaagtaagtagaaattgattttttcctattttgtataatcaaagtaagaattgataccaaaagattagctttttaaaaatgtcaatatagatatttagtttatattaaaaaagtatgagttggacttttaagattatactattttgaatttgtctgatacagaatgatgctttttttattttttatttttaaattaaatttactttaagttctggggtacatgtacaggatgtgcaagtttgttacataggcaaacatgtgccatgatggtttgctgcacctatcaacccatcacctaggtattaagccctatatgcattagctatttatcctgatgctctcccttcccccaccccctaacaggcccaactgtatgttgttcccctccctgtgtccatgtgttctcattgttcagctcccacttgtaagtgagaacatgcagtgtttgtttttctgttcctgtattagtttggtgcggatgacggcttccagctccatctgtgtgcttgcaaaggatgtgatctcatttctttttatggctgcatagtattccatggtgtatatgcaccacaatttctttagtctgtcattgatgggaatttgggttgattccatgtctttgctattgtgaatagtgctgcaatgaacatatgtgtgcatgtatctttttaatagaatgatttatgttccttcggggatatacccagtaatggcattgctggatcaaatggcctttctggttctaggtctttgagaaatcgccacactgtcttccacaatggtttaattaatttacattcccaccaacagtgtaaaagtgttcctatttatccacagcctcgccagcatctgttgtttgttgacttttaataatcgccattctgactggcgtgaaatggtacctcattgtggttttggcttgcatttctctaatgatcagagatgttgaactttttttcatatgtttttttgctgcataaatgtcttttgagaagtgtccatgtgctttgcccactttttaatggggttgtttgttttttttcctatatatctgtttacattccttatagattctggatatcagacctttgttatgtggatagattgcaaaaattttctcccattctataggttgtctgttcactctgatgatagtttcttttgctatgcagaagctctttaattagattccatttgtcaatttttgcttttgtcgaaattgcttttgatgttttcatcatgaaatctttgcctgtgcctatgtcctgaatggtattgcctaggttttcttcttgggtttttgaagttttgggctttacatttaagtctttaatccatcttgagttaatttttgtataaggtataaggaaggggtccagtttcagttttctgcacaaggctagccagttttcccagcaccatttatcaagtagggaatcctctccccattgcttgtttttgtcaggtttgttgaagatcagatggttgtagatgtgcggtcttatttctgagttctctattctgtttccttggtctatgtatctgtttttacaccagtcctatgaagttttggttactgtagccttgtagtatagtttgaagttgggtagcgcgatgcccctagttttgttcttttttcttaggattgtcttggctatatgggctcttttttggtttcatatgaattttaaagtttttttttctaattctatgaagaatgtcaatggtagtttaatgggaatagtattgaatctacaaattactttgggcagtatggccattttcatgatattgattcttcctatccatgagcatggaatgttttaccatttgtttgtttcctctcttatttccttgggcagtggtttgtagttctcctcgaagaggtccttcacttcccttgttagctgttttcctaggtattttattctttttgtggcaattgtaaatgggagttcattcatgatttggctctcagtttgtctattgttgctgtataggaatgcttgtgatttttgcacattgattttatatcctgagagtttactgaagttgcttattaggttaagaagtttttgggctgagacgatggggttttctaggaataggatcatgtcatctgcaaacagagacagtttgacttcctctctttctatttgaatacgctttatttttttctcttgcctgattgccctggccagaacttccaatgctgtgttgaataggagtggtgagagagggcatccttgtcttgtgcccgttttcaaagggaatgcttccagcttttgctcattcagtatgatatgggctgtgggtttgtcataaatggcccttattattttgaggtctgttccatcaatacttagtttattgagagtttttaacatgaagggatgttgaattttattgaagaccttttctgtattgagaaaatcatgtggtttttgtctttagttctgtttatgtgatgaattatgtttattgatttacatatgttgaaccagcctcgcatccagggatgaagcccacttgatcatggtggataagctttttgatgtgctgctggattcggtttgcccagtattttattgaggatttttgcattgatgttcatcatggatattgacctgaagttttctttttttgttgtatctctgccaggttttggtatcaggatgatgctggcctcataaaatgagttaggaagaaatcccttgttttcagttgtttggagtagtttcaggaggatggctttttgaagggttttttgtgtgtctatctccttaagagtaatactttaatgggaacttttctaataagtaatttcagtatttgtgaagttagctaataggtgatttttgagtatttgttaagtgttaactatgtgttcttctcggagaatcaatgcatactttgtgaagttgcctgacacagtccttgcctcttttccctgcccattagcactgttctaagtgctgcagtacctggctttcaacggaattgcactttgttgaagggaggtgggcatattaagtccttgcttctttctttgttccctcaagttaacgtggaagaagtatccttttttcacattttctctgaatcttatctccatggatcttcttagaaaccttcttctagaaattatttcctcattccatatttccaacctctccaactcccctggaaccttttcattggtatttaaacatacctgggtctaatcggccccctgtgcccctgttagctattgtcctacattttttcttgccttcccagccagacttttaaaaattcttctcttcttaatttcattcttatactcattctttttcccctttattggttttattgtgaaatatattaaacatacattagcgtttataaaacacatacagtttaaataataataaacacttaaacatctgccacccagtgtaagaagtataacattgtcaagaccgtagaaactgccgtgttttcaatcataactcccaagaagtaacctttatcttgacttttgtgagtcatttccttacttttattagttaatgtatcatctattaagtatgtctttaaacagtgtgttgtcttgtttagccgtattttgaactttatctgttgaacttatactgtttgtgttcttctgagatttacatctttttctcagcattacgctttgagatttattcatgttaatgggtgtaaattcatagaatttgctacaatttattcattttattattaatagagttttgaatttttcccagtgttttgctttcatggacattcctgctatgactattttaaacatgttttccggtgcacatgtgtaagaattattctagaatatgaacctgggagttgagttactgggtaacatatctgtgtacattcaaactttattaggtaacgccaatttcttttcacgaatggatgtagtagtgtgcattctcaccagtaatggatgtgtgcatttgttgttttccatttttgtcagcacttgatatggccagacttaagtttttgcaagtctgttggtgatgatggtatttcgttttggttttaatttacatttcctttttttcttttcttgagacaggctctcaccctgtcgcccaggctgaagtgcagtggcaggatctcggctcactgcaacctctgcctctcgtgttcaaaggattctcctgcctcagcctcccgggtacctgggatcacaggcgggcgccaccacacccggctaatttttttttttttttgagagggagtctcactctgtcaccagcctggagtgcagtggggcaatcttgtctcgctacaacctccaactcccgggttcaagtgattctcctgcctcagcctctcgagtaggtgggattacaggcgtgcaccaccacacccagctaatttttgtttttagtagagatggagtttcaccatgttggccaggatgatctcaatctcctgacctcgtgatccgcctgcctcggcctcccaaagtgctgggattacagacgtgagccactgcgcctagtcaattttttatatttttagtagagatgcggtttcaccgtgttggccaggctggtcttgaacttctgacttcaagtgatccacccaccttggcctcccaaagtgttgggattacaggcatgagccaccgcgcctagtcagttttttgtatttttagtagagatgtggtttcactgtgttggccaggctgatctcgaacttctgacctcaagtgatccacctgcctcggcctcccaaagtactgggattacaggcgtgagccactgtgcccggcctttgttgcatttctgtgatcattaatgagtttgggctttttaaaatagatctattggctatttggattttacttttttggtaaaatggcttctcaggtcatttgtctatttttctggtttttttttttcattttaatcatttatttgtggccatatattatgtgtcttacatatcctaatccttagatattatacacgttgcaaatatcttctcccaattgtggcttatcttttcattttcttttgtggtatcttttgatgaagataaattctggtttaaagtttattaatccgttctttttggtctgtgttcttattgtttaagaagtcttttcttactctgaagctattaagatattttcctatattttcttctaaaagtttcatggttttaccttttacatttaggtctataattcatctagagttgactgttattattttttattatggtatcagaaggggtccaattttatgtctttctctgtagataaccaattgtttcagtatcatttatttatttaagttctattctttcttcttttatctgtgcattgcccaccctctcatatgttgagtgtccatagatgtttgaatctgttctgggtcctctatttcattcctttgatctatttctttattctggttcttgttctacatagtcataagtagtacagagttacattaaggctacctatttgatagtgctagtacctttttgttcttctttaagagtgtatctgtttttaagttgaacaaggaatactgttgtgtgtttgtgattacatttaatttttagatgattttggggagaattgaatcttcacaattttgagttatccaactcttctatcctgactttttaaggattgattcttttctttctatagctcttgtgcatcttttagacttttttctcccaatgtagatattgaattattccagtgcgttaagaaaataaacttattctttcttcttttgcctgcacagtatgtactttatatttttatactactttaaatggtaaactttaaaaattttttgttttctgtttttactgccttggtcagggacttagttgtagtagcaatgtgaaggatggttgtgtgtaaggaagagtatagatcaggagtccagtgaggacagagtggttgtagtccaggtacagaggatctcatctaaagtggaggtgttcagaattggaaggaatacattgacttgagatggaagaattctttacatcaggggtctccaacccctgggctgtagacgtgtactcgtctgtggcctgttaggaactggctgcacagcaggaagtgagtggtaggcgagcaagcattactgcctgaggtctgcctgctattagatcagcagcagcattagattcttacaggagcacacatcctattgtgaactgtacatgtgagggatctaggttgtgcgctccttataagaatctaaactaatgcttggtgacctgaggtggaacagtttcaccccaacaccacacctcccacccccggtctgtggaaaaattatcttccatgaagccggttcttggtgccaaaaatgttggggggaccgctgctttacacattccacgttgtccaagatgactctaaggtctctggctagaatgaagtgaggaattctaggaagggagttattaagagatgacatgttttggttttgaatgtgctgtatttgaagttacagataaatattttaataagataatgaatatacttgagctttattgagtgtcttctatgtgacgggcagtgttctaagtgctttagatgaattagatattatctagcttaattcttgcagcctatcaatgagttgtagattccatttgtattcctgttttataggtgaagcagcatctgttttacagatgaaggtctctaaggctgctgttcagttcataaatggtagaagtgggattttaaccgaggcagtctgactagagtctgtgcatttaaccattttattactgtgcttcctagataaagatgtcaagtaagtggttgcagaattgaggcagatatcaaagaggtcaacactagaaacacaaatttaatattgtttgcatagagttgatagttgaatgtgatgtcatccttaattcaaaatggtggaaggaacagaggagttcttaccggagcgatggcaagaggcaagggaagggaggatggaagaggggagttagggtcaagtttaggagcagaagaaggacgaattaaactaaggcagagaatggtattcaccagatgctgtccgttttcagagaatgctttttttttttaatgagaagcctgtgattgtctcaaattatgtatttttctctgtagaaaggtaaacaagatacaaagatactttactgctactgataccccctatgtactgaacctagagaatatagtttctgtgattatcaactttataatgtaattaatggacatagttctagagtatttctaaaagtttaaaaactcaaatataacttgtgtcaatgggttttgttatatatgtgttattaatatggttcaaagtaatgaaatgctgtttgaatgattaagtagaaatggcaagaaaagtttgccatttaaacactacaaagctagtggtagcaagcacaggttcctttaatgtactattctgcttgattgaaagaaaatttaaaaagatattatatatgattaagtatttttaatggccttgaagacttttgatcatcacaactaattcttattaagataacacttaaactaacatttgatttctttccagaataaatacaatcctgtaaaaggtacaataacagttaacattgggaaaatatcagattgaggtgacatttatacatataaaatctttcagtgatggattactcttgtcaagcattttgctttattcagatatttttccagttgtcaccattgcctaacacaaaacagcaaagatgagtagtgtaacattgttaaatgttaagtcgtgctacacatgtgccttttctcatcctccagcaccatcctttccctttgctgtcctctcttgcatgcgttttggttttccatgagagtgaggtaaagcttagattcaaagagagcctgataagatgttgcttctccttctgttgcacccaatcctttatacccaaatgtaaagatttacagcagtggggtgggacctgtctttttctaacctggactctttacccatgattgcttcactttgctacttattcctgtgtgtcatcatctctcgatcatctgcttttgttttccttccagtacttcttggtgttaaatagttgttttaaattatgcatcacatcattttgtttctcttgagccaccacacaaaagatcaccttgttttgacaggaataaagaaagatgactctaagggatttactgtctttcatgtgattaatacagtctcaatgattaagatccagaaattgtgcatttgtgacatgacagttatggactgaattattttgtcgtttgttttggggcttaatacttttttcaaggttttacagtgtttgtattattgatattcagactgataaaagagtaagaattttaagtagcaaaaatagagataagagtgactttttggttgccttttcaccttagaaatctgaaatgttattgcccttactaatttagaaagaatcgctaggaagccccctgtgttatgatggcagcctgctggatgcatactagttcctcttgagcatttgtcagttgccctggctttgttttatccattagaccattttgatttagacaatatggcctttaacttgggggggttcttgagtaaataaaaaagatcaaaagtttcaaaaaataaaatttgctcttaatgatagtatcaaatcaaaaaactcctttggttaatgctttatagaagtgtgggatcttttccatgccacctacaggaggtcattcagaggctggtgaaaataaacacatcttgtgtgtcctatataaatgacagaaagaatagccagcttgctttgatcatggactgtcaacctctatttgaccttgtgcattattaacccaaatgggcactgtggtttagccatactgatagtggatagacaggagtcacttgtttttaactgcctttgcctgtagaaataaatggtaatgtcgaagggatggcttaggtatctgaatgtaattacttgaaacgacaattgaaaataaaggcagaactggataaagacaaaaaatgtgtgtttgagacagaggatatctgctttgtataacatcttttcactataggaaagcaccttccatgctattctgttgagcaaaacataaattattggattgttattcctattatgaaaatattgtttatgtagatttatttttgagttctttttcttcataaattgaagttgggggaggtaccagaatattatttcaacttgaacttgtaaagtaaattgctttcaaaaaagctgacttcataagaatagagaagtggttaccttttcagttagtaattatccagtttaaaagaattaaaaaaaaccctttccagttctcttgttaaccacattcactagtaattttcttttttaactaaacttctaaaagttacttttatttactttttgagaccgggtctcgttctgttgctcaggccggagtgcagtagcacgatcacggcttactgtagcctcatcctcctgggccaaagcaattctaccatctcagcctcatgagtagctgggactacaggcatacaccaccacacccagccaatctgttattattattattatttttttttagtagagagggggtcttgctatgttgttcaggctggtcttgaactcctgacctcaatcaagtgatcctcctgccttggcctcccaaagtgttggggattacaggcatgagccaccttgcctgacttccaaaattaatttttaattaaaaaaattttgtcattagaaggtaaaaaatcacagggttttgatttggccttttgtgagaaataagttagatgatgcaagttatttgagttatactttaaataatactatagtttgttgattttttgttaaacttagatattttaattttaactcttctaattatatgaaatggctatagtttagtatcagtttcatctttttgtttaaaatgttagtggcagattcagtgaatcattgtgtgcttttaccagtcacaatctccttttttcagctatccttgcccaccaaaaagtatccttttacatggaaagttagttcaaaatattagactgaattaattagtattattggttgggtattgtctaataagattgtctcccaacagtgctatgcttaatatgaatttacattttcctatcatttgtcatctccttccactgtttggatattgtctgtatgctgatttctcccaaatcttcgtctttgatctgtatatctccttacaggctccagccttgtatatcccactgcttccttgacttcgccatttggatgaccttgaccatggacacctcaaatcatcatgtcagggcctcctccttatctacctcaccttttctctagctagcatttccattagtattgcccatcttctttgattgtggtcatcaggaaattgcattatcatttcttagtgtaacaagggtttttaaaaaaaatttgttcaatgcctctctctcctacctcttttcttgccactgggctatagaattttacttcctccctgacattagaaagtttcccaagcacataatgtatttgcatatgttcttcccttccttggactgtcttctctctttcctccaaatgcatgccctcacctccacccaccccacattaatcccacctggctaaatagttgatctctggaactcatgtcagagataacacctgtggggtcatcgcccttctaagcttcacctcacctcttagctccaaggtctgttccatgctagttctttatcccatattaacaattaacatctgttgttgtgtagtatattctattatttgtttacatatttggcttgctactagattgtgagttttgaggttaggatactgacctcagaaaaattctttttatgaagcctttgacgctctgactctactgtgtaatgattttccttgtcctgggaaacagatatcattaatagacaaagaccatttgtcaacggttgtaagaatgttctcccaaggttgtagtgagtcccttgacagatacaggctgtgtatttgtagaaagggaaaaggacattctaacttcctaatttctaacttctaatattgtattcctgagggaagttgtaaaaggagtatctcccttcttggagtagtcacctggtcatgctggcaggatcttgtgctcctcactatcctaaatgagctccgggccagcttcagggctgtggccattagattagttaaagcatcatgtcttgagtgagagagtaggaaaggtggataaaaacctggttagtgtttggccttgagtttggcacacaattataattactcaatacatgtttgtataattaggttgaactggtttttcctctttttgggaaaagggtttagtatcgttatgctgtcattgcatcaagtcatcgttaatatatttatgttaagtacattgtaagttgtataagtaatataattgcattaatatcagaacacttgtcttacatttgagtttcaaattgtccagatttgagagtgagcaaaatacaccagatataccaccaaaattgaaaaaaaaatcaactgcttgctgttggggaagaagtagtaatgttggaaaggttgacttgatagaggattttgtaagatgagtgaaaaagatctaaaaggacagtgatgtctctgttattgactgaggtatccttggtctctagaatagtgcctgatgaacagcattgagttacttattcactgaattgaattgaaagatttgatgaaggccaaatttctctaaatacattcttgtttatggattaggtcttattatctatcatatgtgaatgaattcattttattcatcttatgtcacagttttgtttagtctattttctgttgttgcgaggattttgtaattttttcctcatgagtttgtttggagttgataatggtatttgaggagcaagttttctagaaacatagatgaagagttttttgtaaagtagggggtgagagttatgtatgttcagagcagcttctgaccatttcctattggaggcttcaagttgtcttctaactctggaaaaacatggagatgagtgagaggaaagacagaatattatcatgtgatgtatgccagtgagcagttttattggaaatacaaaagaaagtctattttagtgtttaattcctggtttacataaaaaaaaaccaaatgaaactgtaaacttacagttaaaagattagtaagttaatttgcaaatcagcaacagaaaaagcagttcagaggtggtaggccattttaaaatgcaaaactgagttttgtagatatccaaaatctttttgaagactagtattttgcatattttatgattaatgttacatcaacagttgctttgtttttgccattttaagcaagagagtgagtgaaagagggcagtgtattatgtgctggcaacagctggctgatagcattgaaatacttacataattaaatatatgtgttggctgttgtcctaacaactctgtaggtggaggctccagaaagcatgcagaaacttgctttagcaggattaaagaaaaaatcaacatgatctaagtctgttctttcagccaagagtgatttcctattgttttggtttgaaagacattctacttattcttggtgtgtgtgtttatataacagcagagaaaaaaaggctcttgtttttttcttcccttattgtttgctctaagagtgacaaacataatctttcataatttttagtcagtagtattgtttaataactgataataagtgaaataaaaaagactttttaaacccataggacatgttaccaaagtattaaatattaaccctttttatttcttacttatggttacacttaggtgtcgttctctgggccacattaatgaagttatttagattgtaggctatattaaggcatagattgctatgatcctgggaaattggataggagtggcaggtaatatgcaacttacttttacctaacagctgtggatctaaatcttactcaaagtgccctatgtttacatattttactgtttttgtagctctaaggctgaggctggtccctactgtacctttgatgaaaggatggcacttttgtgggtgttagagtgcatagacacagtgcagcaccactgtgtgtggctgccccatattaatacctgtcatttctttatctgtctgcacccattttcagagttccttaggggcagccactatatcttttatctgtatcccagcatcttatacagtgattgacagtgatagttgaacaaatgaatgaaccaactcatatgtatgtttcctttgcatgtttatctttcccatcccttccaccttctgtgtctgtcagatcaaatgtcttccactggattttcatagaactttttctgtgtctctttcttattagattttaagagtttgaacttgaggttatctgcatgtcatagaaaacctaaaaagtagaggcttacatgacttaggggatttatttttcgtacatattgcaaagtccacagttaggaaattgctggctttgctttaccagtttaagggtgtgaggattgaagtcggttgttttaaaggtctttcccttttggtgtcaaatggttattgctctctggccatcacatgcactttcccccacaaaaaagatggaagtaccaaactggatgtgccggctgagtctgtcccttctttaaaggagctttataggaagtcccgctcaaaacccgtgcttgcatctcattgtgtggagtcatatcacaggactacctctatttgtaagagaggctgggaaatgtagtgtttttttttcttttgtttttatactgcacacattgttgctcccaacagaattgggattctgttagtaagggagatggggctaatgtttattggcttgatatctctgctatagggtataaactttgggacaagatacacattttatttatctttctatcatttatcaggtccattgtattggaggaggtcctcaacatacttgtgaacaaatgatcctcttttctcctcttatctttattcagaacatttaagaaatgacatagttgacatgtaagaacttttcctctttttgcttactctgagtggtctctgatgaaggaataacagaatacataggagaagttcatggcttagttgttggacacacgtattttttaaaaaatgggacttacatatattttctgctcttaagacctgcaatgaccatatttgaaatggaatctataaggaaaatatgtttttcattgttctgagattcatttctgtgatataataatcataagcctgatttaaaacctagatattttaaaataatttagacataaaacaaaagtggagtttatgatgattatcatggagggtcttaaccaattggaaaacaggttgaaggacagttaaactcattttataattaagcgtttagaaaataatattttgtttaattctaaaaaaatttaggtacagctgaaaaataccacctctcactaagatggaaatttaatgttttagatttcacttgaaaaaaaaatggagaatttgatataaccagtgaaaatctaaccaatgggaagagtcttacaaaacttgctggagattttttataggttggcgccattggatattatcagagggatattaacgctatcaaattctcattccaggatacaacctacacattctgcagcagtgtcttttttgtgtttctgtacacagaaactgtcgagaactacccagatataattaggttctcctgacccattctttactgtttctttgtgtgcatgtgtgctcgcacgctcaatgtagatgcattaagaaagaaactgacagaatcacatgatagaaagtgttttgggaaaaatacaaattaaaatggatgtcaaggatctctttaacaatatgttttagaagtcaacagctcatcctttgtgccaaccaacaatttgctttccagctcataaatttcgtttccattacaagaggaatcagataagcaagtttatggcaaaactaaaaagtttaatttggtgctttccttaagtacctgtcagtattttatgatagttactgaaggaaaagacttgttttacctcaaatgagaaaatggtttgagtcaacatattttgtagtatttcagtcatccatggttgaaacattgattaactcttttgatgcttttaccattttaatttgataacaaaggatttgatgtcattgatcaagtaaattttttaaaaggtaatttttaaaaatagggaatagaactggagtgtattcattgagcaaattctaagaaactttaaaaaattctcttctatctaggctgcaagctttttcttacttgtcatttcagatacttgtatatcgagaaatttgcaatataccaacttggtaatcggtaatgggtggcttgaggggtatacagcataattagaacttaaaactcagagtaatccagggcagatggtggcctgagtatgtattttcgatcccctcattgtcacactgcctaaataactttgaacaaccgtgggagcctttgtacctggtgttagaggggagcacatatgcagctgagactctgggtcttgggcagaagttgtgctgtatagatggggttgggggagtgatcttatctgtattccttgtggtgatggagagaagagtccaggacctagaatctggagagtcttagctctcccatagacctggggcagtgtcttgaaaacttatcagacccagtaatcctcttatataaaaagtgttttgcaacgtaccctttattatactgaagtgaaaatcttgaataatataatctatgcacacacataattaacaaatcaattagcacagtgctctgaatgtgattaatataaggaaaaaaagaaaaaattgttaatgcaatacgtatttcaaaatacaaatgcttaggcacaaatatactagaagacctaatcaaatggcctgtatacagaattacagtgacagtgagagtaatgaatgcagtctgatatgtgtgtagccttaacagcttaaatgccaagaatagcattggtgatctagtgatgcacctttccagaatggatgatgactcttgctaaagttcttaatgacacaaagtatgttcttccttccattttcacagaggttggattcctgaaactgtacaagaaatacttaaaataagtcctcacttaatgtcaatgataagttcttggaaactataattgaaacgatgtatagagagatgagtttttttttttctaagcaatgttataaagaaactgtcgaatgaaacaattttattccaggagctactatatgtaaaatggagataggttctaaggagatattataaatatattttttacgtatatgcatgttaagtggggctttcagaactcatgcaggtcgtgtggaattctctgtacagcatagatctgtgtagcggaagacatctagcacctctgacttcggcctgcttaatggcagttgcacccccccaattagtattatatccaaaaagatttggatttaaccacttactgattaaaatttctatatggcctgaagcacacaaaacaagataaaagaaaaacaggagaatatggatgtgaaggtatatatgacattatgtttataagtttaaataaatactattaaagagctccttacattaggcaacataattagaaaatatccaaagggcataaacaggcaatttatgaaagaggatgtgcaaataaaaatggaaagattttcattcttaccagtgctcagggaaatacagaccaagtgagatattggtttttgcccactagattttttttttttcccagtaggcccagtgctcctgagagtatggggaactgttgtttactctgatacatttctggtagaagtttgaattgctataatcttctgtggaagttgttttttgataggtataaaatttaaaaatatatctgccccttgatttagcagtcctgtgttttatgaccctctcctacagacatgaaatacctgtttgctaggataggaacataaagttatttattgcatgattatttataatgcaaaaagtgttataacaaatcttatgccgtcttaggtattcttctttatgggcacatattaatacattttacagcagctgatcctggaatctacttacatagatttgcccggctgagaagcaacttgagggctgatcgcccgctgcattccaaagaatcctttttttttttttttttgacttattagtgattatgatgacattaccttttattgaactgtttcaaaatacatgaaaccatgctctgatgacatttttgaagtgtctggattctgtttgccactgtttaaagatttaactagttctttctttaattaatatttagctcttctagtatcatcttaccactggaacagcatgtaccatttgcctcatctttccatttcagggctggtcaaaagagacaaatttcagacattaactaactgaacattctttactataatagatttggaacttttatctaaaacaaatgtctatgttctctggccactgtgttaaatatgtatggtgtgtctcttccatttggcagcaaatatccattgcatttgattcagttttcactgcccttgaaataaatatacttgtcctgaatggcaggcttaaggattttccaaagtaaatgatgtttgcaccacatctggccagccatttttatgtgatacattaaagagagtcagtgttcattaatttgacaaatatttcttgaatgcctactatgtgttacaggctttggcaattcaaagattaatgacacagtcactgctcttaggagatgacagtttagcaaaaagggcagagtcttagccagataattataatacagtgagggaagtgtggtaatgcttctttgttgacaatgatacctgaatgggtgcgaatgtacctcagtttttaaaatcctgggtctttttcaagtctatactcatcctgggtctctgtatcttattttacaccccccttccctcaacaataagcaaactttgctatctgaggtaacaagaaatcttgaggaagggcagctccgactttattaattcagttgttcaaagatactatcaaagaccctaggcactaagtacttcgtattttttccttattttttctcttctgccacgttcaatgtgatggcttggtcttcagtgaagttaaaaagttactttcataaggtggctgcctgggttttggggaccatgtgtagaggaacaatttctttcctgtgtgtacttttctggggtaaattttaaatcattttagactaatagcaaaattgtaaaaatagtacactgaatttttgtatactcattacctagatttaacaaatgctaatattttaccatattattttacttttttggtgtatgtgattttcatggctaaaattttaaaacaaaagggtgtgcaatggaaacttcattacagctctgatgttagccaccttatgccctttaccataatgtatacaaatgactatgtcaatacctttcctccctttctcctttgtctctctttcgcttcttctctctcctccctttgtgtttttccctccccctctctttcttccctccctgcctcccttccttcctccaattgtgtatcctggaataattccatatggatatatacaaaggttcctcattctttatagattcatagaatatttgtttgttctcttatttatggatttttagtgttccagtttatgtgcatgaaattttattaaccagtcacctctcgacttttttggtaataattggcattataaatactgcttagaagaatgtttttttaagtatttatttatatttttagagatggagtctctgtctgttgcccaagctggagtggagtggctatttacaggtgcagccatagcatattgcagccttgaaatcctgggctaaagccatctttctgcctcagcctcctgagtagctgggactacaggcatgtgctactgcgccagcttataaacatgttttgactggaaaccttagttgttgactatgtagagtatgtaaacagtttttaacttgtgtcttgaaataataacataattactgaaaagttacaaaaatagtgcaaagacttcccatggacctttcacccagcttcctttaatgtttaaatattttacatagccatgatgcagtgatcaaaccagagaattaatattgatacagacttaattcacattttgtcttttttccagttcaggatccagtttaggattctccattgcatttagttgtcattcactgtcacctccaatctggaacagatcctcatttttttcttcttcttttatgacattgacgctgttgaagaatacttgtcagttgtgttatagaacattggtcagtttgcatttgcttgatatttcttcatggttagattcagatgctatgcattttatcaagaatataggagtggtcgatattgcacttgagattgacaaatatcagtgtgtcataccaagaagattcaggctgttgatatatctctgtaccagttaactttaacatctagtaaccaggtgtaaactttatttaaggtggtagctgtcagttttctccactgtaaagttactgtcttcttctttggaattaatagatattttgggattctttggtactgtgcacatatcctatttctcatcatgctctcaccattataattttagcatcccttggttattcttacctgtaacaatcaatacaattgtattatcaagtggtgatttttctctttccatcatgtcttctccacttattaatttgaatttttgagtgtaaagaagagctacagaatgagtctcttttctctcatttatttatgtattcaattatttatatcagtgtagcctcatggttctttattttttgagacataatccgtaactatcattatcacccatgttgttctggacttggccaatggaaatgtcttcaggttgtctcctttatctttttgttgttgtcgtttgttttcttattgagtgaggattttaatgacaagctatggaactcagcttatactaatgagaatggtacaaggcttgactttccctccgcgcatcttaaccatttttaaatgcagagttcagcagtattaactccattcacactgttacccagtgctcctgtatccttttaatatgcttctgttttgagcacttccttatttcccggcaccataagttcaggcttatcgtgtactttccttgcctcaagtcctggtttgagtcatttcttgaagaagccctggttcctttcactggtgaactgtgtgaagaaaccgcaatctgggcactagatatgctcattgctactaggatgtcattgcttccaggcactcttagtagacttaaatctactaagacttaggaaatgtatgtatttacacaaacacctataactatttctacttatctgtatatgtattaaaaaaacacgaggttgtactcttccctttgattttacttcaactggataggatttgattttagcatctcccttttcttataagtaactctgctctttaacagtgaaaaacagaaagtctcatagtctacaatatatttacattatttgttcaatcctattaatcatatacagtggtttcagaattactaacccatctctgtgaaaaagaaattttactaacacaaatataatatttatgtttagtcctttttgtgaagttcacttgggttagttctttcctttgccactcaaatcaaattctgtttttaatttgtaatacaattagattaatttgttaccacttgtattccattgtggattctccccacttcctggatggttttaattttttgagtttgtgaaatatgagcatggccctcaaagtcagaatgatattaaatcttttactcagagaatgatcactgcccactcgtcctttttgccatccccattactccattctttccatcttgagcccacccgtctcccattagcttttgacttctccttccatttatttatttattttttgtacaaacaggcagaagtcagcagtgatttttcgtattttgatcatgccttctacatttgttaattggaatttcactgtaaggaagagtggtctcttattccccatttattcaattatttatgtcagtgtagactctgattatttattctgtaggtcataatgtcatagaataaatatacagaattctctgtatgaaacccatggaaatttttaaatttccttttgttttttacttaaatgatagcatactatagatactattttactttttgtaatgtaacctgggaactctgcatcagttgatagaaatcttcgtcattctttcttatggctgcttagttttccatgcagtgagtgtatagtggtttattcaactactttcccatgtgtgggtgttgaggttgtctgatatttcacaattccaaactgtgtggcagtgagtgaacttttgcttattgatttttatattattggaggtatatctttgggatgaatttctagagtgcagactgctggattgaaaggtaggtacgattatagatactgcctagttaccctccaaaagggttgtaacactttatatccttaccaccaagtgtgaaaattgtgtgttccttgcaacccctcaaatggaattttattgttgtcattctttataattttcaccattcagtagggaagaaatggtatttcagggttttcatttttcatttctgtaattgtgagtgggtttgagcatcttttatagtttggccatttagatatacttttgtcaatcattcatgtctcttattgtttatctattgtctctcaatttgtgtgagtttttctgtttgtctgtggcatatgtcacaggcatattctccccttttgtctgctgtccttttactttgttgtgcagaatattttattctttgccattaaatttatgaatctttttcaagttcttttggattttgagtcatggctaagttatcacctttgtgtaaaaagaggctaaagagacatttacttttttctagtacttgtcacttacatagtgacatttatatctccaatccttttggagtttattcttatctacggtgtgaagtatgaatctacttttttctttgtgtaacctaattgttctagagctctttttatctctagaaatgttctagtgctcttttattttttttaaatctctaaattttttttagtgatggggtctcgttatattgctcaagctggattgcagtggctgttcacaggtgcaataatggcttactacagccttgagatcatggaccaacatgattctcctgcctctgcctccctagtagctgggactctaggcacacaccaccacacctggtgcttacactagcactatttactaaaaatttagtctttaccaccagtgttttgggatgccatttttgtcaaaacgaatttccaaatttacgtaggtctattttgggctttctgttctgctccacggttctgtttatttgtattccatctacgctgtttgcaaaggaagttttatttatattatagtttgacatctgctagggctagtcctttcttgtagtctgtctcccttcccttccctctccctctccctctccttctgcctctccctctctttctctttctctctctctctttctttccttcctttctttcttcctttctttcttttctttctctttctttctttctttctttctttctttttctttttctttctttctctctctctctctctccctctccctctccctctccgtctctttctctctctgtctctctctctctctttcctttctttcttttctttcttttttgagaatctcactctgtcacccaggctgtagtgcagtggtgcaatcttgactcactgcaacctccacctcccagattcaagcgattcatgtgcctcagcctcccgagtagctgggattactattagccaccatgcctggctaatttctgtatttttaatagagacaggatttcaccatattggccaggtggctggtctcgaactcctggcctcaagtgatctgcccacctgggcctcccgcagtgctgggattacaggtgtgagctaccgtgtctggcctagtttttctttttaaagtgtttttctgagtattctttcatgtgaattttttcaaattaactttagtatcatctgtgtaactccatgaaaaattgacttggtatttgtattggtaaattagaaattaatttttttcttttgagacagagtttcactctgttgcccaggctggactgcaatggcacgatcttggctcactgcagcctctgccccccgggttcaagtgattctcctgcctcagcctcccgagtagctgggattacaggcgcgagctaccatgcccagctaatttttgtgtttttaatggagatggggtttcaccatgttggccaggctggtcttgaactcctgacctcaagtgatccacccgccttggcctcccagagtgctgggattacaggcctgagccacagcgcctggctggaaattaatttttaataaattaatttagggagaactgatagttttaggaggtgaagtccttctgtttaagaatagatgatggcttcacatttattcagctctacttctgtgtcttttagcagtgtcttcatgttttcccagtgtaggctttggatatacagatgtcattccagatctgtgggggattggtccaggattccccaaagataccaagatctgccattgctcaagtgcctgatattaaatgggcgtagtacttgcacataacctatgcatattctcctgtatactttaaatcatctctggattacttgtaatccctaatagtataaatgctagataatacttgttttagtgtattgcttagggaataatgaaaatgaaaagatctgtacatgtttagtacggacacagttgttttcccctgagtatttttgatccatggttggttgaatccatggatacagaacacatgtgatatggtctggctctgtgtccccacccaaatctgatcttgtaactcccataattcccatgtgttgtgggaggaacccagtgggagatgattgagtcatgggggtgggtctttaccctgctgttctcatgatagtgcatgagtctcatgagatctgatggttttaaaaaacaggagttgccctgaacaagctctcttttttcctgccgtcatccatttaagatgtgacttactcctccttaccgtccgccatgactgtgaggtctccccagccacatggaactgtaagtccaataaacctctttcttttgtaaattgcccagtcttgggtatgtctttatcagcagtgtgaaaacagactaatacacgatggatacagataccttgttgtagttattcctttatgttttatgttctttgttgcctttgtaaatatttttttttctgcctttcatagaggatttctctctcattttgacctctaactggttattacttgtatatataaaggctattattcctatatgttcattttatattgtcttactgaacttttttatagtttgagttaatttttatcattcatttttttctagaattatttatggtactctcatttcatttggaaacaagagttttaattctttgctttcaaattcttattctgttatttcttttgtctaatagcagtttcttttgtccagtttgtcttttgtctaattacagtgttgagcagtagtggagatagtggataatcttggcttgttccttgtgttagtggaattgactttagtacgtcccccattaagtaagatactggcttttgcactatatctattttgtcatgttaagaaactatccatacatttctatttttttagagttttttctttttaaaaaatggatacgcagtaaccatacatatttatggagtacatatagatattttagtacatgcatacaatgtgtaatgatcaaatcaggataattagtttattcatcacctcaaacatttatcatttctttgggttgggaacattaaaaatcctctcttctagctattttaaaatatacaatagattagtgttagctatagtcaccctactgtgctgtagaacactagaacttattcctcctgtctaactctgcagcctctttctatcttcttttcccctgctccttcctagcctctggtaaccatgattctactcttcttccattagatcaacttatttagctctcacacatgagtgagaagatgcagcatttgtctttctgtgcctggattatttcacttaacataatgttctccagactcatccatgtatgcctaattgctctgattaggacttcctcttagagttttatcaggtgtgagtggggagttttgttgaaagcatttcagaagattgatggagtgattatttttcctcttacatctattaatatgacatatagtgttagtagattttctaatattgaatttacctcgtgtttctggagtaaatttcatatggttttttttttaaattgttgtattcttggcaaaaaataataaaatattatcatttggggtccatttgtgatatttgtctgtagttatatttttttgaactgtctttttctactttgggcatcagtgttatacttgcttcatttaaagaattagaacatttttattcattttcagcactctggaacaattcacagataattggaactatctggtttttgaagacttagaatttccctgagaacacatctggtccttttgcttttttgtgggatggttcctatataaatttctgtatatgttctttagaaattggtctgtttaagctttctatctctaattggggcaattttggtaatctgtatttctgtatgaaattacccatatcatcttggttttaaatatacagtcatgcgttgcattttcagtcagtgatggactgcatatatgatggtggtttcataagattataatggagctgaaaaattgttatcacctggttatatcatagcaattgtaatgttgtcacacaatgcattactgaagtgtttccggtgttgctggtgtaaacaaacctactgtgctgccaattgtgtaaaagtatagcacgtacaatcgtgtacatacataatacttgatgatgataacaaatgactattttactggtttatgcacttaatatgctaaacttttattattattttagagtgaactgtttctactgattaaaaaaaaaaagttaactgtaaaacagcctcaggcaggtacttcaggagggattccagaggaagtcattgttatcacaggaaatcacagctccaagtgtattattgcccctgaaagtcttctagtggagcaagatgtggaggtggaagacagggatagtgatgatcctgaccctgttcagacctaggctaatgtgtgtgtttgtgtcttcattcttaagaaaaatgttcaaaaggtaaattaaacgttttttaaataaaaaaaggttatggaataaagataaaataaaatatttttgtacacctgaacaatttgtgttttaaggtaatcgttattatgagtcaaaacgttaaaaagaaaaagtttacaaagtaaaaaagttatagtaagctgtttagtttattattgaaatatataatttttaataattttagtgtagtctaaatgtacagtgtttattgtacattttagtgttatgtcctaggccttcacattcactcaacactcacccactgactcacgcagagcaacttttagtcctgcaaactccgttcttggtaagtgccctagacaggtgtaccattttaaaaaagtcggccggcacaatggctcatgcctgtaatcccaacactttgggaggccgatgcgtgcgggtcatgaggtcaggagatcgagaccatcctggctaacatggtgaaaccccatctctactaaaaatacaaaaagttagccaggtgtggtggcaggcgcctgtggtcccagctactcaggaggctgagacaggagaatggtatgaacccgggaggtggagcttgcagtgacccaagattgcgccactgcactccagcctgggtgacagagcgagactctgtcttaaataaataaataaataaataaataaataaataaataaaataaaataaaataaaaaagtcttttatgctgtatttttgtatgtttggatatacaatacttactactgtgttacagttatccacagcatctagtgtagtaacatgctgtatgggtttgtagcctaggagcaatagtctgcaacatataatggcctaggtatatagtaggttataccatctaggtttgtgtaagtacacttgaggaatgatgaaattgcctaatgacgtatttcttggaaagtatctccatcattaagtgacacatgactgtatttgcatagaagtctgcaaaagtgacctcttatgactttaaaataatttcttctgtttttattattatttatgccttgttttttatttgataattttttttgtgtgtgtgtgtgatagagtcttgctctgttgcccaagctggagtgcagtggcgcgattttggctcactgcaacctctgcctcccaggttcaagcgattctcctgcctcagcctccctagtagttgggattacagacacctgccaccaggcctggctaatttttgtattattagtagagatgggctttcacctgttgtcccggctggtcttgaactcccggcctcaggtgatccacctgcctcagcctctcaaagtgttgggattacaggcgtgagccatcgtgcctggctaaatttgttttgttttgtttgtttactttgcttttttcatttttcaacgaaggctttatttttttttagatggagttttactcttgtcgcccaggctggagtgcaatggcacgatcttgcctcattgctgcctccacctcccaggttcaagcgattctcctgcgtcagcctccctagtagctgggattacagtcataccccacaccagggtaatttttgtatttttagtagagacagagtttctccatgttggctagcctggtctcaaactcctgacctcaggtgatctgcccacttcggcctcccaaagtgctgggattacaggtgtgagcccccatgcatggcgagagctaagtctctaatttatcttttattcttgcatttttactgctaagttttagtaatatgaatttttctctgtttactgttttaaatcctagagatgctgatgcatagtgtgctcaatatcactagtttttagaaatcttctaatttaggtttttatttctcctttcacccaaaagctgcttaaatttttttatttctaattttattgcaatgtgatcagagttatttttaatttttctgctttaaagagcttcctgatgtcctttatttgtgatttatcattttgtgaatgttcaatgggtgcttgaaaagaaggtgtattctcttctctgttattaggtagtaacactgaatctagattaagatctgtgttgttttttttttttgactctatttaagtctttgtactatcattgcttgagtcttgtatggagaatgtataggtctgttattgtgaatgcatttcttcttgcagcctcaggttggttttatgttatttggtgcataggtatctatagatgttctaattttattgtcagttgtgtctctaaagtgttcttcttgggctgggcatggaaaaaacaaaagtgcttttcttttcatatttattcaattttggcttggattattctttgtatgttactcctttgtctctttttaattttagtcattctgaattatttagctttaggcatgtttctggtatgtggaatagaattgggtgttgctttgtgaaccacatttaaaatctttttcttttaataggtgagttaagcttctttacagtcagtaaggcttcacttaatgtcctggatagattcttggaaacacagttttaagtgaaatgaattactatatgttgtaggaacttaactcttgctcatatcaattaacctatggtaaattgtttctttatactacagttgtttcgcttaaacttgtggtttccaagaacctattgatggcattaagtgaggacttactgtttgatgtgactacattgtttggtctctgctctgttgtgatgttttaaaattatatatattattttttatttactatgtttctttgtgacatgtgtttttttctttaaataaataaagtgttatttaggaagttgcatattttgagtggttaacttttcatttataacttctaaatgcctgtagtttcattgcctatgtttttgtttttgtttttgagacagggtcttcctcatacccagtctggagtgcagtgtcatgaggcatggttgtagttcattgtaacctgaaactcctgggctcaagggatcttcccacttcagcctccctagtatctatgactacgggagtgtgtcaccacacatggctagatttatttattgattgattgattgtaaagactgggtctcactatgttgccaaggctggcctcaaactcctggcctcaagcaaccctcctcctgccctggcctcccaaagtgttgggattataggcatgagccactgtatccggtttccattgcctgtttaaacatttaccatctactttgtcagtgttcaatagtatccttttattcctgacttttgccaaccaaagaatgtgttttactttctgattttctcaccctacacatttttctgcattatttctatttattataacatttgtacattgacctacttttttcctacttttgtgcattgctacaatgcatagcatttgtacattcatctttggcttttgacaattaatattcccccctgtattttagttttagatctacagttatgtagcaatgagctcattatcagtccttttgctgaaatttccccagacctctcttggttgcatgaagctcatcctgttttatttagattcttcaagaggggattatggattcttgtgtgttaaaaactttttatatagccttgaaacttgaaggataccttggttgtttttaaaattcattattcatacttttattgaatttctaaaaaatgcttttccattgttgcattatattttgttttagacaactctgatgccagttgaatttatttgccttcgttcattattttatcttttatgcctagtagccttggacactttttctttgtttttgaagcctaagggtttattaggatgtgtcttggagttgactgttccaagtaaattctcccaggtactggttgacccttttaatatgcagattcaagttttcttgaattacaatcttaaatattgtttctatttatttttatttcttttttaaaatttttttgctgggactctagttttatcaacgttatttttttcttttttgctttctgattccatcactttctctttgacttttaattttttttaatttttatttttttctgagacaagctcttgctctgttgcccaggttgaagtgtagtggcgtaatcttggtttactacagcctccacctcccaggtcaagtgtttcttgtgcctcagcctcctgaatagctaggattacaggtgcccaccaccatgcctggctaatttttgtgtttttagtagagacggggttttgccatgttggccaggctggtctcgaactcctggcctcaagtgatctgcatgcttcagcctcccaaagtcctgggattccaggcgtgagccaccacacccggtctaattttgttgagttttaaaataatttttatttagaattttatgtaggtgtttttaaacatatgacattatatttgaaatttcttacaaatatttagtaaaggaaggaaaactaaagaagaatttcctgacaataaagcgctgttagcaatgtttgattccttacattcggtgctcaaaccattactattctaggactggtcctttttaaggatggttgaaactaggacagattgtcacttgtctggaattgttctttctataagcaagactttattaatactgaatgttatctccctctgtctctgtctgtgattctcttgaaagtgcttcattctgactgaaggaaaacttttgctttctgcatggagctttgtatagaaacccggcacgacagggcactttcgggtcatgccttgagtcttaagaaatattgaaaaatataatctaacaatgatgcttctgttcagcaaggcaaggaatttataacagggcaaaactgaaacctgtttcttgtttgctagcccataaggaggcagcttgtttttatcatcagtttcctgacatcaggatgtgacttcgagaagaggaaaataacacttattggcatcaaagatactaaagtatttaatgccttaaatgaataatcagtatatgtgaacaatgaaaacacagatgaggaaggatacccagtttcagtttcatctgttgtatcatgttagttggagatatttagcttaagcctcttccctgttggtccactttaccctagttgtttcactgttgtgaatgcatttacaattattttaaaagatggcctcattctgtaggtgaatccctgtaaagaacattgtagaaggttattataacaactcctaagcataagctggagtctaaaatgtttctaggcagcaacagtcatatgtatgcttgacctttgggagatctggttctttcctgttgcttgtttttaccctggcactgtcacccacttgtgcccaggctagtttcaaccactgtttgcctgagcctacattttgtgtttttttccattttagcatgttttacaaatttattgaattacactttgtaccaggtattgtgttagggggcaggtataaaagcagagttctcatctgttatttgataggaaagacagtgtgactgttatcagtttacttattctcagcctgcagcccagccttgtttgccttgccttgggtgacataactggactctgtaatagctgttctttgtcagctgctataatgttagtagatggtcttggtggggaattgcaaagtggtggcagcaggaaagcacttgtcttctgggttccagttttcctccatttttaattcactccagaagcgagagatgggtgcatggaaggcctggtggagctcataggatagtatcgatactgcctcctttcccatgacattacagactgtcttagtttgctcaggctgctcttacaaaataccatagagcaggtgggttataaacgacagaaatttaattctcacaatactggaggctgggaattccaagaataagacgccagcagatttgatgtctagtgagaactcacttcatggttcatagatggcaagttatagctgtgtcctcacacagtggaaggggcaaggcagctagctttatggggtctcatttataagggcactatctcattaatgagggtcccaccctcatgacctaatcacctctcaggagctccatgtcctaatatcacattggtgattatattgtagcatatgaatttgggggggacacaagcattcagacagtaacacaggccatctccctcaagaaaccctggttctagctgtaatagtctgtacttatctgatctgccgttccttctctgcctagatgacatttattaaaatatcttttattatctaacagcacttccctcttgcagtcttccttaaacatcagcctgtattagtctgttctcacactgctataaagacatacctgagactggataatttatggtgaaacgaggtttaattgacccagggttccacagctggtataggaagcatggctggagaggccttaggaaacttacaatcatggcagaaggtgaagaggaagcaggcacaatcttcacatggcagggcaggaggagatgggagtgctacacacttttaaacaatgagatctcgtgataactctatcaggagaacagcaagggggatgtctgcccccatgattcgatcacctcccatcaggcccctcctccaacaacgggaattacaatttgacatgagattttggtggggacacagagtcaaatcatatcacaacccaagttagatttcccaacttgaattcctttaaagcatctgagatttactatagctgtgctattctattagactgcattataatttttagttggcttgtgtttttccttctgaactgtgagctctttttaatttcaatatcactagtgctaagtaacataacctctcagatgcttactgaattgatttaaatcttctatttactttttccttccacttaaaatagtagctcttttctttttctttcttttttttttttttttttagagacagggtcttgctatgttgcctaggcaggagtgcagtgactttcacaggtgcaagcatagcaccctgtagccttgaactcctgggctcaagaagtcctccagcctcagcctcctgagtagctggaactacaggtgcacacactgtgcctgtcttatattttattgagtaatgtgttaggtacttttatatactttgtctagtttaatcccactggagcttaggaaacaagtttagaggagttaagtatcttgcccccatgtttatatagctaggaagttaacatagttcattttaaaacctgggtcattcctgctcctatttatcttctcaaatattcagaagatgttaaaaagtaaccaggtttttggaagatagctattttgtttcttatttttattgtgttaatatagatccattagagtaccagagtaattcagcatttggtttaaaagtcttggctttacttatattgagagattcattagcagaaaattacttattgatagtgtcttatcctcttcaaaatcggaattaacaaaatgattcttttatttctctcacagtgattttttaaaatagattttattttttagagcaggtttagattcacagcaaaattgagaggaaggtacagagatgttccatatatcccctgcccccacatatctgcagcctctcccatgatcagtatcccccatcagaatggtacatttgttacaactgatgaacctacgttgacacatcattatcaatcacccagagaatgtagtttacattaaagttgacttttggtatggtattttctatggattttgacaaatgaataatgacatgtatccaccattattgtatcatacagagtaatttcactgcccttaaaatctttgccctgcttattcatcccaaactcttagcatccactgatgttttgattgtctccactgttttatatttccccagatatcagatagtgggagtcatataatttgtagcttttttggatgggttcctttcacttagtaatatgcacttaagtttcctctatatcttttcgcgtcttgatggcccattttttagtgctgaataatatttcattgtcagaatgtacaacagtttatccattcacttactgaaggacatcttggttgtttctaagttttggcaattatgaataaagctgctttaggccaggtgtgttggctcatgcctgtaatccccgcactttgggaggccaaggtgggtgggtcgcttgaggtcaggagtttgagaccagcctggccaacatggcaaaaccctgtctctactaaaaatacaaaaattagctgggcgtggtggcatgtgcctgtattcccagctacttaggaggctgaggcatgagaatcacttgagtccaggaggcggaggttgcagtgagccaagatcgtgtcactgcactccagccttggtgtcagagtgagtctctgtctcaaacaaagaaaaaatgaataaagctgctataaacattgtgtgcagtttttatatggacataagttgtcaactcttctgggagggcaaaaggaaggtaattgctagatcttttgataagatatgtttagtttcagagtatgttcagattctgtcaaactgtcttccaagtgactgtatcattttgcatttgtatccacaatgaatgagagttcctgttgctccgcatccttgccaacatttggtgttagcagtgttctggatttggccattgtaagaggttcgtagtggtatctcattgctttaatttgcattttcctgatgacatatgatgtggagcatatttttatatgcttatttaccgtttgcatgtcttctttggagaggtgtctgtcaagggctttaccccattttttaatcagattgttttcttattgttgagttttaatatttcttcatgtattttggattatagatctttatcagacatatcttttgcaagtattttctttattgctttttattttcttgacaatatcttttgcagagcaaaattttataattttaatgaaatccagtttattgattcttgtgttcatggagtgtgccttttgtgtaatatctaaaaagtcattgtcaaacctaagggcatctagattttctcctatgttatctcccaggagttctgtagttttatgttttacattgaggtctgagccatttcgatctaatttttgtcaagaatgtaaggtctgtgtttagatttgtttttttagcatgtggatgtccagttgttctaccaccgttttttgaagatggtctttgtaccatcatattgctttcgctccttggtcaaagatccgatgattgtatttttgtgggtctatttctgggctctttgttctgttccattgatctgtttgtctgttctttcatcagtagtacattgtcttgattattgttgctttgcagaaagccttaaagttgagtagtgtcatccttctgactttattcttctcttttaatattatgttggctattctaggtcttttgccttgccatgtaagctttctaatcactttgttgatatccacaaaataacttgctgggattttgatagggattgcattgaatctatagatcaagttggaaagaactgacatttttacaatattgaggcttcctatcctaaatatggaatatctcttcatttatttagttctttgatttcattcattagagtttttttagttttttaaaaaattttattttatttttgctagaaccataggcacacaccatcacagtctgctagttcttaaaacgtttttatagagatgaggtctccctttgttgctcagtctgctcttgaacttctgagttcaagtgatcctctcaccttggcctcccaaagttctaggattacaggcatgagccatcaagcctggctcttgtagtttattttctatagatcatgtacctattttgttagggttattccttcattttgggaggtgctaatgtaaatggtattgttgtaaatttcaaattcctcttgttcattgctggtatttggaaaagcagttgacttttatatattaattatgtatcctgaaaccttgctaaatagcttatttgttttaaggttttttttttttttgccaatactcttgagtgttttatgcagacatttatttcatctgcgaacaaagacagttttgtttcttccttcccaatcaatatacctattatttctttttcttgtcttgtattaactaggacagggtccccaacccctgggccatgaactggtactggtctgtggcttgttaggaaccaggccgcatagcaggaggtgagcggtgggtgagtgagccaagcttcatctgtgtttacagctgctcccccttgcttgcattaccacctgagctccgcctcctgtcagatcaggggcagcattagattctcacaggagcacgaaccctattgggaactgtgcatgtgaggtatccaggttgcctgatgatctgtcactgtctcccatcacccccagatgggaccttgtagttgcaagaaaacaagctcagggctcgcactgattttatattatggtgagttgtgtaactatttcattatatattacaatgtaataatagaaataaagtgcacaataaatgtaatgcgcttgaatcattctgaaaccatctcccacccaatctgtggaaaaattacctttccctcgtgccaaaacggttgggggccactgaactaggacatccagtatgatattgaaaaggagtggtgaggggacatttttgtctttgttcgtgattttagtgggaaagcttcgagtttctcaccgttaagtatgatgttagctatagatttttgtagtctttttaactagttgaagttactctatatctcgttcactgagatcttttatcatgaatgggttttggattttgtcaagtgtgtctgtcaatagatgcagaaaaatctattgctatgattatgtgatttttcttctttagcctgttgatgtgatgaattacattaattgattttcaaatgttgaaccagccatgcaatcagaggtaaatcccagttagtcatggtgtataattctttttatacattgttatatttgattttctatggatgattttatatctatgttcatgataaatattggtcaatagttttcttgtgttgtctttgtgtggttttggtattaggataatgctgacctcagaatgagttaggaagtatttcctcttgattctaatttctgaaaaagttatggaaaattgtcataattaaaaaaaatatggtaacattcaccagtgaaccaatctgggcctggtgctttctgttttagaatgttgctaattattgattcaatttatttaatagatataggcctattcacatcgtctttttcttcttacatgagttttgtagattgtttttcaagatttggttcatttcatctgggttatgaaatttgtgatttgttagatcaatcagggataagaaaattaaaaagttattttacttttattcttttatcaatctttttttcttttctttgtttttcatattttattttattttgttttttgaggtggggtcttactctgtcacacaggctggagtgcatggtcacagctcactgcagcctcgacctcctaggcacgggtgatcctcctgagtaactgggactgtaggcactcaccaccacatgcagctaatttttctatttttggtagagaggggattttgccatgttgcccaggctggtcttgagctcctgggctcaagtgatctgtctgcctctgcctaccatagtgctaggattataggcatgagccaccttgccctgcttctttctctagatccaaatttctgacctacatcatttttatcctatgtaaaggatttttttttttaatttcttgcaaggtagatctactggcaaaaaaatctctcaatttttgtttgtttgagaaagtatttttccttcacttttgaagaatgattttgcgggttacagaattctatgttgttgttttttctttttttttatcaacactttattttactttaccactcgcttgtatggtttctagcagaagtaaaatgtaattcttatctttgcttctgtctagctaagggttattcccccctcaccccccacctctggcttctttcaggtttttttctttatctttgactttctgtagtttgcatatgtcatgcataggtatagtttttttggtttttatcctgcttggcattcacagtctcctgaatcttttgattggtatgtggcataaagttagggaaattttcagtgattactgctctgtatatttctgctgttcctttatcttctacttccgcttctagtattctatcacatgtatgttacaccttttgtaatcatctcattgttcttgaatattctgttgagaggtttctttcgttttttttttgtttttagtcttttttctttgtgcttttcagttttgtacatttctattgtgatatcttcaagctcagagagagtctttgctcagccatgtctagtctactagtaagcttgtctaagtcattcttcatttccgttagtgtttttgatttctcttatatgttttttgttctgttttagaatttctttttgtctgtttacattgcccttcttttcttacatgctgtccattttttccattggcacccatagcatgttaatcattgttgttttaaattcccagtctgataattcccacattctgccatatctgagtctggttctgattcttgctgtctcttcaaattgtctttgatgcttttagtacaccttgcacttttttcttgctatctagacacgaagtactgagaaacagaaactggtataaataggtcttcagtgatgtggtattaaggtgttgggggagagggagtgttctgtaatccactgattaggtctcagtcctttagtaagcctgtgcttactgtgatcctcacaagttcttcttagtcctctccccttcaggagggactagaaagctagacttggctggagctgggcatttgttttcacccaggtcatttaggctctggtgacaccccagcaggttaggctgtagttaactagtttttcctgagagcagactttaagaacagagtactctggtgagtttccatatagtttcttttacctttcccctactggaagcatgaggggattttgctccagtattcactgtgagaaccaggtcaagctcctggaggtaaaaattcacgcaagtatggggccccagtgactgagtcatcctggagtttttaactttactctaaaagttgtccacactgagcctccagcaatacataaattacagtttagattttcctaccctaacactcgttcccgtggaggtttgtggttttctgctcaggcaaattgtgatttttggtatctgccagttggtgtctccaatattaggggcagtgatttgcctggtgacctcaattctcttacatatctaaaaagaatgatttgttagtttgtttagttttttcacttgttggtaggatggaatagcaacttccaagcttctcagatgctgaactggaaacctgaagtccccacaaccatttttaggggcaaaactgtaatgttcatttcatgagtattatatataatttccacctagaggtaaatggtgtttttgttattactggttgttacttgttaaaggtttatgttgtggttttcaaagaaatttcatgtatctgtgctctaattttctttatggaaaaatggaccaaaaaaatagagaggtatttaattgcaatgaatgggtgccatttacccctccctgcaaaaagaacatttcagaatcattcagaattgaatgataagaaattctgtttttattgtataaggcttatggtggtcttagtgttacagaatagctaactttttgaaatttcattgtttgttaatccatggatttttaaaatcattttgcctcccaattatgaaaaataactttcacattgtagaccatttggaaaatacaatttaaaagtcacctgtatctccttgtgtaatggttaccatagttaacatgctagcatatgacttgccaatcttttttctgtattggattctcttttacttacatgaaattatatcgtacatatttttgtatcctactttttaaaaaacacatgtgtttaatgaggtaattttttaaatggctatgtaatatttcattttatggatatactataagttgtatatattttttggctgagtacttagattttatccaattttttattcagtagtataaatgtattataactgtcaaataaatgaacatctttgggtgtaagtctttaccttcttttttggtattgcattttaaaaaatgtagatctagttgatgaaggtggaattttcggtcacagaatgagcattttacgaactccagacatatttttcaacactgttctctagagaagagatatccattagccttactaccgcagtgtgtgagaatgagggagacacacccctgccacttgtgcttttagtatttccaattttagttttgctaatttaatggagattgggatgacagctcattgttttaatatattttctttgattataaacaaaatagaattttttttatatttttttgattatttactatttatattgtctttattatagacttcatgtttttcacgtatacttatatgagtttcttgtatattaagaattagctataagggaactgtggaagtcaagactactttaccatgttcataaaaactgataaaaaatgaatataactttcagatcttgagagcggattttacagatgtcatgtgagttcattgagtaatattcttatgtaccactactgactgcttgggactttattactgtaaataggaaaaacaaaaaattaagattctgatatgctaattattttgcttatatggtggtgaatatacttttaaaatgaaacatgtattgcatgcaacaatactattttggtagatttttagaaaagcaggtattattacaggtaataggcaataatgacttcgaaggtcttagggactatgagtaggtaaacactttatgaccacgaccccacaaacaccccgcaggagattatgtggctgccatttgtaaacggccattcattgtcctgtctcttgcctttggctctttccagtttttcttcccaaatctttggactagttcctgcagaaaatatgaattcacagtggtgccctctgggcctgggcatctctgggccggcagaccctgagcagcgactgctgctgagagcaggtgtgtgtacagatggcatggtggggccagcctgccttctgcttggtgatgttggagagggtgattgataatagagcttacaccgagtaatggtctgaggcaaggcgagcatgagtgcctggctaagtgaaagtcatcgctggcagagtggatatgtacacttaatttagtctgtagttttattaaacttccttattagaggaggccttattttcttattaaccagaggtctccatgctggctgtttcatcttgttgcctcctctcttaccgtgtatcctctcagggaggtgaggataattgagaaagggctaaaaacagctctcccgagtttgagaaggttttcagttgtcaatgcttacataatttagagaggactccaaagcattgtgaaagaaagctcattatgcgtctcagtctccttccttgtcttttcttgtagttgtctccatagtgggatgtacatatccctaggctagatttggagttgggtgagaagaaaatattaaaaacttcatttttatttcattcttttttatttcccattctttttcatttctattttatatatgttatgtaatatacacaaccaatttttctacagtaaagtatgtatataatttataagcaaatatacataaatttggtggtatgcacaaaagtttttaatttttaagttttcgcagtgtgcagtttaaaaattttgtagaacttttgtcttataggatttgttgtataggcatggcagcttttgcttaccctgaatactaagacattttgacatttacataagattactatctaccaattggagtgtttttctcccccctctgagtaaatcaggcttaatagagtacatatgaagggcataaagtcaagggcaattctcactatttctttgccaggattttaaactgaagttaaacatgtcaaaatgactaaagatttagagatgattggtagagaagtgttctcagtttgttactcaacctccaagttaatgtggaattttataactgttttagtcagctttctgttgggagctccaaacatcataaaatcttgtgaattctgcctactactaatcaataagtgaaatgatagtaattatctctggttttcttcatttttatatgctttgacaataatgtttaaaaccattctgggctttgatttgggattccacagaattttcttctgggtcacagagggggttaattatttctagaactctgaaattttgtgattcttgtggttcaaaatcacaaaaaccaaagtgaaatcatggtagaaagcttgatggtggggaatatcagctatggaaagtaacagtaattatcagttttgtactttttttctggaaaatattatcttttgaggcttcatttaatatttttctttatcagcccagaacattaaaaaaaaaccctaacctactggaaaaatttggtaagccagtgctttgagtggtcacaatgtagagaaaatgagcattgtcatgtagtaaagttaaaagacagttgtggccgggtgcggtggctcacacttgtaatcccagcactttgggaggccgaggtgggtggatcacgacgtgaggagatcgagaccatcctggctaacacggtgaaacccaatctctactaaaaaaaaatacaaaaaattagccgggcatggtggcaggtgccaatagtcccagctactcgggaggctgaggcaggagaatggcgtgaacctgggaggcagagcttgcagtgagccgaggttgcgccactgcactccagcctgggcaacaaagcgagactctgtctcaaaaaaaaaaaaaaaaaaaaaaaaaaaagacagttggggcttgcacatgagtaagggacaggatctcagctctctctgtggtgggtggttcttcacagtctaagaaggcctctcacttttttcttccatctttgtttccttttcaaatatttaatgtgtagaaatttttattgccctttctgcttagtcagaaatactaaccattgttgaaacttgtaaccatttctgataatttgcccagttgaaataagataattcttttattcaattccaggactctgaaatcctctgagaccaaacttatagaactgtcagttgtctggactttttgtgtgcattttatcaagagggagaagaacagttactttctcccttccctcaaaacagggcaaatgacagaattctatttccagatagatatgtttctttcagggacaaatgtcctatatttagttctttttagttaatatactttatattagccaatgcctagcactgcacacagcagcagccttgctttctcgcctatggctttctgaaagttgagaccacagaaatacttttgcctttccttgtcatgtcttatccacttaatgagaataactgaagtaatactaaaagctttcataagacctggttaaacttgaccttgagattgcttcactcagaaaagttcttagtttaattaacaagtaactgataggagtcatgcttggcatgggtcttcttgagaacttgccagctactttttttttttttttaagacaagatctctctgtgtcacccaagctggagtgcagtgacatgatcatggctcactgcaacctcgatctcccaggctcagaggatcctcccacttcagcctcccgaggagctgggaccactggcacacactaacacacccggctaactttgtgtgtgtgtgtgtgtgtatgtgtgtgtgtgtgtgtgtgtgtgtgtgtgtatgtaggtggttggtatagaagtgttctcagtttgttacttaacctccaagtttatgtggagttttataactatctttataaacaaacaaacaaacaaacaaacaagcaaacaaacaaacgtattttttgtagagacagggtttcactatgttgcccaggctggatctcaaactcctgggctcaagcagtcctcctgcctcggcctcccaaagtgctgagattacaggcatgagccactgtgcctggcccctgccagttacttttattaaagtcacagtgttctactctggatctagggagaccccctttggttccacagaaggagaagaatgggcatctctacctgtgcatcaggatgtcatttttttgagttgcgtagagaaggttctactcccacagcttgcatattgtccatgtctgtattaatcttgttatgaggcatcaactcagcatgggtaataggtagttacattaatgccagggctcaaggagtcccacccatttctttcaccaaatagcccacgaaagtgatgagagataggatgaccacatatataccgtaaacaccagaatgaaggcctttgtcactgctttccccctcagtgaaaaagtaggaaatgtttttaagtccctgctgttgtttgaatatttgattctccaaacctcatgttgaaatttggttcctaatgttggaggaggggccaaatggaggtgtttgggtcatggtcagtagctccctacagtcctcacagtaatgagtgggttcttgctgtcttagttctggagagagctagtggttaaaaacagcctggtacccccacatctctcttgccctgtgacccctgcacacactgactccccttccccttccaccatgagtgcagattctggtgccatgggccttgtacagcctgcagaactatgaaccaaacaaacctcttttctttataaactacccacattcaactattcctttatagtgacacagactgactgagacagtccctatttaatgcagtgctgctgcttttccagccagcaattctgaaagatgtagatctagtatacatattttaagactgtgtttttctgggaaaaacaagttgtctatggccttatgaactggattttctcatgcttctaaacaaactttagcgctgatgggagtatccagaattatttcctaaaaaatatctagggcttttggtccatcagccactgatagtttattatttgttggatgtctgccatatgtagcctctctttttgttacactcaggggaaggtctcaccatcaaaatcattctttaggactgcttaggttagagatccagctagatgctctggatggacatcattttctcatatcattttatcttttagagaaatacacatcattttctccagatatcaagttataacaggaagaagtgatatttatacattactagagagcttctgcttgttcatgtctggtaattcatttgcaccactagtttcttcatgcttggcatggatctgttcctgctacttccatcattcttttgttttattcctttttttctttggccaggcagatatactctggattgtcagccattctgcagaatgttgaaggcagccattctggtttttattgatttttttgttaattgtagtaaaatatacataatataaaatttaacattttatccatttttaccatttaatcattatttaagcgtatagttcagtgtcaataagtatattcacattgttatgtaaccattaccatgatttgtctgcagagttttttcattatccaaactaaaactctgtacccatgaaacagtaactccccattcctcctttcttccaatccctggtaacgacgattctactttctgcctctctgaatttgactgttccagattcctttatatcagtcgcctttctatttcactgatatttaaaaaatagatttgtaaaagccattgccacatttcttgaatgcatggcttaagttaccagttacatttgcatttcttctcttagctgttgtcccaaaggcattccacattggcctgctaggcataggagagcaaagcatggggagaccccagaaatatgagccctcatccttttaataaagactgattttaagaagtcgtctaaaaaccaagtcaactttcccaccacatttttatattgctcagtggcagttaccaaatagaatttcgtgttactgggcactcctaaggttccagggctccagagcttttagggttagactgtgaacttttgaagaaattaggtagctaagagcacctgaaaatatttagtgaaggaaatgaaatccattctttagaaaaaaattagaagttagcctaacagttagcaaagacaatttcctttggttgtgtaaaactagaatacagactttttattttgaatttctttttatctctgtccatgggtttatgcttggatttgcaacaaacaacaacaaaaaactgtttgtatttttaatagcttttaaaaagtattttaacaaaaatatttaaaattttaccaggtattgctaaaaattaattctttgtaagttgtgttaaattggaaggtagtatggtagaataagaatcacagcttgtaattatatagaatttgaagtaaagctgagtaaatctttcattaactttttacaagtagcctatgaccctgtttgctgctcatttctttccagctttccccagttaggacttgatgcaaacagtatgtgttgaagaatgttttgtatgacgtgttcggtagtcatttttcatcatgttcacttgtaatgaatttcagcattttccacattggctcacgaagattaaaaaaaatcctatgtgttgctttaccacatacttcactactgagtgataatctgacctttgggagcattgctggtcactatatagaatgatatttccttgttctatttcattcaaaatgaaaaaaatcattagagagatgcaaaaggaagaaaattggctgttcttttctagggctggatgtactggaaactacaagatgtcatgcaaaaactagtgtgaagatcctgtaaaacatgactgaaataaactgattttttaaaacaaactttattgagatgagcaaaccattagtatttctaggtaaaatggtttcaaattaaaaaatgcatagagcatcattgttggaaaataatggcttcttaaagttttggtttctgcttttggtgagatgtttgaaatgtcaaggaaattgtatctcctactagttaagattttatctgtttttgaaagataatgtgataataatgtgataatttagatcaaaagagaaggccactttttttgggaacatatacattgtataatttaagcaaaaacttaattaagaaaaaaatcattggtggacttgattttttcaggactctggttcttgattatttttgaggtacagaccattttaataatctgataaaagccatatacatcctgtccaccaaaaggaagcacattcataaacatggcaaaagttttcataccgtttcaattggatttctggaaggccacccatggatgcaaaattagaaaatgtttctgtagggactgtcatgaaatgacataggtaacttttgtcattcataatggttagtttctgccaaacaagtttcagacgagtgagctacttttctacaagactcaggccccattctgctacacaaagatgcctagtaatcattgctatctcctggtatgggtttctgatgagagtgtcctgggctttgtctttttgactgaagtaattgattgcccctagatctgaagtttgagttacgtgcatctcattctttatgcacaagtattttaaagtaactacagacattgtaacaggagataatttatatgctttatatcagtgaggcaccttgttttatacgcaaatccttttaattattttcctaccaatggtgggttttagtcagttttgtgatgttccaatgtattcacattgactttgtcttatggtaaggtttcctgtgtattgcagtgtgtctgtctgtaacatagtggctagtcaatgaattttggttgaatgaacattcaaaatccccactgaacaaaattttagacaacgttttgattttagaataatcttcaacttacagaaaagttgcaaaaaagttgcaaagaaacctcttacccagtttctcactgttgttaaataacatcctacattattatgctacatttctcacaaccaagaaattaacattggtacattcccgttaactcaatgccacattttattcagatttcactagttttcccctaaagtcctttttctgttccagtatttcatccagggtactatgttgcgcttatcatgtcttagtcttctctagtctgtgacagtttctcagattatctttgtttttgatccttggcagttttgggctggtcagctgttttgtagaatgcccctcagtttgggtttgtttgataattttctcatgttgagagttatggacttttgggggaaggccacggtggtgaagtgccattctcatcacagcatatcagggatacctactaaacaactttatttttaatatttcagtatcacaatggagagacgggaagagtaagaaggtaaaatttaaaggagtcagtcttgtcatggtaaaaattgtggtaaagataaggtgagggaactgaatctaaaagaatcatttatatttatctgggggaattcagcccttggtgttcctgtcagtgactcactttgggtgtttaagagttggtagaatttattctatttaaatgatacaaatcagaccaatgaaaaggtcagtggttcatagatacacatcaaggcagaatttacaatgataagttttaaaaactctcttgtataaccatttttttaaagtcagaaaattcttaattgtatttttccccttttcctctgtttctatatatttttcttgacctgtgttcttttgcattaggatttatgtttttcaagtccagttaaggatattgagcaatatgtcaaaacatttgtcacctgaatggtttatcccttaataaatggcgaggtggttttgcagacaggtgacacactttaatgtattacagagaccagacttgttagttattgattcgtgatgaataaattactgccattctaatcataagaaaatttcttttggggataattaatcagattcatgtgcttcttaagcagtgtagcattatcatcttttttagttacaagaatgaacctgtctgcctctgcccttggtaaatttagggcagaggcagacaggtttctaggtttgtattttgatctttatttttattaagcagatgagaagcatactcgcttaaaaattacttcaaactgcctttcctgttgagtaggttttgaactacctgcttgacagatggtgttagaagtaattactgaaatcatgtgtttacctgctcatggacatgtgttcaccagatgcaccctgtttacccagggctgctgatttcttaaagaaatatgcaccttctggatagagttgcataacttaggagaataaaagctcgtcaagccggagctctcaatctctgcatggcagaatcagctgtagcgagaagaccatttacatttcttaatgagtggtcaatttagatcacagaaccatgtacagcattatttacctttcttcttttgatttacttagtagtttaattttacctgtctactgagttatttaacagatagcctcccaaattgttgactaaattgtagcagtagtgactaaccagtcttttaagatgatggtgttttggtttattatgttatttttgaaaacatgtttttcagaagacatattaaaaatgtacccatccctccccgtttctaaattctgattgtggaggtccggcttttggattaggcattttttttttttaacacctcatgagtaattcttatgttcattaagatggagagtagttactttaatattttatttactaactatcaaaactgaatttattttttccaccttgcttctgttttattctgttttttaaaaagttaaactgatgagccaggcatggtggcacatgcctgtaatcccagctactcaggaggctgaggcaggagaatcacttgaacctgggagccggaggttgcggtgagctgagattgcaccattgcactccagcctgggcaacaagagtgaaactccatctcaaaaaaaaaaaaaaaaataaataaaagttaaactgaatgatagtgactcccctaacatgtgtgccttaaatgttcaattttgaaaaggagtacatttaactctctataaacctagagaaacaaggaaagtcattgtttcaggattttgacaggtgcaaaactgtaaataattacaggcctgggcagaaactagaacagaagttgcacagcagctggcaggcctgacctgtgacaggtctgacctgagttaagtagcctaaatttcatggcaagctcagatttgttttatggtatgaaattcaccttctgctacagaaagattctactgattgaggctagatatttgccaaaaagggagtaacatacagaatattgagaaagaaaactgcccactgagccacctcttgtatgacttcaggaccagatggaactagtgtagatgcattttaaaatcaatttacatttggactgaaataaatcactcaacaccaaatggtatacagtggttatagctgaggagggtggtctggaggtttttgggtttttttttttttttacactttttatgtaatctgtttctaaaacattttaatttttagacttaggagcatatctgactttagtgaagaggaaagcagttttaatttaatatcttgcgaatacctgaattgtatttttcaaggtctttgtagagaataatacaaaatttcgatgagattttatcaccttcaggttccattaagcagttctccaccttaggacaccagatttgttcctggtccataaagaagccggctagcagcttccatccccacatgctgtgttgcgaccctggaaagctgcagtttagaaaggatagggttctgatgacttatgggctcaatctcacctatacatgaagttgtttttttttttttttttggcttgcccagtgtcttgaaaatttgacaatttcacattttaaaaaatctgtgtttctagctttcttggaaaaaccgatgaatggcagtgctgggcctgcactgtactattgctggaaccaagtagtagctctctgcttttagactctctgatttgctccagtccttatcattccctgttgtactttcatgtctattaccttcctgtagatacatgagttaatgacccctcgagtagaggatatgtgcctcagaagtggagacatgcagagagaagacagctttcaggaggatgcttgtggaacctttatacagttaggcttggtgtgcccatgtcttctgccccctcccactctgtctaaggtttttccctttttttctacgtaatacctcaattttccccttcaccattagggaaattatacctaccagaactttgagttatgttcccccagccacccttagtaaatatcctatgtacctggtgtgtaggagttttgtgaatgtttactagatctttaatctacccatttgtatgtgtagtttaatcatctagtttttcttcttgtttttagtagaaatcagctttcttgaaggataagagattgattagaaaaggaatggagacatttttaaaggtctgggcagattgagagttagggcagatcctgctgtgatgccgtggtgggagaggctgacagcaatgggatcctttctagcatggacaggaggaagcggaaagatgccagggattaaattttctcagaaaaggagaagaaatgatcctcttcttccttcttttcttccctactcctgtgctgtttggtgtttaaactcttagcactcagtgaaatgggaaaggttcccttgtccccctcgcagggcgtgtgatgtgtgtgtggctcacttcttcagtctcccactgctcgaacctctaggggagcatacagacgggcaggtcgtggggctctgaccccatggcagtgtctaagggtggatgcttacagctcctgaagccccagtaggcgtgtgttacagggtgcttttttagtctttccgtctataggcttgtgttaaccagctgaattagaccctctcccttgtcacaaggacagagggctttctgtatcccggattcttgccttggtgtaccggaagaatcagatcacacctgggcttggggaatgagtgcaaggtttaattgagtggaagtagctttcagcagatgggggagccagaagggagatggttttcttgtggattgggccttccaactgctcaggcaaaacttgtcgttccgccagtcgatggccggctggcctgctggcctgctggtgtctgttgtgtgcccctctggacgtcctctcgatatccagccacctgtgttttcttcgccgatgtgttcctcatgatgtccagccacttgtgtgttggcctgctagggtctcggggtttttataggcacacgatggggtgtggccggccagggtggtcttgggaaatgtaacatttggatgtgaaggcaggagtgcctgtcctcacctaggtctgtgggggtggagccctagccaggggccacgcccttctctacccagcacttcccttcaccacttctttatcatttgaagggaccacgctcttcccttcccagcactcccgtatcactagggtctgtggcagaaataggatttccctttgcttctaattgggtatagagagaagtgaagagctgagtttcatttgtctaagaatctcacaacttactgtaatatggtttccattagaatatgtgttgcaaatatagtgaaacttaaaaacaaaacctccattgtaagttgacttttggcacgtagcttcctcatagcttgggttgttcttggctttgttaaataaagttaaaataaagaaagtggtgtagactggggcttggcaaacaatggccctcaggacaaatctagcctgttgcctgtttttataaataaagttttatcggaacagagttgctctagttaattaaggtactgtttgtgactgcattcacaatattagtgtagagttgagtagttacgatagagactatatggctcacaaaatctaaaatatttattatctggcactttacataaacaattttgctgacctttggtgtagatggttaatatccaaaaaacaaaaaggaaaaaaaaacccaactcttttatgtgctctaatgtatttgctgttgaaaacaaagggaatttgtgattcatttaaaaaatatatatatagctatttgatgattttgaagatattttatagttattgttccatttgaatgaagtaaaaatgttatgatgtcttagggtacaattgagctataattttagtatgtcaatgactacagcttttttctagggaaggttataatagttaacaggaaaatatgacataaatagtaaaaacatgatataatagtaaaaattagtaaaaaatttttgttttgggctgtaagtttttttggagaggagactgtagtaagtgtaaaaacatgatgttatataattagttttacacatattttcaggaatatttttaatacacaaatgtgtggatatagtctattttggtgtgaatttaaactttgaaaactgctaaaagtttcagttacttgagaaatagtgaatttttatttaatgatcaaattaaacactaataaaattatgtctttattgttttcagttttgagagcatttgaaaagtgcaggcctgtgttggggatttcattcaacacaattattgattgtttcaggtattaagcactgtttgaggctctgggatttcagtactgaataaaacaaaatacttaatgagcttatgtgggtagggagagaaacaaacaaacattccttgactcaatttttttatcaaattacaccaagtgcttttttaagacctggggatcgataatagcaatgaaggaagcaaattttctgctgtcatgtagcttaaagaaaggtaacatgtaagtctggtagcaactgttaggaagaaaatgaaagcaaggcattgagagagaagaggggtgtaattttttgtagcgtagtcaaggaagacttctctggtaaaatgatttgagcagggacctgaatgaaataaggtaatgagtaatgggaatatttgagaaaagaacattctagacagaggaaacagcaataaaaaaaacactgggggaggaatgtgcttgtcatgttcaagaaacagcaaggagaggcaagtgtggctggaatagaaagtgccagagggagaatggtaggagatgagtttattttctacttaatgaatagctttgaatatgtatcagaggcaaagccacatgagaccaagctaaattctgtatgaggtgacagcagtataaaaccagaaaacaaggatatatggaagaggtccctagaccagaagtgaggaaataatagttaatttgctcattgtttctcaaattaaatcccacttctgtgaatctctttgtgatttactctttcaaaatggaattctagatggtatagtccagtgccccgaggcctgtgtaaattgttgaatttatggtgtgccaataccattatagggtggtcatctggttaatttgcaacaaagaatatgaggtttggaataaatgggtcagaaagcctgactaaaatgagaataacaattcacattcaattaaaaatgtgagtagcctgcaataatttcttattgtacttgggtaaaggggagaatagaagtagaatgataattaatagttgtaaatttaaaagtcagcttttttgcaagtgttaatttttcctggaagtgttgtacaaaatgatcaagttcctgtaattgcagaaacactgatcatggtatttataattgcaaggcatgcgaggtagctgaccttaagtgtaaactaattaacgtaggatttgtgtgatatgctttagcaaaagtagatatttgaaaataactgactttttttcattgtacaaatgacaatatttgtggcattttatttgtttaatattactgagcacaattttcactgtgattcttttcattttaaagcaagtatcaataaatgaaattttgtttctggcataataagattattacttaagcttgttcacaaaatattttataaagaacagcatcaatcacaactattatttagctactgtttgtggaagagtacaggcttttgacactcagcagttagtaataattatttaaataccatataaagacaagacaaattaaatgtataccattcagacattcggagatctcaccaggaaagacccccatgtataaacaactgggcctaagaagctcttttgcaaagacttggtggaattcaggacacatttttactcaggagaaccatatatagggtattcacttcacaggcaaatgcaaaatgtatcaggaagctgtatacatttcatggattttagaggagtctagtactagtttttagcagatctaactttatagaaaagcttatagctttccctttccttggtgtatatatatcagtagcacagccattctcgaatctgtttaggattactcttctgtttgctacctgtgtcacttgtcctgtgtggtgggtctggtagtatgtgttcatagcggggttgctttatgagtaggtccactggtgaggcagttattgacattgcagtcactcttccaagggcagcagcagaccgtctccatgggtgctgtgcttatgattttcagccacagaaagccaaggtgatgatgagggccgtccttgaccacgcatttggtccacacttcacaggacaataggagaggtggggaaggccaggcacagcagactgggacaggcaggccctctctatggaaagccctatggtgctacccatcaagattcctttgccttcattctgctgctgtatccagagatacccatgcctctcactagccttgcctggtatggggaggcaaacctgtttggggctggattttggctgtagggttgtgtgaaatagggtgaaatagaagaaggggaagaaaaaatctctcagtctaacttcttttctttactttaggcttcccgccaaccctttggtgaatttgaaagtagtgatcagatgctcatatgctgatccaactagcctagtttccacccttacattttgagtaaactactacaatccagactttaatggcactggacacacctttctcctcactaccattttagatttataacattttacttttatttactcaagccaaagtactcatttaaggtgtcctctaactttacaactagggagatggaataccatcaaatatataactacacttaaatatatctgtgtctatctgtatttgtgtgtatcatttaaatatctgttatacaaggtcataaataatccaggagtacagcatctgtttcacctgctgctctctttatgatgtgaagtgatgagtcacatgagtaattgtattacttgtataaagtacttggaagacagtttaacttgcataagtcctgtgctgtgtgtcataaagatgaaaagtttgagccatctgttacttaaaaaaaaaattaccccagtgtaccacctggtgtttaactaggccttgggatttgttccagatacagcactgcttcattgaacaaatattgggggtgagggtgggtggggtttggtgattacttctgggacctgggagggacccttttcactgagtcctgaacaacgttatttagatcattgttatttcctattgtggtttgtctgtcattaaaaacaattttgtcttaattttgaaaattggatatgaggagttacattacacaaaacaacattatacaatgatggagataatgttctgtgcagcatgatttaatttggagcagtggatagccacctgctaggcctttgttcttgtggcagtctggcaagtggtcccagtgttttgggtctttccttggtcacgtggctgttgagatctgcctgggttagttgcaaaccattaatccagtagcacagaatgatgaaatatttgactactgggtgtttgaagtaagaaaacaaatccttttaaaagttattattcagcaaccacagaatgcttttatcatgttgatataacatctgagtctttacattttatctaagggtagcctattcttatctacaacataaaaaagaaatctaggtaatatttggcattatggtaactagctaccatatagcacctgtctgcttacccactgtggtggggtaaccatataattcagtgattaaactggaatacttttgtcagtgacagagagctaggacgaaaggtgtaaacaaggatatgtagtcattttacttacaaggcatagccatattttgccatcttccatgatcaagaataactgactattcctcatgcatgtaagagtaattcttattttcaaattgcattaattgtgctggtatagtgcctcatataaagtaggtactcaataaatatttgtaaattgaataaatgtttatgcttaaagaaatcttaaagcttcctgccaaaatctttaaaaatgtacgttttagaagggctttgagttaaacatcctctgtattttcttgatattaagacccagtgtcaggattccccacagtggcattacccatggacctgtgatctaaactctgaaaccattttaatatgtagtatattataagagtaggaaaagcacttaattgcaattacgtattgttctgtctaaaataatttaactgtgtgctagaagagtgagccctttagtcaagtgcttatgacttatcttggtaacttatttactttacctttttacttgaagttgttaaacaattcagtggctacttaacatttccttaaatttactctgagagaaaataaggaacccaagtcatttaatttacttgtttgttagtaccttgtcagagactttaatagtacggaaagaaatttgggataatttttttcacgaattttcaatttttgtgttgttcactttagaaattttctttcatttaaagttttctctctccttgcaaggcctactttactatatatgacatagaaaagggtgcaggaatttctatccttttctatgtggtgattcttgcctgcctgggcagcttatgagacagattggatttagctcaaccctggaatgtgtgttacagtgtggtgggttttggcaagtcacttgtggtttagagggactctatgacgtgggctgggaactttggtcttttcttttggtttgaagtaggttttttaaaaaaggtgttagacagtttcaggttcgagaccttgttaattggtttaacatcccatctgtcctagtcactctgattctaatatgacagaattgaaacagatgctatttaaatctccatttctttattttattttagttttttgtatgtgtgcatgtgtctgatgatattgtagtcttggtctttctgtatctttccctttgacttttctacaatttctggtctggtttctttgtgtttcagcctttttcttcttgtccttatgttttttctttttgacttttttcacttgagtgacagagtttaccaagtcttattgtttatgtctaccctgatgtatcataatagtcaaacattggtcatgatagaacttgcttcagtacttcatgatttttatacagtagaactaaatccatgggaagatatttatttacttgttaattatcttcccattgcaatgtaagctccaagggcaggggttctcttttttttacgactgtatccccagagcctggaagtgtgctgagtgtctaacagctgttaaaaaaaaaatgaatagaaatgctttagttttctgagagtttcccaaattagatattatttagggagagtcttgaagttcctttgctctacagcacacccctgaaccttggctggtatttgaaccgtctaatgaagaacaaagtacttttgagagattctatttgtaatactgtaagattttttttttaatagattgagcatccctaacccaaaaatccaaaatctgaaatgctctaaaattcacaacattttgagcaccaatgtgatgctcaaaggaaatactcattggagcattttcaattttggattttccaattagggatgcaaaaaaaaaatttgaagtctgaacacttccacttccaagcatttcagataagggatcctcaacctgtagtctcttccctttctagtgctcattgtccctagactcgattttactactttatcagttaagatgcttgttggtttcattaatagaaatctcagctgaaactcacttaacaataaggacgtggattatgttgcacaacaggaagtacaagaaggcttcagagtgggttaattgaactcattgttgtcataagagacctaggttgggtctttttatatttttcttttgctttcttggcttcatccttcaagctattattttctgtgattattaggacaagggcagcaattagatcaacattttccttgttgtatgtaatgggaaagaggctggcatttctttccttgaagacctgagtaagaatttctctatgtttttattgggccaaattggtctcagattattctctcccgagtattggcaaaggcaatggagttatagcgattagcttggagtaatcatcgagagtgaaatggatgttggaatcaactacaacacttgcagaaaatcccatatgaattaacctttataaataaatttctaaagactgttgatttcctgagcttcaagttaaaacttccctgagtaattaggtttataaccaagaggatgcagggtgaagtcaacattatgataattacttcattagggaaatcatggcatttaaataaaaaaagtaacaagtttcatcttcctaaatttagtaaatattacatgcaacattgtttgtagaaagtaggtacagtcatgtgtcccatgatcccgtgatgtttcagccattgagagccacatacacatctagctatgtttagaaacacaaatacttagctttgtgttatagttgcctacagtgtttagtacagtaacatgctgtatagatgtgtagcctaggagcaataggctacactatatagtctaggtgtgcagtaggctgtaccatctagatttgtgtacatacactctgtgatattcacacagtgatgaaattgcctaatgacacatttcttaaaatgtatccgcatcattaagtgacgaatgactgtatgtaaaaatcagttagaactgacttccctttaagtctgtttaaactgataacaatcagtaagtttgaattatttaaataaaatgaaatctgtggactagaaaagtggaggagataactaggacatagtgaagcttactttaaaaaatacagagtcaatataaaaggtaatgtgcatctgttaccttaatttactgagaagtttttgatttacttgaacatgcagtaatggattatttttgtttggccaagtattttcagtaaattttaataggcatttggaagcattatgatattatggagaaaatactgaatcaggaattggaatccaaatttctggttctggtcctacctattgacatgatttctagtaaaacattcaacctctgtaagccctcatttctttgtaaaatgcttcctttttaattttcttaaaatgtctatttcttttcattgattgtaaccactgctttcctgggaattgagcgacatatatcattcctctagaggtgtggctttttagtaggattaagattatatgtaattaagtttatttgaacaagaaggaacaggtaaaaagcaaataaaagttgtgagatagatatcagttctgtcctcggtgtatacagtgattgtagagaagagtatttctgttttgaaatatacatgttaattcattagaaaggaattattttgtaggtataaacacattacattttcccaatatttcgagtatgtcattagccaaatatgagattctaatgttgtctggcatttcgaatagtgtcagacttctacatttgtaaataaaagactgaagcatagattccttaatcacctgtaatatagtaaaaagagttttggacttagagtcagaagacaaattggaatcctggctcagctagtttagaaaaaaccttggtagcatggcggaatgataatatggatgctggagtcaaacagaggcaggaatgagttggatttcaccacttacattaatacattttgatgaaagaaagtttggatacctttggcctgtatgttgcagaaaacaaccagaagtagcatgaatcataagtgtgttatctcatagaacaggaagtctggaaattggtatttatgtgttaattccatggcttaatgatatcttctgcaacacaggagtatttaaacttttggttctgtcattcttagtttgtttgtggtatcttcgtttgagtggtgatattgctgtaatagcaatagttcaagatattacatgcagtcatgatgacagccagtaaagagaggaattcctcccatttgtctctttttagtaggtagaaaaccattctcaaaagctgtagtacacaccattgattcaaattatgtctcaaactcagactaaaagttactcactagcaaggataatgaagatgccatgactgacttagacttttttttttaaccccacctttggatttgggggtggggaggctctttcctgagcacagcccctcatagggtaaacaacaaacaaaatcggatctctgccaggaagcaaatggggtgtgtagggagaagaacctgagttggcaaacaaaagtgatgagctaatcatcttgagtagaggccagtaggagatgcacagaaaccaagagagagtggtaacagaatacaacagtctgtgctcggggcagtatgcagggtgctacaggagaatgtatgagaaaacctgaatccaaagttgcaatggtcaggaaagacttttctggaggaaatgacagcttagttatcacctaagggattagtggaaaccagacaggaattagtcatgagcagcatacccttcttctgtatctataagagcacaaaacttagccatgatggtgtttcaggactattttaaggaaagttttaggacaaatgttggcttcaatacctaatcagtgtgcttgatgtgttagaaaaaaaaaaaagaagtgaaatgaaaagaaaagaaaatttaaaaaaagaaaagaaaaaaacacctaatcagaggtaagcaccattatctgtatgtataacaactaatgttcaaaatgattgttgtttttcaagaaaaagttatataacttttttttttgagatggagtctcactctgtcgcccatgctggagcgcaatggcacaatctcggctcactgcaacctccacctcctgggatcaagtcgttctcctgcctcagcctctgaagtagctgggattacaggcacccgccaccatgcccagctaagtttttgtatttttagtagagggtttcaccatgttggccaggctggtcttgaactcctgacctcgtgatccacctgcctcaccctcccaaagtgctgggattacaggcctgagccatcatgcctggcctatataactttaaaaatgctgtatattacagtatgaaacactctcttttaatctttgtaagattctaagattcaaaggacttgtgatcatgtagttcttacttctgtgaaaagcaatcattacttacttgatgcctgtaatgagaagtgtttattagaacaaaaactaggatgactttaattatttcaagaagcacaggtaagagactttaccctctgatgttaatgcaaagcatatacctggaatcgacattctgccatatctttacttgcatcctttaaagctgtttcttaagttttgattgaattaattaatttagaaaagagcttacactaacaagggtttttttcttctaatgaatcaggagtgagtttgcatgttttgctctccactgccatttttatatgttttgtttctctttaaataatactcgtatcttaattatttaaaaatgataccacatcctaagagtacatgatgtaaatcattcttagttcctaatacttactctccactctccaaagacatagacatcatattaggagactgatattcttttttcatattacttggataattcattgccccatatattcatggagaataattgcaaggcaaaccaacagatatttcaggtaacccagaaaaaggatatggtaagcacatttgcaaagaaatacttgatgaactagaattcatacactgtacaatgaaaataaagatttttatgatcgattttgacttaaaatttttcttttttttcttgttaaaaacaaaacaacatctaagctcaagaaatataatacttaacaattgacatagaaaagtcagacaagttctttatttatagagctttctaaataccttatcacaagttaccacaagataaatgtgtatgaaaaattagagccacctacctgttttggtttttgtaaaaatcaaatgtgagacatatactttattcactctattaaaatacatcagtgatgctaactttgatcatatttggacttttaaacaaactattttatccttaaaaaaagaaaacataaatgcaagcaaaatgatttcttatgacactttttaaaaatgaaaaatgcttttgtcaagatagacttatacttaagaaataaagaaaaagcaggatctatcgaccaggatgaaagatgttcttttttttatcataataacatgaagggcaaattaccaccagcttatgggcaagaagtaaataaaaacaaagtactatgatacaaaaaattctcataatgttcagttgatccagaagataatagtctaaggctattagctatgctagtctcttatttttaatattaaaatattttttattaaattttttgcatgttaagtgtttgtcgtaatcaatgatgtcccaaattcaatgcttttgttaatattaatgatactattgtctgttcttttttttttttttttttttttttttttgagacagaatctcactctgtcacccagactggagtgtagtggtacaatcatagttcactgcagccttgatttcccaggctcaagtgatcctcccacttcagcctcccaagtagctgacactacaggtgcgcacccaccatgcctggctaaattttttattatttgtagagactgggtcttccaatgttgtccaaactgtattattgtctattcttgttcactagcctgagccattcacctgatatgggtgacattttttcttttttcactgaaatgaaaattggcagacttttgctgcttctttattacccaatgttaactaatgttttccagtctagaattttaacttaactaatattttaaacttgtatattaaaataaaacacttggcatacataagagtttatagagtataacctctacatctgaagaattagggatacttctgaaggtgaggaaatcactttgcatcatgctatgaatttgttaaactgtttttattttgtgactagcagccttgttttatttaaaaaataaattttattgtataaatttaagatacgtgatcagacacatatatagtaaaaatattattatagtggaacaaattaagatcatcatcttacaattattcatttttccctgcctgtggcaagagcagttataatctactcatttagcaaaaattctgaatataatacaacattattaactatagtccttatgttatacattgcatctttcaacttgttcatcctgttgtgtttgctgctttgtatcctttgacctacatctccctattttctcccacttctgccagaatcactgttttatcctttatgtattatatttgccaaccctccccccacctttttaaaaaagattccagatttaagtgagatgatgcaatatttttctttctgtgtctggcttattttacatagcctaatatccttcaggcccatccatgacgggatcttctccttcttaaagactgaataatagtctgttgtatgtattcaccacatttactctatccatttgtctgtccatagacacttaagttgtttccatttcttggctattgtgaataatgctgcaatgaacatggaagtgcagagatcttttatgaagtggtgatttcatctttttggggtatatgcccagaaggtagattgctgggtcatatggtagttctatttttaatttctgtgggcacctccgtactgttttccatagtggtttgtaccaatctacattccttccaacagtgcacaagggttctctttccaccacgctttcatcaatgcttgttatcttttgtctttttgataacagctatgtaggatattctgaaaatatatttaaaatattcttatttttcctagtcagtatttcctgacttttctcctctaggttgcatgtattgctttagtaataaacaaaagcattaatgaaaacttcgttttgaaaaaattggatctgggatagaatttaccattttgttgtgggtttattttctgatatggatttattttactatttcacttgtaattttagtttttctcaacttaggtaagaagacgaatgagaaggtgagagacagctagtgcgtgctcatgggatatgacatttgaagggaaaaggatttgatagaatctcaggcatttgataaagagttatttggcacttgcagtaagctaagcactgttctggtttggtgcacactgtgatgaataagagagtttctcagccttgtggggattggggagataggaactaactaaatattttcaaaataaaaacaggatttcaggtttgataggcttgataataagcatgcagcataaagtaaaaaggagtgatgaggtcaaatggggcctattttatataatatggtcagggaaaccatttgaaagaggtgatatttgaacagagacttgaatgctgtggcagagcagaagtttgtgaagagctggggaatgagattttttaaaattatcctgctgttggacagaaagtacagcaagagatgatgtggcttggatgagtgtggtgccagtggagatgagaagggcttggatttgaattctgtcttgaaggtagccttggaggtagattgtgcaaatgaaaagaagagagcaatcgggtaactgcttgtttcattttgttttggtttggttgggtctgggttgagtactgggcatatgttggtaccatttatctgagatgagaaagaacagaagaggagtttttctgtttgttttgtttggggtgggatgggtgtgggaatgagaagtcaagaagaatttgttggtttgtatacttgatttgaggcatttactagatacctgagttgatatgttatatgtatgaggctggagtttggcatataaatttgggaatcatgtgctgtagatggtgtgtaaatccatgggactgcagaagatcacccagagaatgtgggaaggcagagaagagagaaccaaggactaagaatgtgctcaggaggttgaggagcactgatcagtagaggtggaggaagtcgggggaagtgttttagtgaagcatgtttccagaaggaggagtgatcagctgtgtaagtgttgctgagaaattgagttagatgaagactgaagattgacttactggatttgtcaatagggaactggtggttgttctgatgagcagtttcagtggagaggtggacacacaagactgatttgagtgggttttaaacagaatgagagccaaggaagtgagataaagtacttattgcattttaggggaggtttgctataaagggaagcagaaatggagctagagcttggcaggggttgggaagatgtagaatcaagggagagtttttattttgtatttttaatacaaaatacatgcgtatatttatgctattgagtctgatccattatagaggaaaaaagctttgtagaagggaaaaggataatttacaggaccaaagtatgacagaaaggctaggatctagcacacaagcagaagcatcaggcttactggggagtgaggacagctgatctattgtaacaggtgggaaaactaatatgttgatacagaacaggtagtttgatagatatgatggtgtaatgaaacagcggttccttcttcttgtttctgttttctcagtgaagtcagaaggcaggtaatttgctgagacccttaatggggaaggccttattagagcaatataaaatattttattttaaaaatactactttataaatgtattcttcacttagctgttgctttttggttgttattgtggttagcaatatatgtctgaatatgttttctttaaacaggtagagttgagtttccctgggccacatagggcataagtcaggagccctcaccaccttttttgtatatggggaatttgaaatctagaaaccttgtgtttttttgccttctccctcttctggttctctaatttttcatcaggcacagtagagaaggagaaaggatggtttcatttagttcagtgtgctcattcagctgttctgcagcctccaggtcttgagagttgttgagcataatcccttgcacagtgaactgtcccaggcttgtgaaatcctagtggccactctaacacagatgactgagttgagatgttctttttgttcaggttttaaagtgaagtgccaccctttagcaggtagagattatatacatcattctgttttctttgaggactccaagtgcccctcttagctgtaagtagtagagaccaacgttaattcatctctcaatcttgtattccattttccagttcatttccctgaaccatattttcctcatttgtggagtaatacttcccactcatgggttcttcatcaggcagcttatgatgcatgtgaaaattgttctggaaaagcctaaacagtacaaaaagagaaatcctattgtcatggtgataattttgttattctctagaagacattgacagttccctaggaccaccccttaaactcttgtttttcatcttacagaggcatccatttcttgttttatttcttctgttaggggcttagtgtagtgacttgagtactgtttagggttttgatatatggagttcaaatttgcatactacaaactgggggtgaaagaaaagaagctgaatatattgcctgttttcaaatagtttattattcttctaactttttaaaaccacaagcttccctcttatcacatttttacaaatggatatatgaaagctggtagaaaaagcttgaatttaagatgataaaatgaaccttgttcttatgtttttctttgctaattttcaattctgctggagattagcatcttctattagcaaggtgtaaaaattgagtgcagattgcagcttttgggagagtgttcaaaaatatttttactttttttataattaaaaaaaacttcttactatttggaaaagaaaaaatgtctaatgacgtcatctactactgtggtatttcttcttaatcctacctctaggggcaaatatttcccatcacaataatagatttttagtcctggaagaaaccttagggttcatctttttaaaccattttcatgtaacttgtgagaaaatgaagactcagagaagaagatttgtctttctgtcagttcatggcagagtccgggttcaagttgaggtctctggacagtcagtgtgtagggttttccttcctgaaccatcctgccttttaaagtttacagttgtgttctcagaaagagaagagtgaagttacccagccacagtagaggaggaggatgggcagatgagttctgtgtacactttgtgcatttaatttgcctcagtcttctcaatggttttaactcattaccacaaaatatagaaaacaaacaggttctttgagttgtgctctctttgaaagctctttaatagtaattctgaattatttggtctttttagtgtcatcctagttacttctgataaggatggtcagaggaccaaatacagttttgtttctactaatacgagtgtacataggaatttttccagctaactgtgacatagtatttatatgccatgggttaaaaccactttcatgtgggttctgagatacataggaaggttgaaaagactttagagacagctaccatggttttatttctcttcttctttttgagggctgggaaatctcaggttatttaattttagagtatttttaattaaaatattttatgtttaacctctattgtaaaatacaataaaaaatttaaaaaccacacagaaatgtatagtttagcgaattaagtaagataccctgtagctcttaccactagctcaagaaatgaaacattgccagccactctggaaaacccttttatgttccccatgaaactcacagatctctctctacctcaacaagtaaccactctcctgacttttataatgcccacttctttatgtttccttatggctttttcccctgcttgtgcttagataataaagttaaatcttgctcattttaaaaagcctggtacgtattttaaatctttcttaatctacaggctcccctccatttctttctattccttacagtttacctgttgaagaacctgggccttttgacctgtagcctttccgtagtctggattttggtgattgcatattcaaaggtgacaagatcatggttctctgaggattggcttcctcatgggattggcttccttatggcatagggaagttactggtcttcttgatgtggttttgggccctgtggtggctttaagtcatttggtggcactgttctgctttcctggttgcaatgctaatggatacaggcccatatataggcattttttgtttgtctacctttttctttaaaaaaaaatttgcacaaatttgtggggtgcatgagaaatttagttacatgtgtgtaatgcatagtaaacaagtcagagtgtttagggtgtccaccacccacgtacagcacatgtttgttaactgtagccttcctactctgctatcaaatattgaatttattccttctgtgttcttaccctttaagccacctttcttcatcattccttctccccagtcacccttcccagcctctgttatctgtctttctttactctctacttcttttttgtagcccaggctagagtgcagtggtgtgatctcggctcacggcaacctttacctcctgggctcaagcaattctcctgcctcagcctccctatgattacaggcatacgccaccaggcctggctaatttttgtatttttagtagagacagggtttcaccatgttggccaggctggtctcaaactcctgacctcaagtgatctgcccacctctgcctcccaaagtgctagatttcaggcgtgagccctcgcactggcctctattctctacttctgtgtgatcacattttttaactcccacatgtaagtgaggatatgtgatatttgtctttttgtgcctgccttatttcacttgagataatgacctccagttccatccatattgctgcaaatgacattatttctttttgttctttttatgtatttatttatttttattatactttaagttctagggtacatgtgcacaacgtgcaggtttgttacatatgtatacgtgtgccatgttggtatgctgcacccgttaactggtcatttacattaggtatatctcctagtgctatcccacccccctccccctaccccacaacaggccccggtgtgtggtgttccccaccctgtgtccaagtgttctcattgttaaattcccacctataagtgagaacatgtggtgtttggttttctgtccttgagatagtttgctaagaatgatggtttgcagcttcatccatgtccctacaaaggacatgaactcatccttttttatggctgcatagtattccatggcttttatgtgccacattttttaaatcccgtctatcattgatggacatttgggttggttccaaggcaaatgacattatttcattctttttatggccaaatagtattccgttaggtatatataccacattttctttatccattgatggacacttaggttgattctatgtctttgctattgtaattagtgctacaataaatatgtaagtgcaggtagccctttaatatgttgatttcttttcctttgggtagatacccagtagtgggattgctggacaaatggtaatcttatttttagttttttgagcaatctccatactattttccatagtgtctgtactagtttacattcccaccaacagtgcgtaagcattccttcttctctgcaccctgaccaacttctgtttttttttttttttttttttttttgagacagagtcttactctgtcacccaggctagagtgcaatggcatggtatcagctcactgcaacctccgcctcctgggttcaaacaattctcctgcctcagcctcccgagtagctgggactacaggcttgtgccaccacacctggctaatttttgcatttttagtagagatgggatttcactattttggccagactggtctcaaactcctgacctcatgatcctccccccttggcctcccaaaatgctgggattacaggcgtgagccaccgtgcctggcccgattttgttattttatgtagaactacttttatattgagagccatacttgtggcctcaacttacttgcaggttactctggaagccaactcctgtgaaggcaggggactcaaattatcatttttccatctttaattatgaaggtcagctttcatttgctgtgaaaacaacacggataatttgggaccataatacgttctgaaatagttcaagacaagcatgttaaaaatgagggtttttttttttccccactgaaccttccctcaagattttattgtcttcataataaaagatgatgcttagaactagttaatttggctctttctcttcttttctcctcccggttcaaaatgcttgcttctcttaataggcagcattctcttagatttgcaactgggctcaaagcactgaagcctcatcacagtcttctttttggcagtagcctttttacagaattccagaaaatgggtttagtatgcccaccatagccactctgcttcctgtcataatgctgcttaccctgggcacacatagaatccttgtagtagaggcaggaggcagagaaattgtagacagacaggggccggaccctggtgaaacctcaccatcaaaaacaaaaccaaaaaaacagcctgaaacccgcagcccaaagtgagaacttctgttcctgtttgcccactctcttctggttggttctttctgattaatgcctttttaccaattgaatgttgccttttccaaaactacctatgggctgccctgcccccatcctgtgcctataaagaccccagactcagttgggagagagaggagagagagacagacagccagacagccagcctgacatcggggtagagacaacctgactttggggaagatgacctgcgcttcccatcccctctccacctccactttctgctgagagctgttttcattgctcaataaaattttccatcttcaccatccttcagctatccatgtgacctcattcttcttggatgctggacaagagcttgggacccatcaactgcaggtacccagaaaggctgccacacaagccctttgccctttccagtggagggcagctgccccatgtgatgaggcaaggggccaactgagctgttaacccaccactgtccgtggacagtggaactaaaggagcactgtaacacccactctggggcttcagggtcgtgggcaccctcacctggatgccacctcaagggccagctgagctgctaacacacgctgtctgcggatggcagaactaaagaagcactgtatcaccccctctggggctttggggtcatgggcatcctcacctgggtgcagctgtgttccccttgaggcgacatgcctggtctggctgtgggccctgcgcggagcttgctcctgtgtcggcatctggagcaactggccaggtcctgcacttgctcgctcatgtgttccctccacaaggggttgagtgtggcaggccgagtagagggggcacccctgctgggagtccggcaaaggggccgacaaaaatcctgcattacttgctcttcttgcactgtgtcattttgtagggttggtgcttgccacacgcgttacagaaagtttgatggtttttaggaatgttcaccatgtttataggagtgctattggaacagaaagaaaaatgagtttttttaagtgtcctaaaatactgttagtctctgcctcttgcccctttagtggaactttttgattatgcagaattacaacttgctgaagcccagttgaggtagctttgaaggaagttcatttcttcttttgcctctgttcagaggttggggaattttgtgactatgtaaatttgctaaggagacaccattccagattcttatctttcccaggactcaagtggctcttgctttgccactgtttttgctgttgtttttgagacagggtcttactctgtcgctcaggctggagtgcagtggtatgatcttgactcagtgtaacctccgcctactgggtttaagtgattttcccacctcagcctcccgagtagctgggagtacaagcatgtgccaccacacctggatactttttttttgtattttttggtagagatggtgtttcaccatgttggccaggctggtctcgaactcctgacctcaagtgatctgcccgccttggcctcccaaagtgctgggattacaggcatgaaccaccacctccagccacttttgtattattttgaataacaaagggcatttttgttactccctgcaagggagtagcttttacattaataccttttctttttgaaaatggactttgataaaagatgtaaaaagactttgtaaaattttgtttgataaccttttatgaggttaaaacaaagtttaattctgattacatggccaattctaaatttgagaccaggtacagtggcttatacctgtaatcccagcactttgggaggccaaggaggacagatggcttgagtttaggagatccagaacagtgtaggcaacatggtgaaacccgtctctacttaaaaaagaaaaaaaaagctgagagtggaggtgcgtgcctgtagtcccagctactcaggaggctgagcctggggggcggaggttgcagtgagccaggatcatgaccctgcattccagcctgtctgaaacagtgagaccctgcctcaaacaaacaaacaaacaaattcatttggctgtgtcttccacctgaaatcagattgggatctcatagtactacagctctcatagcattcaggtagatggagctagaaataagcccaagtatgcattttccttcaggactttttaacactaagctagaaaatataagtatctcataaaccttatccctttaattaaatttttagtaggaaccagaatgtaaatttcttccttccctaccccagaatgtagatgcatgtcctcatttaattttagtcattcttggcgaatgtgataattagggtaaagtgcaatgagatttgcaaattggatggtgaattcactaaatgtaacagctgatcagggcttctcttctcagtgtcactttattaaggtcttcggatatactgatatattctggagtttcctccccacccccgcctttttcttttctctctttctccccttgttgaaagatactaacttctacagtgttggtgtgagtagagtatcaggatattgatcttaggggaggtgaactaattatagatttgttttttcattttatgagaggctattcttcataataggaatatagaatatatgccatatacttgaggttacttttgttaatccctttaagaatggagcactttaccttgcttaacaagaaggaaataattgattcagatgctgcatgctgtgcaaggtgagttttgaatgcagtgaggcgtatatgcagtggtctgacttccgtaagcctcactcatctgactttcctttggttcttaatgttacactgaagactagctgggcatggtggcttatgcctgtaatcccagcactgtgggaggctgaggcaggcggatcacctgaggtcaggagttcaagaccagcctgaccaacatggagaaaccctgtctctactaaaaatacaaaattagccgggcgtggtggcacatgcctgtaatcccagctatgcgggaggctgaggcaggagaatcacttgaatctgggagaccgaggttgcggtcagctgagatcatgccattgtgctgcagcctgggcaacaagagtgaaactccgtctaaaaaaaaaaaaaaaaaaaaagaaaaagttacactgaggactaaactctaaccttttttctctcttgcccaaattcttatctaagggatctagggtgtcacaccctacaaaccatataaatttcatcaggtgggttttatttaaccctatataatatgccttacttttcaacctgactctggcataatatcacataacagataagaaaaatcaaaatattttaccctaaaatacgtttttttttcttccatatcttaaaatggccctgcaaagccatcttttataggggggagtatttgcatctgagagtctatcaccttttaaaggtttggataggagacatttgccatttatttgtctctaagggtggccacctataagacctcatctgcagaataaccttggtctccacaaccccccagacagttctattgattccaggtcttagataataactcttttgaccaattgccaatcagaaaatcttggaatccagctatgacctgtgtgaccctccccccacctgttctccatatatcctacttttctgcaccaatccagtatatacctcacatgtactgactgatgccttttgtttccctaaaacatatacaatcaaactgtaaccaagcgaccttgggcagatgttctcaggacctcttgagactgtgcctggagccatggtcactcatattgagcgcattataaacttctttaaatattttagagttttactctttttgttgacaacacaaaaataccattgaaccttaaatttcatgttacagggaagtgacatcccaaagactcccaggatggctaaacagtagaaaggagaacttttattggtgatactggtttgtaagctgggaagaggaagtctccagcatagactgaaggtgctctctctttgaagaggaaaaggacagactgggttttatgcctcaccagttctgtattacacagtggagtcatatatattcagcaggtttgggggaaaagctacatatttatgaggagagctgagtacaagcacaatgagtaaacatttatgtaacatataccccatattcactttgtggtggggttttagcattaaaatgagatggaatttcactatctatatcaaaaggtgaacaaaagcacacaaagactttgtgcagcccctataaactagctgaaactggtttctggtctccagtagcttatcggaaaagaatgtttataaggcccatcatctgtctaatcaagtggcctgggttgtaaatcagttctgaaaatttgcctgatagctcctattgttaaggagttaaacaagagggtggttactcttatagccataggaatttagaaaaatgccatgccagccaggccctgaacccttgacccacaggtaactgtttccttaactttagggtctgtcttagttgattaaggggcatcattttgatcttgcaggtcacaggaggaaaaaagctcttccactaccctcttaggctcagtagctggggtctatgaatcaaaatgataaaggacagattaacaggaataaaaacatacatataactacatatggatatacagggtttaacaaatgaatgtgacttaaggacacagttagaatttggggcttatatcccatcttaacaaagggaatgaaatacagagaagagtcttgttagacaaagaagaaaaggtttggggcttcttgaggggggtaagttgtgggaaagggactaaaaagggtacagtaaataagggtcatttgtaaggttttttaaaatgcaaactagagtcttttcaggtgccaagagttgtcttcagagtagttctcttcctgatactggagagggagacacctttacaaatggaactttatgtgctgtttttagtaagatggggaaggacagggagatttttttctgtgtctgctttttcttaaatgctttcagctgaaaatagttcttatgctatagtggcatatttttggatggtatattcttgtccccttccatgaggaaatgagttttgaggtgactgataatactacaccagactttataagggccgtatttggacctgcaatgagttctgtcctatttgaactcagaacattaattttcttttgctgtttttcacttaaaaatattctaatttcaaggcagttttatagtgtgtgcaatatagtactgtagtactgcatgtatatattttatatgtagttgcatgtatttggggtacatgagagcttttctgttctttgcttttgttttcactggtgagtgccttcataaaatgtctagtggccactggtctgtgaacttatttgtgtttattaatgtacaaataatgtcctaaccttttatttaagtgttcatgtgtatttctgtataatttgtatatttcagtggagggtggtctttccaacttcatgtgtgttctttgaagcaaaaattcctcttggtatctgacaggtatctaagcttatattgtatgcacgataggcacaaaataaatattcattaatgaatttcaaaaatcatatataaaaggaagttgttgattttcatcgtttactccagaaatttttatggattcattacatagcagttagaaatggtgatggtagattgagtagataagttagaaattgacatattgagaagtaataggtgacacccacaaaagaaaaagaagagtgaatatgtatggcttattgagattatttattatggggccacacagcttgatggagcttggtaacccctagcttagggcattattatattgaagcaaaggacagtgatagatgatttccagtaatgacactgtctttactttgatcttggacaagccatttaatctttctggtcctcagtttcctctttcataaaacgaaatgacagggctagaaagcttttgatgtcttttaaaaatttgaaattctacatgtactccgattatctgaggcagtcaccttaccaagtcacttagattcgctatattctctataataagaaaggtaaacacgttgtggaaacatttttattagaatgcttactcttttttcttttcttttctttctttttttattttttttgaccaaaaatgatttgggatgtagttcagttttttgacattaaaagggcaaatttggatgaataggtgaaaggtatatgaattaaagttttataataataacatatggcatttgtgattaaacaggaagtgttaaagtaatgaactccctacatctgatgaaatgaagcagaagccacatgatcacttatcagggatattgtagaaaatattgaccagttgggtaaaaatccattcaaacaggcaaccttcctatccaagagaaactcccctaatgttggggaactctttgaggttacataaagcaagttaggcaggtagttagggaggtactctttatgacatctgtccccttagattagtcttaatcttgggatgatgccttctaaggagcttgtcaggatgcagccttcccacagctgctggggaactctttcctcttgctctgttttggtgtcaggctttgagagtttcttcttttttttcttaatgtcttatccaacaaaagtagttatttacaattcggagtattttctttcacaggtttttctatgcatgtaccctctttataaaaattggacatagtttacatcctgttctataacttgctactttcgtgtaaccatatattgtggacacatttccttgtcagcacttgtagatctctataattctcagtttataaagtacttactgcgtggcagcacttttaaagtgctttcacatattaacatttaaccctcacgacaacctcatgaggtaggaaattctattacaggtaaagacgctgaagcagagagaggttaagtaattcccctatggttatatagttagtaaatagcagagccagtgttagaacccaggcagcctggcttaagtctgggtgctaactattttactaccctgcttctcaaatgaccgtaaggttcctttttgtgcctatgccgtgattcatgttagctactcctcgtggttgtacttttagttctctcctgtttcctttttgctgctacaatgtgccaggcatactctaagcctggtagcatgcttgtggactaaaatacgccaaaatccccatctttatgacattcatgctctggaggaaggaggtggttggagacagactattaaaaggttaaataagaaaattacattggcctggcacagtggctcatgcctgtaatcccagcactttgggatgccgagatggacagatcacttgagctcaggagtttgagaccaggctgggcaaaaccctgtgtctaaaaaacaaaaacaacaaaaatcaaaaagtatctggggcatggtggcgtgtgcctgtagtcctagctacttgggaggctgaggcaggagaatcacttgaacctgggaggtggaggtttcagtgagctgagatggagccacaccctgaaaaaaaaagaaagaaagagaaagaaaagaaaagaaagaaagaagccagacccgaaaagaaagaaagatagatagatggagcccgacccgaaaaaaaaggaagaaaggaagaaagagaaagaaagaaaagaaaggaagaaagaaagagaaagaaaagaaagaaaggaaagaaaagaaagaaggaaggaaggaaagaaaaagaaaagaaagaaagaaagaaagagattacatggtagaggaacaggtgagaagtactgtgaaaaagaaataggccaggtgtggtggctcatgtctgtaatcccagcactttgggaggccgaggcgggcagatcacttgatgtcaggggtttgagaccagcctggccaacatggtaaaaccccgtctctactaaaaatacaaaaattagctgggtgtggtggcacgtgcctgtaatcccagctactcgggaggctgaggcagggaattgcttgaacccgggaggtggaggttgcagtgagctgagatcacaccactgcactccagctggggctaagaagcaagactccgtctcaaaaaaaaaaaaaaaaaagagagaaggagaaataaagcagggaagcagccagtggtgttgctgtggagtataagagttttaagcagatgagagggcgatgtgagcaaagttgaggcagatgaaggaaagtgagccatgtggacatctgggccaagaatgtatcagtggagaaacagcaagtgccatggcttaatgtcaagtgcatgcatgactttttttcaggaacactcagaaggcctctgtggctgaaacagagtgaatgaggaaagagtaggagaagataagggaaggaacgcagaagggaggactgcccaggtagttagagcttcgtaggccattcttatgaactattagtccttgtgagatgatgatatatgaaacgattttcaggagaagagtaccatgttctggcttctgttttaaaatgaccactgctgtgttgagaccaaagtctaagggaatgaagatggaaggcagcagggaaaaagtgttactggcttagaccatggtggtagctgtggggatggtgataagtggcttaaacctggacatatttctgaggtatgttgaaacatggtatatttctgagtgggatttgctgatggattgagtgtgagagaagttaagagtaattctaagagttatgggaagaactggaaggatggacttgctgttgactgagattaacttgcacaaatgacttgatgctgaatttttaaatcaaagaacaaacttacggcctttagtactttagatacagcttttaagtcactagcctgagaagctaggtagtatatatgcttcattatcttgaaggattggagtttcagttgtagagaagtggaaacatgtgtcatagagacaagctgtctatcaggtgacataaataggcgttgacagtaattttcagggtatgaaaggttcagtttggcaggttcaggaatttgattttttaggtttacctagagttaaatgggcccaggcacagaactcataagtaaccagtctcatccattcagtttgtcatggagccccatcagaccatagccaacagcagccagcctcccaggatgacaagatctctccccttaccttgctgccaggacatctggtgaaagatttccagggaggatgacctgtagcagccagcctggtaggactcagaagcatcatcttctctctttttttaaacattattttttaattaaaaaaatttttttgagatggagtcttgctctgctccccaggctggagtgtagtggcacagtcgaagctcactgcagcctcgaccttctgggctcaaactctccttgcacctcagcctcctgagtacctgggactacaggtgtgtaccatcttgcctggctatgagaaccatctccttttccttttctttttttctttttcttttctttctttcttttttttttttttttttttttgttgttgttgagacagggtctcactctgtcacccaggctggagtgcagtggcaccattttgctcagtgcaacctctgcctccggggttcaagcgattctcctgcctcagccttctgagtagctgggattgcagctgtgcaccatgacacctggctattttttttttttttttggtatttttagtagagatcgggtttcatcatgttggccaagctggtctcaaattcctgacctcaagtgatctgcccgcctctgcctcccaaagtgctaggattacaggcgtgagccactatgcctggctgacaagtatcttcttacaagtctaaggaatcattcccgttgtctgcacttggttcactttggagccataaggctagttaagcccctctgatgcgtgttttatttttactgtacttctcattcattactcattgtgcgagcaccacagtcaccattttctaatttctgcaggtaccacctttgacttttctccatcgtttacttttccgcccttcatttttcccatgtagtttctttttcaaactttttgtatgtgtctcattgaatttctctttctataatgaaccaagtttttaaagacccttaacctcttcacagaagtctgtatacgtatcctcatttcttccccttaaaataaagctacaaaacatttaaactaatctttcacagacccttgttgcccttgtaaagcagatggaaacacagtaacaggtggcactgtaggctggggaggactcttagtctcagctgcccagccgccccagtgcccctgaccttctccctcagggacctcagtgggagtcagggtgatggagtcatgctttcagggaaaaccacttctcctgcataacgttggtatccttgggtctcttgataaaggtgcatgatgactgtcccacagctacttgcagctgtccttgccatctccacatctctgttcttccattcttcccttttacatgaaaacttggcttctaaagcatatttcttccttctcgctctaaactgtgaactttagatcagtgactatctttgtgtctttatttttccttgtgtctggcatgtgatacatgaacaaattgtagaatgaaaacatgaaatgcttgtgaacaaaagttctctgaaaaagggatttggaggaaacagactttattccagtgcaccatgacacccggctatttgaagcctttagtgtaaaacaaaggtgcattctagagaatgaagaggaggcttgagttgtataacaaaagttcccacccaggtttccaatcaggtccatttgtgcaaatgaaggattgaaacttgcttagttttgattggccaacacagctgagttctgattgttgaatgcaataaggtttttgaaatatggtattcatggaatctggagatcttgggtgctcctgccagctccagcactaactatggaaactgtgggactttaggcctcaatcattgcctcttcttaaatcttaatcttctcatctgtgaagtaagggaatgatattttgtcatctttaagtattttttattatgctatgaattttaagattttgtacaggccgggcatggtggctcatgcctgtaatcccagcactttgggaggctgaggtgggtggatcccttgaggtcaggagtttgagaccaggctggccaacatggtgaaaccccgtctctactaaaaatacaaaaatttgccaggtgtggtggtgcatgcctgtagtgccaactactcaggaggctgaggcaggagaatcaattgaacctgggagatagaggttgcagggagctgagattatgccactgcactccaacctgggcatcagagcgagactctgtcttgaaaaaaaaaaaaaaaagaaagaaagaaaaagattttgtacaaattgtttcttccatttggtttttggaagacaagagggaaaagcttctttatgttttctatattactcaagttaatgctctagaaaagggtacctctctttatttagaaatatgtttcaagaaaaaatgacccattatattaaatttatattgtttttatattagcatttcaaggctatctgaagtgaagaaatggaaattaatactattttaaattttcttcaggtattattcttatcaccattcatattttgcaggataaaagcttttaaaaatatgtctgtgctgggtacatttttaaaggaaatttttttaaggcttttattaacctgaacaaagctaaccagacaaaaagaacaagctgtaagaaggtactgttgagaacaaaaatactgtgtgaatttgcattaaaactttgctactttatttggtgacttgtaaagtatggtgttaatattccatgacagctatgatttcggcttagattatagttctggtctgccttagaattttaaagccaaatttaaaaaaataatgaaataattttttccccaaagccaatgtaattccacatcattgcccaggctggtctcaaacgccttcctgggctcaagctatacacctgcctaggcctcccaaagagctgggataaaggggcaagttgctgcacctcttttttttttttttttttttttttgagatggagtctcactgtgttgcctgagctggagtgcagtggtgcgatcttggctcactgcaacctccacctccctggttcaagcaattccctgcctcagcctcctgagtggctgggattacaggtgcatgccaccatgcccggctaatttttttgtatttttagtagagatgggtttcaccacgttggccagactggtctcgaactcctgaccttaggcaacccacccgccttggcctcccaaagtgctgggatttcaggcgtgagccactgcatccgaccttctctttttttaaaaaactaatttcaacttttattttagattcagtgggtacatgtgcagatttgttacatgggtgtattagttcattctcatgctacaaataaagacatacctgagactgggtaatttattaaaaaaaagaggtttaattgactcagttctgcatggctgggaaagcctcaggaaacttacaatcatggcagaaggcacctctttacaggggagcaggaggcagaatgagagctgagcaaatgggaaagccccttataaaccatcagatctcatcagaacttactatcatgagaacagcatgagggaaacgactcctatgattcagttacctcccactgggctcctcccgtgatatgtgagtattatgggaactacaattcaagatgagatttgggtggggacacagccaaaccatatcaatggtatagtgtgtgaattacttaatcatgcacctcaatttttctttgaattttttggtgttcttattcccttaaaataagctttcgcctatttcatgtcacgagaacattgtccctgagttgttatatattggctgtactgttttcaagtattctgcatgactaattacataatggctattaccctgattaagtgctatgtaagtgctaaccacagtttttattgtcatagtatcattggttctttgttttcacctattatttttgatcctatagaaatgtttgtacacctctataaaactgtaatgttttatattcaattggattctctcacactttgacactgctgcatccgctgtcatcaactatcactttgaaatctatcctcacttattctcagccagccaacttgcatttcagagatttgatgggcattgctagaatctcagattcagtgtgtcctatgttaatttattaccttctatcccagtgctcagctctgacaaccagtggaacaactatttcttttttttttttctctctgttttcttaagctgtggattagcaaactattagcaaactatggcctgctgcctgtttttgtaaataaagttttattaatgttagatgcccattcgtgtaagtattgtctatggctgcttttgcactaaggtggcagagtttaagaagttgcaacagagaccttatgaccagcaaagctgaaagttttgacttttggtccctttatagaaaagtttgctgacccctactttagactaaaactttggcattatctttgattcctcctttggtatttttcaagtatattctagcaagagaactaatctccatttctgtaatcatcatcatctttttaaaaatcttccggccgggggcggtggctcacgcctgtaatcccagcactttgggaggccgaggcaggcagatcacgaggtcaggagatcgagaccatcctggctaacacggtgaaaccccatctctactaaaaatacaaaaaaaattagccgggcctggtggtgggcacctgtagtcccagctactccggaggctgaggcaggagaatggcaggaacccaggaggcggaacttggagtgagccaagacagcaccattgcactccagcctgggccacagagcgagactctgcctcaaaaaaaaaaaaaatttcctccacatgcgttctggttctctgatccttttgcctagggtattaaattaatttcctcacctcctggcttcttttccccttctatttagggcaaacagaaggggaatgtcgatgtcaaatgtattgacattttacactatgtcaccagtgttatgttctcaaagttccactctgccaccaaaacttaagagatttccatattgcccacaaaattagagactctcaaccctcttaagattctttctacagtataagccctctcattctcccaattacagaaattatttctattaatataatgaaatactttcctcctccttgtctttgttcatgctctaacaactgccctgagctttctgtgcctccatctccatttttcctactcctgtcttgccaataaaaatcctcctagatttcctcatgaagctttttcctgtgttttcctttctgcatattctttttgacttcgtggtatgttagctatccatctcactgtcaccaaggacaccttactgaatgctgtgtttttaacgttcttttatatttcaaatattataaaccataagcttgttgagtgcaaagcacttgtcttcttcattaccgtgttctcttaaacactgagtgtaatgatgtcttagatatgcttaataagaaattgaatagcattttaggaagcaggctttttgaatttggatttaattattagtcatctcaatgtctcttggatgtttggcagaaattctaggtgttataatgaaagttcttgaaaaacttgatgttaacgtctttgtatacatggctaatgaaaatggaaagatttttttgtttgataaggtatttcacatttaatacaagaaaagtatttatatgcaatgatgtgcttggtactgataaaaagtaaaaccaggtggcagagccaggcaataattctcttggatgtgttatgcaatctaccaaagtcagatttgtttttatttcgttaacaagctttttcaagattccaagaagaaaaattatatcaaagtgttcttagaagctattgaaatgaaatgcaggtgccgttaaaatagtattttgtactctgtctattcatttatttaatcattctctctgtacttcccagaaaattttgatgtggctgttcatcacaaagagcccaattttttgttggcatctagttctgaatttgtactcttgaaaaagttgacaaagacaaagaagtgtgccaggtttagagaccttttactttgtagtagtacagtttaatgtcacaccgacagaaactcagctgctaatacccttacctttctcagttggtttcagaaacctagaggttgcttgtagtggtgggaggagggacccaattgggtacataacacgcagtgcccaaagactcagcaataaaagtgaacaaagcatcaaaacacactccaatacccgtacacatgcaaaagaattaaagacttgaaaatttaattttaagatgggcaaaggatttgactagtttctaggagaggatataagttctgctttgttcactactgtcttctagcacaaaataaatgtttgctatatatatgcatacccgagtgaataatgtcacatcaaaacatattgctagcaccctcttgagtaaagaaatgcttaaaaaatagccatatatgtatacttttgagccagcatttctacttcttagtttttttttttttttttttttgatacacagtcttgctctgttgcccaggctagaatacagtggcgccatcatcattggtggtgctcaccacaaccttgaactcctggggcttcagtgctcctcctggctcagcctccagagtagctaggactacagacacgccccaccatgcctggctaatttgtttatttttagtagagacaaggtctcgcgatgttgcccaggctggtttcaaactcctgggctcaagtgatcctcccgccttggcctcccaaagtgttgggattacaggtgtgaaccactgcacccaattacttagaatttatactgaggaaataattacacaacagagtggggatttcacatctaggtttctgtaatccagaaatactttctcaaatcttcaaatatgtttgtatgtacaaagcaccagcttgttttcccatatatgcttgcatatgtgagggatagtcttgtgtctggaagtaagcatatgcagtcaactttagcatgtctctagggagcaggactgaggagatgggggaattactagcacgtagggtattataccttttatttactcttctctgtttcagtttttttaaagtatattttacttttatattggtcaaaagactaggaaatagtctattaagttttaggcatattttcattaacatttaaaataagtaacctacttggagagttagcttgcctatctggaaaatgcagttttcaagaatgattcatatccttgggaataaagtaaaaaataatgaatttttttgttttataatgagacggtaatgaatggcattatcagattggactgctgttgtgttctttaatgctgcgataaatagacatattgtacagaagttttattatgtgttctttaaccagttgtaagaaaatcttgtttcatgtgagataggcctgttattatttggagaactaatatgcactaacaacagtttccaagagtatacccatgagcaaaggaattcacattgtcttctcttcaatcttttagaaaagctcaagaggagaacaagaaaatcgtactggctggatgcgttcctcaagcccagcctcgccaggactaccttaagggactgagtatcattggggtaagcttgtacctgatgcaaaaagagaaaatcttacattgttaacacctgtaatagctccgcattttattttctgtttgtaggttatttgtaagctatgttacacttatggctgtcctaaacatattttccttattgtccctgaaactgtcatttctgtgtaactttttcaccttagcacaaaaacatgtgttagtttctctcattaagaaagagcaacacaataaaaagccatagtgtggaatttacatcccttaataacccggtctttggctgtctgttaccatcgctttccaagtcattacagtttttccacctcactcagctacttgcttttcgccccctagtacatcaatgccttttttcaaatgccccacttcccttatacctaccaccacaagtctcagctccaacatgacaacattctgtgaagccttctctgcctactccgtgtagtccaccataattattctctctagtttctctttgcttactgtgcagttacctgtcgtataattctttgaataaagcccacctgtctatttaaattgttagcctcatgcgaatagtttttcaatctttttttaaaactctcaccatgtttctctagcctttcctgtgatacctggcacatagtaagcactcaataagtgtttgttgattgcctgaaaaaaatcttcccgttgtatttctgttgttagcatacttttttttggggggcgtgggcagtcagctctgtgaagtaaggagactactgtctattctctctctcttgttctttgtagtcaattactctttgactgagtaaaaatgccctgaagtagctgatattcagtcaatatttgttgatcaaatgatggtgcttcttccttcccaacattctactgaagctgtaggtgataagctcagcaatgttgtttgtttaaaaaggctacattaatttaaaaaaatatgtaaaaacatcatatgctcatagaagaagtttacataattaattggcatctgctttgaactttatgatagatttttccttatttgatatactactgacaggttcttgtatcatgttctcagtgtaatgaacttgttttctgctgtgaagtccttaccccactagcaaatttaataatctttgaacaaacattctcactttcaacaaacagaacctgaatgtttggtaactttagtttgttttcaccatttgtctgtttacattttgatttttcttggtttaaggaatgaaatgaatatgggactcccgagttatcttttcatgtcagactaactttctctataaacataatcctgctgtggtagggaaataggaaactagttggaagtcttttttagagatggaatgtggtaaaaacttggagttgatcttagatttcatctcaaggaattacgttagagaatagcagaatttctctagtatggcaaaaggctcttctctgcatacattttggcaacattttttaaaatgccattgtgtgccgggaaaagcgtatgttaggatgtacaggagattctccagatgcagtgtaagggaggacacttagtgctattaatatgagtttatttgccaatgtcacagctttgtgtcagtccaattttcagggccgacacaaagctgtgacactggcagataaacatttttttttctatttaatcccacacctttgttgttctgtggttaacatttattttctttaaacttctattttaagttgaggggtacatgtgcaggtttgttatacaggttaaacacgcgtctgttgtacagattattttatcacctaggtactaagccttttactcattagttatttttcctgatcctctgcttcttcccactcactaccctccaataggccccagtgtggtgttaccgccagtgtgtccatgtattctcatcatgtagctcccacttaaaaatgagaatgtatggtatttggttttctgctcctgtgttagtttgttaaggataatggcctccagctccatccatagtcctacaaaagacatgctcttgtttttgtttttttatggctgcatagtattccatagtgtatatgtaccacattttctttatccgatatgtcattgtaggttgattccatgtctttgctattgtgaatagtgctacagtgaacattcacatgcatgtgtttttgtggtagaatgatttatatttctctgggtatatacccagtaattacattgctgggtcaaatggtagttttgcttttagctctctgaggagttgccacactgctttccataatggttgaactaatttacactcccaccaatagcatgtaagtgttcccttttctccacagtcttgccagcatctgttattttttgacattctgataatagccattctgactggcatgaggtagtatctcattgaggttttgattttcatttctctaacaatcagtgacactgagctttttttcatatgcttgttagccgcgtgtatgtcttcttttgaagtgtctgttcatgtcctttgcccactttttaatagggctgtttgttttttctcttgtaaatttgtttatgttccttatagatgctggatattagacctttgtcagatgtatggtttgcaaacattttctgccattctgtacattgtctgtttactctgttgagagtttcttttgctgttttgttctgtcatatagtcccattttgttaccactagtagtctttaggtttatcttattttgttcatttacaattggagaaataagaacacattttgaagagtgagtagaaataaaatctatatttctatcgccataatgcatttaaaattttgcttatcttcttcagacttaacctttgcatcttttacttaattgtaatctcaaacctattttgtattcttattttttgatgttctttcatgagttttttaaccattttaagtgtggcattagtgttctattgaaggatataacgtactttacctatttcttaattattgtatttaagaattttctagtttttaggaaatatgcataatacattaatgctctcgctggtcttttaaattttttaaatttgaaattagtatattttgaaaagtttctgaaagtggggtcacactatcattaacatttcagaggtgtaatttaattatatgtttaccagcattacatattattaaagtataagattattatttgttaatatcattttgtagagcatttttttctgtggcaggtatattacattttatttatcatcactgactttttatatatgaaaattatgtccacataactaaaaattttgaaaacaaattacaaattaggaaacaaaattatctaagttttacctttagagagacctacttttgaatagaactgttgtatagaattgctataaaactagaaaccttctcaaatatagtgagttacagtgaaataaagaaatgaattatattttatacaaagagaaaacagttctgaagtccaaaaagaatagatgtttaaattcagtgacttgggaaactatttttagcaggaagtttagaattgtattgcacgattgagtaaagaatgctattccttcacaaaatttctatgatgggaggatgttaatagagttggaaggaagaacaactgtaactgcattctttgcttttatcttctgctagcctttatctgtgtcaccttacagtacaggaagaatgtgtcaattctgttgaccaggcgattaaaataaaaaacttccatgaggtggggatcattgggtgagcaagctgcttattgtacatctgagttaaaggacttttattgtacttacccatgtttgaaagtgctcatagcataggcatttaagaagatattaatagataaagagagaaattactaccatcataacatgctggtttccatcaatataagcctgtaggaatggggcatttagtttagtaatcagaacaaggcagtgtggtgagaacacatggtaagcaattttttgacctctgggccttttattatcatctgtcccactctctcctgaaatcacctagttgtgattaatattatttgtgtgatggtgcatggaaagaaaataacaacattgaaaccagaaataaagcctgccatcctctgagtccagatcctctggctttggtggctgtaacctctgcacttctcccatcttggagcaaaaatctgtgcacaaacctgtctaatttcttcacaatggaagcggagagagaacagatttgaaaacatgtatgtcttgaataaaaagttttagccaaaatctttttcacaagatatgaaactatcttagcatgaagtgaagtttaaattttgtatctagatgatgtatatttatgagtgaccagtatagaatcaggatctttttgtctctttttaggatcttgaaacattttaccttacagttaaaaattccctttctcttttaacaaatagttatagttaatcatctaccttagagttttcatgcaatgccatttttattactgctatttgtttatgtcatttatgttagctgtagatagtttcatatcttgtgaatatatctgtttgaatgtttctgtttttcttttaggctaatttgttggcagaaagtttcttttagattagttaaccagaacataggatgttctcttaacatttgcagtaaaaaaagagtagtagacttcaggcttcagaaagcctagcttcaaatcctagacccaccatatcattatttatttggttcagcaagtacttactgagtgcctactgtgtgcttggtgtactgttccttgcacagtactatgcaagtgctgggaatgcagcagtatataaaatcgtcccagatccctgtcctcactgagcttacgttctggttcttagggagagaattctggtttgagtccagaacttctccagcttcctggagaatctagtgagatgggtccctagaccacagtgagatcaattagttgggaatttctctttaaggctcagatggaaatgcccttggtgtctgctggttgtgagttgtgttagggagagatgagtgaaacaatatttatttgctgagttcttcttcctaaggtagtgttatttatcagttattacagtatccattattaacaggaacaacatttattaggaagttaggctctcactctattactagaaagtgtgtttatgaaattgtgtgctttgtgtagtttttctgtgttattaacaaggaccacatttgaagttggtcttggtgttaattcattggactgatcattgtaactaattatagctctagaaattctaaataaactgcaaattaatagacacgttgtaaaatgttaagacatgcaattcacaacggaatatacaatttgatattgaaaatttgtaaatgacaaggcttcctcatgtgccagctgtgagccctgcaggcaggtgaacattttctttggagagctgaacagaaatgtggtttaacacaggtgtccacttatctcagggactattagcaggttgatttgcagtggttaaacatcttttcaggcaggctgctctaatctcgaaaagtgaaacaggattgacttttgactatttcaaatgcgagcactttaattttgaaaattatgtgtacagttaaagctgcatttgaacggctaaatttgagaatatttctatcgtacaccatgttgcaaaaggtaaacaaattcacaaagtggagcagtgtcacagtaacagtgggatcagtattgagggcaaggcttgaggaacgctctccttctcctgtttgcccctacttcgaacatttcttcttgccatgttctatttttttttaacttccgttgtctaaaaggtagtattgtgagagaatgacatgtaaatttaaacacccatttatgtttttcccttccttgacctgttggtttcactttttttggcatcttctaatctcacctgtattcatatatgtttcacctattgaatgattaaaatgtagtatatcatagtgattaagagtatggattcaggaactagattgcgtgggttcaaattgctgatctcaaattctcggctaatactaacaatagctgatgagctaaaaaaaaatcgccaaaaaaaatctaataatgttttaagaaagtttattagtttgcgttgggccacattcaaagctgtcctgggccacgtggggcccagaggccatgggttggacaagtctgatgtgtaaaattgtttattaattggtattttacatctctaatgtgtatttgttttagttataatattactctgtgtttaactttggtatcactttttaaattatcttttaatttgcaacatgttctgttatttaataggagtattctgatgtcccaaacactgtttctgtgtgtgattgagcttagcctgttgaattttgtttttattgctgaaggggttttgtgcctcctttacccctccccgctacagaaagtttaatcggtattttagttgcatttaagaggaagagaggttcctggtaccaatcctcattttactggcacccttctagcctggcttcatctttcagttagttatttttatctctaactcagtattagtcactcactggtactaccattcaggtgaaatatgccttcagtgttatgaggaatgtactgtcatgtaacttctgttgaaagggctatttctacctttggggaagaatctttttgaatgaagagattaaagatgaaaatatactgggagatgagtattaaagttaaatcacacataacatcaaatgctgttttgtgttacacagcaaagttgctcacgggcttgtgagttcaagaaaaatcttctcatagcgttgaaacacattaagctagcttagtgactgctgtcagcttccccacatttaagggatttggaaattgagccctcctccattactatgtaaggtagggacttggcttaatagagaagttaatattgaactttgacttgtcagatgctgattattcaatcaaacttcgttatggtaaaggggaaacatctgaacatatatttgatggaaaagactttatatgtatagttcttaatggagatggaaataagggcatttctttccttttttattgtatatatttaaggtgtacaatgtttttatatatacatagtgaaatgattactagagtcaagcaaaataacttatccatctccttctgtagttactttttatgtttgtgtgtagtaagagcacctaatatctactcttagcagattttcagtatacaatattaaatatagccctgatgatgtaattagatctctagacttgtcctacataactgcaactttgtaccctttgatctacttcacatttttctccccctccccaccccggtaatccccaggctactccctgtttctctgtatttgacttgttttaagtaaagcttttacacacaattgaaatcatgcatttttttttcccagtgtctggcttagtttacttagcataatgtcctccaggttcatcagtgttgtcacaaatgactggatatccttttaaaaatgttgaataatattccattacttaaatataccacaattattttattcattcatccatcgatggatacttaggttgttttcacatcttggttattgtgtataatgctgcattgaacttgagagcacagatatctctacagagtgctgatttcatttcctttggatatataaggattgctggatcatatggtagttctatttttaagtctttgaggaatcttcatactgttttccataacggctgtaccagtttactttcctaccaacagtgcataacggttctctcttctctacttcctcgctgacactcgttatttattgtctctttggcatggccatcctcagtgaggtgatagctcatggtggttttgatttgtctttccctaatcattatgatgttgaccacatttttatatatgttttcattggctatttgtatgtttcctttggaaaaatgtctattcaggtcctttgcccatttttaaataaggttatttaattattttgccattaagttatatgaattccttgtatattttggacatgaaccccttatcaggtatatggtttgcaaatattttctcccaatccataggctgccttttcattcagttgattgcttcccttgctgtgcagaatcattttagcttgatgtagtcccatttgtttatttttgctttttgttgcctgagcttttggtgtgatatccaaaaaatcagtgccaaggccaatgtcaaagatctttttccctatgtttaaggagagagagttttctcccaggaatttcacagtgtcaggtcttacatttagacctataatctggagctgatttttatgtatggtgtagtatacagattcaatgcagtttctatcaaaattccaatgacattgtttgcaaatatagaaaaacagttctaaaatttgtgtgaaaccacaggagactctgaatagccaaaacagtcttgaaaaggaaaaagttggagacataacactttgtggtttaaaattacagtctaaagccattgtggctagcagtggtttgtgcctgtaattgccgcaactcaagaggctgaagtgagaggatctcttgaggccgagaatttgagatcagcctgggcaacatactgaaaccttgtctctaaaataataataatgataataataacaataacaaaaattagcctggcatgatggcatactcctgtagttccagctacttgggaggctgaggcaggagggttgcttgagtcgaggagttccaggctgtggcgagttccaggctgtggtgagttccaggctgtggcgagttgttgtgattgtgccactgcactccagctccagcttgggaaagagagcaagactctgtttctggaaaaaaaaaaaaaaaaaaaaaaaaaaaaaaaaaaaaaaaagctatagtaatcaaaacagtatggtactggcataaaaatagacacatagacgaatgggaacagaatagagagcctagagataaagccaagcataccaaggatatgcactcaactgaagttttttcaacaagcccaccaagaagacacactggggaaaggatagtctctttatggtgttgggaatgaaactggacctagatatcactttttccttttacagatcagtggagttttcaggtagttttaaagttttggttgtggtattttttaattggaattaaaatgacattgtctttttatttatttatatacaatcaaaattaagacagctaataagaaagtactttgcatgtatgtgtatatatatatgtatatgtatgtgtatatatatgtatgtgtgtgtatatatatatataaaatgtattcacttcttttactcctgaaaggatttgaggtatcttgggataaaatcaagagatagtaaaaccccagccagattcatgcagtcttaataagagtcataccaactaatagagaaatatggacaaagagcactgtttcacatttttaatataattagcctgagcaatgttgttaatattattctattaaccctccagtggctttcatttgcaaatagaataaaatttaaaccacatagcatgaactgctgaactgcaagatctcacatactctttctcccatcattatgtgacctcatctcttaccactgtgtccctaattgctgtccctcttttgaccacacaacccatttatgttatttcagcctctcagtccttgtgcttactcttctgccggaggttcgcattgatgcctctgtcagtggttcgggtccctggactgatgctacctattcagtaagtttaactggactgctgtagaaaaattttgctctctacctcctaccactaatcccagattttcttttttttcttttctttttttttttgagatggagtctcactccatcccccaggctagagtgcagtggcacgatctcggctcactgcaagctccgcctcctgggttcacgccattctcctgcctcagcctcccaagtagctgggactacaggtgcccgccaccaagcctggctatttttttgtatttttagtagagatggggtctcactgtgttagccaagagggtctcgatcttctgacctcgtgatctgcccacctcggcctcccaaagtgctgggattagaggtgtgagccaccacgcccagccccagattttctttttcttttccttttttgtttttttttaaataaagacggggtctcgccatgttgtccagggtggtttcaaactcctaggctcaaacaatcttcccgcctcagcctcccagagtgctgtgattataggcatgaaccaccacacctggccccagattttaatttcttcatagtgtctgtcattgtagcaaatgaaaattttccattatttgcagtttctttcccctaattagactataaggtccatgaagcagggatgttgtattttttgtttgtttgagacaaggtttcgccctgtcactctggctaagtggaatgatgtgatcacggcacactgcagcctcccaagtagctgggactgcaggcacatgccaccacacatggctaattttttgtttctgtaaagatggtgtctctagttttccaggctggtctcaaactcctgggctcaagtgattctccctcctcaccctcccaaagtagggacattgtatttttcactgttatgtccccagttactagaactttgtagttcatagttagtgtttaacaaatatttttcaaatgaatgtatttatgccaatggtgatttgtgggggagagtttggagaaaatagttgtctgagtctcttgaaagttcacgttcagttgaagggcattttatgatcatttaataataacctccatgtgcataggagaagggagattcatcaagtggaccacctatctgccattcctggacaagatgtactaggaatcattggcaaaaatctatcttgatatccttgtgcctcaaatctctcagcctcagaaataacagtactatcagccaggcgtggtgactcatgcctgtaatcccagcactttgggaggccgaggcgggcagatcacttgaggtcaggagttcgggatcagtctggccaacatggtgaaaccctatctctgctaaaaatacaaaaattagccgggtgtggtggcaggcacctgtaatcccagctactcaggaggctgaggcaggagaatcgcttgaacccaggaagcggaggttgcagtgagccgagattacaccactgcactccaggctgagcaacagagtgaaaaaaaaaaaaaaaaaaaaaaaaaaaaaaaaaagaagtaacagtactgtctcctcctccctagtagtgtttgaggattaagtgtgataatgcacgtgaagtgtcagtgtagagcatgaaacagagtaattgttcaagaaatgttagctgtcactgtgttattcctagtcattaacttatctagctgctggtttttcaggaaaaatgatacttcaagtgcatactaaaacagaaccttcgactgcagagtagtgtcagcttgttctccgacggcttcaaatgagtggacttttttttttaaagcctagttggcaaaattgtgtttgagatgtatgttcatttcctaaggctgccataacaaattactgtaaactgagtggctcccttagccattccctaaagctgcacttttcagtgtggctgcagtagccacatttgactatttaaatatgaattaagttcctcagtaacagtagccacatttgaagtctgtaataaccacatgtggctagtgactatcatagtggatggcacagcatataaacatttccatcattgcagaaggtcctgctgacagcactgctctgagtgattaggatactttagaatagcatttttatttgctttgagtgccattgtataggcttgtttcttcaatacatgtctagttataaatttggaatagttgataatagctgaataaaatatttttgtggatttctttttaaagttctgcagtagaatgactcattaatgttatttatgaattgtttatacaccaactcctttcttcattgttgagaacatatggagtcagtaataaaacatactgcctgtctttttttgtgtgtatttataactaagtgcctcaaggacacaagatactgttttatttattttatttgaattacatgctagagaataagctcttgtgtattcagagcctcaatttatatattaattaagaacaactttccttttctcccagaatgagttcaatatattcttcattactgtatgtgaattttgagtttgttttcttgctctcgattgttttttcttctttctctgcctcccacccttcattttttttttcttctgatgttttcctcttccgcgtaactccccctcccctgactcttctctccgtttcctcttggtctccccttttttcccttttccccattgcttcctccgttgtcttccgtactggaaaccaaaatggacataatattatctttaaatcatttaataaacttctcttctgtttgtaatcaagtacttacattttttttttaaattttacagttttggcagatctttctttttaaggtcctggggttcccacacaccatccagtgatttaaattatcatgtgttggcaatattccacttcctgccataaaagcaaatgtaatcaagtactattttaaattagaggatatattttcagctatatacattcaagcaaattctgtgtgaccatcagggtctccatcttcatcaggccatctttgtttcttctatgtgcatgcacacatgtacacacacacacagacacagacacactcttagacttttcattttgacgtagtatcactcagaaatgttgcaaaaataaagagttcctatatgctctttacccagattccccaaatattaacattttaacacattttctcattctttttatgtgtacacattttccccctgatcccgatccttatgaaagtgagttgcaaccatgatgccctttacttctaaatacccatatatttaaaaagctacgacacactcttaaatcactatagtacaattatcagtattaatacaatattataaactagtgtattagctttattcagatattgccaattgtttcaatactgtcctttataggaaatgaaaagtctcagattcatagtagcattcaggtcaggtctcttcagtctcctttaatctggatcatttcctcagtttttcgttgactttcatggccttgacattggaacctttgaccactcccaacgttttttttctttttggtaataacaactttactgagatataattcacacactatgcaattcacccatttaaagtgtacaattcattgcattttagtttattcatagaattgtatgaccattaccacaattaattttagaacattttcatcatttcaaaaaaaacgcaggtacttcttagcaactgcctttcattctccctctgcccatccaaagacaatcactaactgacattgtctctgtagattttcttattttggacatttcctattgtgacctttttgtctagcttctttcactttgcatttatagcatgtaaccatacttcattcccttttatggattagtaatatgatcaggcaccacgtaacaaactttaatcaatgatgtatataagtcagtggtctctttagattataatacagtatttttactgtaccttttatatgtttagattcttaccattgtgtatcagctgcctgcagtattcagtacagtagcaggctgtacaggtttgtagcctaggagcagtaggctatatcatatagcctagttgagtagtaggctgtaccatctgggtttgtgtaagtacactctgaagttcacacaatgaagcgatgacctaataacacgtttctcagaacacattctgtcttagtgatgcgttgctgtatttcgttgtatgcatatgccacatgttgttaatctgaatggatacttccgttcccagtttttgcctattatgaataatgctattatgaacatttgtgtacaagtttttttatggacatgttttcatttttcttggagttataactaggattgacattactaaattatatggtaactgtttatttaatcatttgaggaacaggcagcttattttccaaagtgctgcatcattttactgcattcccatcagcaatgtatgaaggttccaatttctccacattttcaccaacactcgttattatctgtatgtgtgtgtgtgtgtgtgtgtgtgtgtgtgtgtattttaagagacagggtctcactctgtcacctacgctggagtccagtggtgtgatcataggtcactgtaattttgaactcctgggctcaagcggtctttcccccttagcctctcaagtatttaggactacaggtgagcaccactgtgcccagctaatttttaaaaattttttgtagagacaggatctcgctgtgttgcccaagctgggctcaaactcctggccttaaagtgatcttcccatattggcctcccaaagtgctgggattacaggtgtgagcaactgcacctggcctgcctgtctttttgttggtagtcatcctactgggtgtgaagtagtatctcattgtgttttttcagtagtggtaaactacacataaaatacaattgaccactgtaaccatttttaactgatgtggagtacatttacattgttgtgtagtcatcaccactatccatctctagaatattttcattttctcatactaaaactctatacccattaagcaatagctccctattcctacgttacggttctgatttgcatttcctggttggctaatgatgttgagcatcttttcatatatttattggccataagtatattttccttggaaaagtgtctgttcagattattttcccatttttaattgggttgtctttttattattgagttgtagaagttcttcataaattctagatataagttccttaccagatatgtgatttataaaagttttctctcattttctgtgttgtcatgttactttgttgatgttgtcctttgaagtaccaaatggtttgaattttgatgatatccaatttattttttcttttgttgtttttgttgtttgtgctttggcattacatctaagaaatcagtgtctaatctaaggttcatatagatttatggctgtgttttcttctaagacttttatagttttagcttaccctcaactttttaacagactgcttcctctgcatgttctgacttttctctagaaatatggcttcttattcagtccatgtgctacaagagtggatgcagtgcttttgagcttttatatttttaactgcataggaaaacatttttctttatggtttcatcatggaattatcttatattttattcattttattgtctgtcttctatccttaattgatatcttggtcattcacccacatccagtaggaaatttgaccaactctttcttatcctattcatgtctgtattatctttggcaatctgagtgtctggatataatgtcttggcaacattgtcacctctcacttcatcatacatcagttccagcagtcatcacctacaccttgtttcagcaacctattcccattgccagatactggaccttactattcttcagaaatactaaatgcctgtgtctgtactctggttataactttctgtcctttttcttttctccttcctttttttccccttcatttttttctttctccaacccccagccacttcatttcttcttttctggctctatttctttccctgtttaacctatttgccaaacttcgtctcatctaaaatgcatagttaactttccttgttccattttctttctagtccattccacaaatctcttagtgttgtttcatcagtcctttcaaccatcctggtataatttagatgctcaataattgatgagtgaataaatggtggtattaacaaaccttgggtcagtctgtttgtctgtttggctcctactgtagaactgctgggacttgagaaaaattatagctctacttggagttattgttataaattcatggtctcatatttcaactggtgtcccaatattgtgtggtgaattttatgtgttcttagtcatcactgtctcttgttgtctgtaataggtatttgaaaacattcattctgttattttatgatatgctttctaactcttagcagatgaacttctggttactttactgagaaaaattgagggcaacaggtgggaatttgcttagattctccctgacctctacaagagtactagcatcttttcccatgctttacccctaacctcttctttcaggagacgaagagttggcccttttctcactctgacttgttctctattcatgttttagattttgctcggtctacttcctgaagatcattgctccatcacttgtttttcagtctacagctcctttgcctactgcctttctctgctcaaactgcaaaaaaagaaataaatagttacttgtacgaacctaaaccaaaatgtaatatattcaatattctctagccatcaagagcctttcttctccttccctttctccccagctttttactgagtacaaattaactctctctgttttcttacgtataattcattactactgaactcactgctttccctaagtttgattcccgtattgttaaatcaaacatattcattttagtctgtatacttatgtctctgtagtatttgacactgttggtcacttcctcctctttgaaatctttgttctgctggcttcttcaatcacattctgtatggaagccacatgggctcttataataaaaccagggcctaatggttccattgtttcctggtagatgcatctccggttgggtaggtttgttgggggctgaaaacctaatgttgtctgagatttacttacctttggcagtttctcagtaattattgttgctgctgccatcatgttgggctgagtggtcagacgtagaatggagttcaggtctgctctcacaagcctttcctcattttctgtaagatactgagaccaaaggaatatttttaagagaattaccatttccttccttccttccttccttccttccttcctttcttccttccttctccccttccttccttccttccttccttccttccttccttccttccttccttccttccttccttccttccttccctccttcccttccttccctccttccttccttcctttccttactgtgttgcccaggcttgagtgcagtggtgtgatctcagctcactacaacctccacctcccatgttcaagttattatcttgcctcagcctcctgagtagctgggactaaggcatgcaccactacacctggctaatttttgtatttttaatagagatagggtttcaccatgttggccaggctggtctcgaactcctgacctcaagtgatctgccccctcctaggcctcccaaaatgctggaattataggcatgaaccactgtggccagccagccattacatttttaataaagttttttaaacaggttcctcttgtctcagttgagttcattgcagagttgtataataatgaaagaatagaaattttttcatcaatagaggtatggatgcatgcatcacatcatgcatccatacagagagatagtaaggtgaatgaaatagacctatagactgacaatatatagaaaaaacatcaaggcacaggtgtattttatacatatgtataaccccctaccaaagaccccgggacctcactgtgttgccccagctggtcttggtctattttgtatatcttttttatatatttatttacacacacacacacacaccctctatcatttgtaaaagaaggataaaactatagaacagacctatatgtaaatgtttgatgccagaaaatgtcatggtatctgctcatcacactattattagtggtttcatctgaggagtggaaatacagcatgaaagatgttatgatttctttcaactgacttccattttatattctattttgtttgacttttttgtgatatttcttctgtaataaaacaacggtaatttaaggacttttaaagaagaatcgactttgacttattctttttttagctttgtgaatcataatattactttgctttttttcattttccttttaaactctagccatgcttactcattctcagtgggtttctccaatcataatcctgtttaatcataaccccaggagtcatccttggttctctaggaagcattcctgcatcacttggtctgattttattacctttcctctgtgttcccatggcaaagcttccttagtctctggtgtatagaacagaagctgtattatttgactttgtatttcatggacctgagtacagtacccagcacatggtagaaattcatcaaaagggttttgagtattaaaataataaagatagaatttggaacagatctccttaatactagcatgttctttttgtgtagcttgtcgttttatgccattttttttcctgaagctctgtgtgagaagacatgtgttaattaaacttaagtttctgtctcaggatatgttgagtatatgttgataggctatcctaaaacaactccaggcagtttatttaaatgcaatatgatatcttcagttatcattggaggacaggagagtgataatttcatacttcattgaaacacaaaatattaatataggatattttttatagtgtctccaaatacattaaaggaaacctgcattgatgtgcttagaaaatgtgtaacattgactcaagcataaggataaacacaaattttgtttcttcgtgtaaattacttgtgtaatcgtttttttttttttccaggttcagcagatagatcgtgtggtagaagttgtggaggagacaattaaaggtaatcgttgaaagtgagataaacagatgtatatattttctgaactacatagtagaaacaccactcaggtaactcttgccaggcacctttataaaagttattgttttagatataaaatcataaaatgttatccttggcttcatgaatttgccagtctaatattggaggcaggcactcgctgtatatttgtttggcttataaatgaatcaggcaaagagcaatggcttactcctgtaaccccagcagttggggctggggctgaggctgaggctgaggctggaggattcctgaggccaggagttcaagaccagcctgggcaagatcctgggatctctgggggagaaagtcagcttgatgctgtggtgtgcacctgtagtcccagctacttaggaagttgaagctggaggatcatttgggtccaggagttcaagtctgcagtaagctataatcatgtaactgcactccagcctgagcaacacagtgacaccctgtctttaaagaataaatgaatcaggtcatagttttcttttttaaatattattttatttttgtgtaaaatgaatttagtttgaatttcagattgaaagaatttaatcaattttaagataaagaaattttctgggcacagtggttcatgcctgtaatcccagcactttgggagactgaggtagttggattgcttgagcccaggagttcgagaccagcttgggcaacatggcgaaacctcatctctacaaaaaatagaaaaattagctgggtgtggtggggtgctcatgtagacccatctactcaggaggctgaggtgggaggattgcttgaggctgggaggttgaggctgcagtgaacagtgattgcaccattgcactccagcccagttgacagagcgagaccctatctcaaaataaataaataaataataaggaattttttatttgtacattttgttatcacataattaggttgttttgtaagtacttttaacagtaataattttgatgcttgttcaaggtgtattttttatagttacactaaaaattacacaaagaaagtagaattaagctttgcttattttgttagccaacactcactgacatagattcttattgaagtcactgtgaaataaaccatcttcaactctgtggtataattttaaatttttaaaggctttttcctatgtttgattagcacaaatgaaaaccaataatatgatactgaaatattaagtgaattgaaagtctcacttaagtactgttttgttgtaaatgagaaacttatattttttaaaaaaccatatagtctccacgtgccaaactggaaattttaatgctgcacttttccttctgggtggtgtctactactttccacatgcttctattcattaattttgaatcattgccttatcagagattattacagaatcaatttctaataaatgagattatgagaatatgagaatgagactataccttaatctttttttattattttttaatttttaaaaattatttattttataaatagagatgagattttgccatgttgcccaggctggtctcgaactcctggggtcaaacgatccacccaccttggcctccaaaagtgctggaattacaggcatgagctgccatgcttggcccttaatcttcttttgatgttccaaaataaagtgaaatatcaggattaaaaatttatagcaatgataatttgaatgtttttacaaactacttcaactccgtcctggagaatccagaagtgctagcatttattgtgtacctacagtgtgacagccactatgttaaacacttcacatgggttaagtcatttaaccttcataatagtactgtgaagtgaagtgggcataaatattttcctaattttgcagaggaccaagttgagacacaggtgcatacagctagtaagtgacagcattgggatttgaatccaggcagtctggctccaaagcctgtacattatactgtgatttatacgatactgttatttctttgctctctcacagttgagattcactaccttaaatgttatttgattgagtgtcttaagcagtgatttaagatacttgagggcattgttgccttattcatcctttgtcttaagtaccaggtatatactggccactcaataattttttaaaaaaattaatgatgatgaagaatataggagaaaatctaggtgatcttgatgtggcgtgattgtttagatacgacatcaaaagtatgatttatgaaagaaataattgccaagttggatgtcattaagttgaaaattttttgctctataaaagacactgtcaagaggatgggaaaataagccacagagtgggagaaaatatttgcaaaatacacatatgataaagggctattatccaaaatatatgaagacctcttaaaactcaataataagaaaaggaacaacccagttaaaaaatgggcaaaagacctgaacagacaatttactaaagaagatatgcaaatgtcaaattagcatataaaaaggtgtttgacatcgtatgtctgtcattagtgaattaccaattaaagcagcaatgcaatatagtggtatgttaaaactatacacctggtacaatggtcaaaatccaaaacattgacaacaccaaattctggcaaggatatggagcaacaggaactctcatttattgctggtggtaatgcaaaatggtacaggtactttgaaagacagtttggcaatttcttaaaactaaacacagtcttacatcatccagcaggtgtgctacttgatatttatccaaatgagttgaaaacttacgtctatacaaaaacctgttcagtgtttatagtagctttatttgtaattactaaaacttagaagcaaaaaaatggccctttagtaagtaaatagataaagaaactgtggtacatgcagacaatggagtattatttgacactaaaagaaatgagctaaaaaaccatgaaatgacatagagggactttaaatgcatactatgatgtgaaagacatcaatctgtaaggctacatactctatgagtccaactaattggacattgtggaaaaggtgaaatacggaaggagtaaacggatcagttggtgtcagtgattagagagtagggagggatgtgtaggcagaaaacagaagatatttatgacagtaattctattctgtatgatgctgtaatggtggacaattgtcattatatatttgtttaaatccttagaatgaacaacaccaagcgtgaaccctaatgtaaactgtggactcttgatgaaaatgatgtgtcagtgtaggttcattgattgtaacaaacgtaccactctgttgtaggatattgatagttggagaggctgtgtgtgaagtgggggcagtgatatatagaaactgtacttctgctgagtttttctttgaatctaaaactactctaaaaaataaaatctattttaggaaattaatggtaattaacagtgtgcttaggagtttgccaaatggcctggagagataaaatttctatgggaaatcatacaagacctgttactcccaggctgagttaatcatggatagctccttactgatgagcgtggacttgagtggatttactggagagattgtgtgtgcatttggctatgaaagtgagtcgaagatgaagttgaaggggatattcattggcaggtttggttagaggatgggaagtttgataattaagccttcataatgcaacaggagaatttttcagatggaaggaataattttgatagctttccttagtttgcagatcaggaagctgagctgtgaaggagttacatgatgtttttgagatctcttagttaatagagaactgtgcctatcagtcaacttctgttcttcgctttctatgtctactgccagtacttcattcagacagcatatgtcactgaaataatgtggttgttacagcagttagccagttgttggttgtctttcagcaagttatttttctgaggcttagttttctcagcttaaaatggtcaggattaaatggataagacttttgaggtacacagaacatattaaggcattagttcatgttaatgcttacctcttacttcctccttaatataagaactgctggaataatctaactgatctttgccatcagtgactctcctttcaatctgactgcatatcctgctatcattaacctgggattattttactttcctgtatgtatactctcactggtgcctcttacccaccaagttaatttgggactttctaccattttcacttcttttgtccatgcatgctgtacattataccctttgctccagccaactgtgctgcttgatgtttcttatatattttttcactgtgctttacatttacttgatggtcctccacagaagtggatatcttctgtttgtccttccacatctattctccatcttgatctgtgtccttggaggctgacctgtatggattgaatcagtaagattcttgccatcttatgtccagttggatttagccaattggaggatgtgacaagagagcaagctaagagtatccattcccgtctctccttccctccctgcctattttgggttggttgctttccttaccctaaggtcacagctcttgtctggtgaccctccctgtttatctttctccaggtttctgcagctcttctcttccttgcctctgggatggaaacagcaccccgttgttgctagcctcagagtaccgcattgtctgttgattttcctaaccctgcccagattttagtaaatcgttcctttatgaaaatcttcttagttatgcagtgagccatctgctttgctggtaccctgattgataagaagttagctgtggagaagcaaggctctgcccagaagggccagatggaataccgcctgacaagaggattttgctataaccctcttgtttccacatttgatccctgttgggctctcttcatatctcatctttgaaggggctttagacatacagcctctgtcacagcctgtttgcattcttcttattgctgcttatgttacaccaagtagtattttaaaaactgtactaataaggtacattgatactaaaagcatttaactctattgtaattaacataaaaccataaaagcttgttttcatttatctgtcttgattgtatcaaaatggcaaattcttgataagttattctgaaatggatcttcatcatgttaatagcaacaagaaaactccattcatttgtggttttggcttcaggatatatgaaattataatgaatttaggatttttttcctgtatcactttgataattttataaggtgtggaactgaatgtaaggaaagaaatacagcgtctagtggattcacattcatttccgtcttttaaaaatattcatacgcaccttagtcttggctcatatggtcattaaaaacttttttttgtatgaaaactatgaaaggaatataaatctgcatttcttccaaaaaaagtatgtgaaatcttctaaacaaaatatcattaaaaataatcttatctttgtggaaagatagtctaattggatatcttatgacaagttattgcaaataaattttacctatcgacattagaaaaatgtttttaccattacgtcatgtttctttaccaatcaacctctgttgagatccctattgtaattaatatgtttgctggtatttctttcagttagattccaaatgcctcaagtggcggtaatttagggttttcccaacgtggtatataatttgcaagtttcaccgattttctgttttttcctaacttctcagtaattggtgccatcttgcactagactgacctaaattcccagagtacgtcaccaagcagctttcttatttaagacattgctactaatcttcactctgtaaggttttgtattttgcatgtggtacttatttagagcataaactgttcataggttgagactgggaagcagtactgtatcaagtgtggtttgatcagtgtgagtgactgaataaccaccttacagagctcaatgcagacttacttgaggatgttttccaaactcaatgagtaagtgattgagcttagatatgtagcatggtatatctgggagggtattggaccacaaaagcacatctgctttttcaatagttgcatttcaataaaataatttttattgatttttaatatgtgctttgaaagaacacttgtatgcatcctctcattatatgtaatctctgatacagttagtatagtctgaatgtagtgggaaaaagtttgtggattgccttacatgttaggaatactttccagtctcatcggtgtaagtaaatacatgataacttctaccttctagtgagtaaaggagccagggatttattactttatttagtttttttcaatgagcctgtttgttttaagtttatgagtatagtaaagttaactttactatttgattacagtttggtaacttgcatttcccattgcaaaggtaatggttacattctttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccggttacattcttaaatgcactcagtttatctgttttgctatcctcttttctttatatctcctttagtttccccacgttaacaataggattgcagctttacttatttgtattctgtacatctacatacattatttctaggatgaactccttgttattcattctctctctcttagatagcatttttcaaaccataacattttcttaaaaataagagtaggctaatttctttatggccccaaacaaaaacattgtatgataagacttttagttgatttttttacatcacttcattctataccttggtttggaataataccagaaaggactttgtaagagaagccagcatgtgttgtcttgtctgtatttctgtaactttataactgtattggccaaattatcagtcctgtttttagctacacacatacagagcagcagcagtgtttatccactacaaaatatgtaatagatgctctagaaaaagtcttctttaaacattgtaagtggtcaagttcactgggtttttttaaatgaagatagtaagtaactttacatttatcaagtatttttagccattaaggcttttagaacacaaatgaatgcctaaatgaatcccccaagtggattctgctgctttatggtggcttcagaatggcagaatggtcttacatgctttttgttcatcttaaatttaattatacagctttagtgtatttatcgcttatatttccttttctgatcaaagatacattttttttaattatttgaaaccacctttcatcattaatggagtttatttatatgaggacttgggtatttctctaacttttgatttcttaattctggggttttggtggggtgagctggtgcatagtgttgaatagttcaagttgataatcatattgtagttttcacataatacactgttatagtggtttactagatttgattgccgtaagcaaggaaaggaaattactttaggcttgaacctcacaggcttcccatgacccagcccttctgctagtagtcccactgacctgtccagtatggtatccccatctttctttgtttaactattaacgaggacttgcctactcttaattacacttacacattaactcttgtgaatcctggtagtgttttggcagatttcatgaaggtgagactacaagtattgtcaaatctctaaaaatgtattatcatttagacttttgtgaaactgttaacatgagcaaatatatgtttgaacatccttgcttttacatgtgtattttaatcatttttatttctggtacttaatattttcagatatggcaacttctgattcccagggttctcgtttctcaaccatattaatttttcttaataaataaataaagcatcaatcccagaaagaatttgtattatacctaaatgttatagtatttactacagtaggaattatttagtgaaaaagaaaaataccaagtagatcaattaatcattttgaggcttccatacaaaatgttcacttaatgtatgtattttaagagttttaatatgctttaaaagaaaatacaaaaataacatttttttcatgttatattcttcctttattataaccaacttttaagagaattggcagttgctacactgcttttatacactgcatatgtatcatgtgctttattacgtgactggagagattttattcttcattagagaatgcactatttttggttagtaaaatatattgagaatagatgagactgtaaagttagagaaaaaaatagatactagcagcttcactgcatttttcaaatgcagggtaaagttgtaggttaattgtggtattttctgttttgctttgattattctcagcacaatagtaaattgtattgtattggtaattcttctttagtactttatagctgatttccctaaaattaaaaatataaaatagaaaccaggtcatgttagaaatacagtatctaaagctttgataggacatagaaattatcatcttcaatttttttttaaaaaaacaaagattttattgttatggaaataatttattatgtcacagtcaagtgaaaactggcaccacaaagtaatttgatggctcagatgtaggtagaaaagaaatttaaatctgactttctctttttcttgaaaaattgtatttgataattggaataattaattaggtgtaggataaacttttctttagtgatgttatggatcttttcttagaaaacctaatattgataataattggtacaggattattacaataatgtttaatcgatttgaacatttatttctaatatttggtgattggcacattttttcttttagaagttcattctgtaacacattatgaagtatacagcagagatgtagcaattactttggagatggagagactaaataccaatttcacttattaatttgagggagagaaaactcacttggagacttcagttaggatatcaactctggatatcctctggatatctggatattttaaagaagtttatctcagtactaccattttataactaagtatgcactgtattgagtaataaagaaataggaattaaaatgtccttataaaggatgctttctaacattaaatctttattgtaattctgaaaattaaagtgcaccatttcttgaagctgcactgaaaagtcagcgctgtgttgggtgctgttgggtgctgctgtgacaggtgagagtccttgattgagactatgaagagctgtgtgcaaatgcttgtttgtactactaacaatgctatctttaacagcccatacaacctcactggttctcagtttcctgagttgcaaattgtatcacatggaaggtcacttccactctgaaattcttgaagtgcatgcgtctgtaatataaaattgagtttcagagtctgtcattagaatagtttttggcattttagatagtgatctctagcagaagttaatagaatgtgactagcctttatctcgcaccccgatttctatatgccagattttactttttctttccttgtgccctccttcttacaaaatgaagctgaagatgtttgtggcagaggtaccatgcatttttgtttggtgtacctctatattttttagtgaagagggtcttgagtaatgcccagttcttggactcttttgcccttcctccattcagttgtaatgcagttctgggcagtgacagggagcgtgcttcccagtgttgctcagaaacactgtgcctctttgaaggagctttcatttccacccgggagcatgtttattttcaggactttgagagaggtagttttagtcttggtaacttggtttgccgagagaaaaagtgatttgaggggatttaatgtaggtaacattacctagagcagtgattctcaagaatgtttgctgggagagggatggtggctgagaggacccatgacctgagaggggagatggcagactgctcaatccagactattgggaaactgggagctggggagttggccctgcagccactcacctggattcattgccatggtaagcccctgttctagacaggtaaggatcatatcactcaggcgtcctgaggtggaaaaacagccttggctctctgacatggtccctgaacacacgtgcttatactcacccaggaccatgtacggttccaggttcattacctatgcctttttcccgtaactcacacccgggaaagtacatcacaatgcaaatgagtgacttcacaggggtgacctttaatctactttaatttgtatatttaagatgtcattcacaaacttgtgatcatcttttttttttttttttttcaagacagagtcttgctccgtcgcccaggctggagtgcagtggtgcgatcttggctcactgcagcctccacctcccaggttcaagcgattcttgtgcctcagcctcccaagtagctgggattacagacatgcaccactatgcttggcttatttttgtatttttagtagagaaggagtttcaccatgttggctaggctggtctcgaactccttgcctcatgtgatctcccccgccttgtcccaaagtgctaggattacaggtgtgagccaccacaccggccttgatcatcattatcaatgcaattatttgtgacgtacttcctagccctccagagcttttaaaagaaatggaatctgactttaacttctagtgtttgaaagttttaaaaagtcccttgccatcttgcttttgagaaacgtcattagcgctgtatgttttgataggagtacagttgtttaattatggtagtaactgtaattaacttctgtctagctctttgtggcttaccattttcatatacattaattcatttctactccacaggaagcctggcattactgattatgcagccaagcagcagtgtactataatttgaaacctagtccccttgttccacataccctcctttctattctgtgaagctgttaatattgaacagacggaaatgagaaagtgaggcccatttattattttcttttctgatacctgttgtttaagatcactgctcactttttttccatgttccctttagatcttctcttatatattttgttccttcatgtgtcttgtttcctctttaatctttttaaacttttttttctcttttatttgctgttttattttgtgccaacataaaacattcttttgtaaggagttaataaagatacgcttaattttttatagaaaattctgagtatactgtttgagtcataccatgctataaaggtgcttaaattgggaaatgagtgagtgaacgtattccctaactataagcaactgttaaaaaagccagccaaaaaaaaagcaaatgaaagattctatagagaaaattcttgtgtatgtgttgtaagaataagtgttgaaagttttaatgtaaaacacactttgtatatagagtttttactgtcaaatggttaggtcaaaaaaatcctgcgatgttttttaaggatatgtcttaaatcttgtattctcaatcctagttatgtatttaggccacatgagttttgcagctgtaaccagaagtattttaatattcataactttcaatctttaacagaccatgcccaacactgtcatttttaaaaattaaattttaagacgatgtttgattagtcttttgactagaactaagaatctcaagcccacataatttctacttcatacattatttttaggagcattttcatttttgaaggcgtggtctttcaccatggggccccttcctgccaagtcttaataaatcttttaagtgaaatccagttaaagtgataggcttttaactagcttggttttaagaagtggaaaatcagtcaaaagcaggaaatctaggaaaaggtactgtgaaatagatataatcatgtatataatttgtatcctgcttgctctgcctcccagacttcagtgtcacctctccctgaagcctttcctgattttccctgggagagttgaccactcccttgtggtgtctctctgtacttagaaacatctgccagatcatctctgacacatccttccacttatttgttcaacagtctgccttcctcgagaccttaagtccctttaaggcagaagtcaaagtagtggctcaagatagagaaggttttaaatattaaaaagtaatctttcatacatgcttcattttctaagctcatctatggtattatggaacttttgtttcagttatgcatgtacattaatacagtgacttacaatataaaatgtacatcctctttgttttaactacatttttaaacttatttcactcttgccatttctatagaaaggcagtgataacacttatctcaacgggttgaggactaagagagtgaatttgaagcaaagtgagctccaggggcctcctctcatttagatgtatttatgctgcctacagtacaagattattcagttcttgattggaagtgaaatgaaggtcagcaaggtcagagaggcattttttaagatacatagatgggaaaattccccagcctttactgcttcccatctcttctgtcacactttatggtggcttgagttgaattagcgcgaggagacttgacatgttcatttgtgattgaaagtgagtgcaacatagtttggatgtttgtctcttctaaatctcattttgaaatgtgatcctcgctgttggaagtggggcctggtgggaggtatttgggtcatgggggcggttccctcatgaatggcttggtgctgtactggcccatagggaattctcatgtgagttggttgtttaaaagtgtgtgttatctgtccccttcgtgtcttttcttgttcctactctccccgtgtgacaggtgggcaccccctttgccttctgccgtgactggaggcttcctgaggccttactagaagctgagcagatgctgttaccatacttcccgtacagcctgcagaaccgtgagccaattaaacctcttttctttataaattacgcagcctcaggtattcctttatagcagtgcataaaatggcctatattcagtgggactctgagcttcaattttaaaagttaactgtggcttacaagttccttatgtcttgtacattttattgttctcattttccagcagcttgagtgctgtcttttgtaaggtctgctttgctttcaacactggctacagtatctttgggaatacaggtttgagcatgagaaatcgttatgttctgtattgttgctgtggttgctttacatacagaaacagaagtgctcatagctttattgctgtaaatatcaagggcttggagccatttgataaatttagaattcaggagagtctgttgtagcaagacagctaatgacctgaagagttctactaagggtcaatactaatgttgagttattgacatgggactgctttgacttttaactgttctgatgtacatttgatttggattctgaaaagataaattgacaccacataagtctactcccactgtcataaaagacatatctgcttgcaaaagatatagtaattaaaacataaaattaaatacttactgtaatttgccccagaaggtatctccattagactaaaaggacattttgcttatgcagattactttgttatatgtatcctttgtttaatgtaacttaattattagttataccattgataatgtccaaatggaagaaaaaaattgcctaagaacattccattccaatgaatgttttcatctttccatgttctcttccataattcttgtccacacataaattttacattattaagattatagagtaggtacttttttgtacagcaggagttttgatattaaacaattctcagatttctagggatttaaactgtgtactgtgatcttaccttcgcctcctccccagtccaccaggtaaggtgttggaaccttcatgctttgttaaactctggaaatgcaccttggtaacatcagtaccttagtgggctctctacttatactctgatttatactttgagttctgtctttttggacagtctcttcttattcttttctcattttaatatctttttctaggtgtcattgctgtcattaacaaactcttcatacttgctgaaaaaggaaattatttaatgtcagtaacaaacaattagagcttgagttgtaaagattctgtgttttttagttaattctaccattttgtgtaaagttttccaatctagacttgtgacaaagctgcttcttccatttaacccagtttctgtgttttatattcttttcttcttttaagatgaaatatttcaaaggagtgtcacactttagtgtgaatacctacctttttttcttctaagaagtacctgtatatgaggaatgatattgaatggagtagagacaaactttgactacacttttgttgttctttgtaattgagtagttaaaatgcctgttaaggacacttaaagtggtaactatggacattttgtagaaaaacagattaaattgggcacttttgtataatattcttaaataaaattcaaattgatgtgatcaaatttaagtgagaattgatatgtacggtacatttatttacttatttattttttatttttatttttttttgaggtggagtctcgctctgtagcccaggctggagtgcagtggcgcgatctcggctcactgcaagctccaccttctgggttcacgccattctcctgcctcagcctcccgagtagctgggactacaggtgcctgccaccacgcccagctaatttttttatttttagtagagatggggtttcaccgtgttagccaggatggtcttgatcttctgacctcatgatctgcccgcctcggcctcccaaagtgctgggattacaggcttgagctgctgcacctggcccatttattcattttttaaaaaactttttttgcttgaattttctgccacccttctgccctctgccctctgcccccatcatcgtgttggattgcttcactaggaatatttccagcaggctgacccagagctagggttcagacaagtcttttcagtgtgtacttaataaaaccaaatttgtgcaaggtgagaccagtcatcaagagataaaaaataaaaccaacaagccttggcatgagtcctctctggtggtagtggaggtggatggtcacatattaagaaaacagtgaatggcctttaaaattagatggagtgaatgaagtattgaagaaaagttgggctgtttatagagcctttagaaaaaagtaaagggaaaaaataaacaataggagtccaagttgccagatcattggtatttctgtaatatgaatgatactctaaagctcgtatgtgcaacccactttagaacgtgagaaccaaacagagaagattggtttgtgtgtaggagcgtaatttagttaatagatatattttgtagctagttatgtttctatcactcaattaatatatgtctttatgttcggggaggtggttcttttctatttgtgagtgacctttatgattggcttcctgatatgctgacaggccaggctttctagtatacatgggtgggatgttttccctcggttctaacaccatccaatgcaagtagcaccatgagatttagaaaacatttttgttcctgaagatcgatagacagcattgaacattgattcaactagtgtagcaattactgtacaaataatatacagtgccttggtttctcttctcataagcatttcagtattatgaattcagaaatgtgcacacagcagtgaattgtatcaaaagctagctttctggttcaaatttttacaatgtataataattttagttggtaaaatcgtttagtaacattctttaatggattagatcaaatgtaaaaaccagcatggaatcaggttttgtagctgatttataaataactgctgaaaacctcagggcttaaaattgaatttggttttaacagggttgaattgtatctgacacttgtacgtaacaactcagagagatgtttattaaagcgggttaataaacccactgagacatatttgaccattatttagaggaggtgaaatgtgaatttacattaaaaatggaaaagataaaagatctcagaaatataacatttttgagtatgtctcattctacatatatgccagtcttcctttctcatctttttattaaagttgcatatctattttagtcactttacatatttatcaccatctcctcggtggcctcatgtcattatcagttgatcttgtcacactgagcatcatctccccatctgttcctattaatatttcctcctttaatttcttattacatgggattgaaatgatataaaaactcactccctttttcttttctatattgttttgctttctttcttttctctttcccttcactcaagccaaaaggctgattcacagtagtcacaaaacaaaccagtgctcagtgagcagccattctttttccatcacagtgctaggcctcagtggctaacgagaaaggatcaaataaagaaggaatgtgtgaatgtgcaattatggtctttgtctcatggtcctttcataagtatagcatgttcattttcaggacaaatttgctccaaaaatttgccttttacctttcacatctcaactccttcagcatgtttctctggtcctgagtccttgtcctctctccttttctttccaaagacttgcttcctttaagacatctctttcagttttattatttattctggtaagttttagtttgttttagatggcagcagtattgataactgcacataaaataggtagtaaatagtatttatatttactatatggtttatggatttaaggaattaatttgaaacagcagttttgcttgaaagaggatttctaaatgaaagggtatataacaaataaaagttttgttctgctactccatttttaaacaaataattgttttattgttgaaattccctcctttcatctttggccagatataacaagtgactgttacgttatttcctactttgtctttagtgtgcaatagttttcaattaaaaaaaaaaacagactattgttaggtctgctgctctttaatgaatcattggattggaaaataactcattataccatcaggcagagatactttcctttatttgcatgtagatagtgaaggtgaataatttatcaaatgttattagtgcaggctgcatattactggagtcgcagcaggatataatgaaatttgtctcatgcaagtatgaaaatagcatgcctttgcatagtcattattgaattcttggcatctcttgaagaactattatgttagcatgccagtcttgctcacctcttcattaactgggcttttgattggagagtttaacttatcttgaaaatctgtggaatccaacatgccaaatgcttgcttgactttagcatgtttccatatcagagcatacattttcagaacgaataaagtactaaatgtttcttattaaagtgagtagtgcaaagaggctatgactgatggtgttattacttttggttgtgaaaagttgtaccggagatatttaagcaataaagctttctgaaatgacaggcgatgaaacatgtatataactacttagaatcttagagctgtacgaattatgtatttgaagttattttaatgattgctttttaaaagttgcatttaatatgcttctgtcgtgatggcatgaggaggtcaacaaaccttctcaaaagcaatgctaaagctgcacaagcagtcaaaagcaaatcatgtcagtactctggaaatcaactaaaagcattcaacaaactgaaaagtgtttattcatgaaaaaactgaactttggataaaaacagtgtaagtctgtggtattaatgctggggctgctccattttccctcctctattcggtgagtaaggttgcaactagggcaaaacaggccatgaaagccagcagcttctttgctgctcccaagacagctcagtggatttggagaactgtcaggttcagtggagattttgatggcaagcagtagggaaggtctgcggctctactggactgaagttactgacatgtttggtgcaagcaatggacagacggactagccagggttttagcagggaattctgggagctgagctagcgctatgaggcttgtgaaactctccacataccttcagttaaccagaagttgtttcttctgcacatgcagcagaaactggaatgggctttgtaagaaatactgaaagtttgtcaggcagaaaagaagaggcactgaatgataacttggattccaaggagcagtgaaaaatgctagaaatggtatttatatgagtaaacatatttttcacattttcattattaaaaaacaacataggccaggtgcagtgactcatacttttaattctagtattttgggaggccaaggtgggagtatcacctaatcccaggagtttgagaccagcttgggcaacatggcaagacctcatctctataaaaaaaatttaaaaagtaactggacgtggtggcgcacacctatagtctcagctcctcaggaggctgagatggaaggattgcttgagcccaggaagtcgaggctgcagtgagccgtgattgtgccactgcactccggcctgggcgacagagtgagaccctgtctcatagaaaacaaaacggaaaaaaacatacaattacgtaaaaaacaataattatagcaccatatttttagctttacatgagtctccccttaaccatgagagatacattccaagatccccagtggatgcctgcaactatggagagtaccaaaccctgtatgtaccatgttttttcccatacatacatccatacctatgataagttttcattcataaactaggcacagtaagagattgacaacattagtgagaaaatagaataattattacaatacactgtaataaaagttatgtgaatgtggagtgtctctccctgtcacaaaataccttattatactgtactgtgggtaactgaatctgtggaaagcaaaaccacagataagtggtgctactgtatataactgtatatgttaatatgtgtgccaatagcacaaaagaggaagaaggaaaataaatagcatcaggacagttgaatattcatattaaaaaaagagcttaggccttcactgtacataaaaataaagtgaattctagacataaatataagaacagaaacaataaaacatgtggaagaaaacacaggagaaatctctgtgcccttaatatagctaaagagttcttagatgtgacaccaaaagcatgagccataaaagaaaaaactggataaattgaacttcattaaattgaaaaaacatttacttttcaaggcacaccattgtgaaagtgaaaatataagccacagactgagagaaaatatttataaatcatatatctgataaaggtcttataaccataatatgtaaataattcttacaactcagtaagacaaatactctaattaaaatactgggaaaatactggagtagacatttatattagttgggaccaatgggtgtatgtatggaaagagacgtagtgtaaggaattggcacatgcaaccatggaggctgagaagtcccaagatctgcgttcagcaagctggaaacctcagagagctgatgtgtatgtagttccagtctgagttcaaaggcctaagaaacaggagagccaatggtgttaagttacagtccacaggctggcacacttgagacccaagaagagccaatatttcagtgtgaatctgaaagccgaaatggacctatgttctggctcgtacagacagtcaggaggagctcacttttagcctttttttttaaattgagacttttatttaattggacgaggctcatccatactgggaaaacaatttgcttcacccagtgtaccaattcaaatgttatctcatctagaaacaccctcacagagacgttcagaataatatcaaaatatccgtgtaccttgtggcgcagtcaagttgacatataaaattaatcgtcataacattctactgaataagaaatacatttggctgataatcacatgagaaggtactcaacatcattcctcactatggaaatgagtattcaaaccacagtcatataccactacacacccattagaatggctgttatcataagaagccgtagtactaagtattggcaaggatatgaagaaactcaaaacctcatacattgctgatgggaacattaaatggtatgactgctttcgtaagcagttgtttcttaaaatgttaaacataaatttaccacatgatccaccagttctactcctaggaatatatccaagggaaataaaacatatgtccatacaaaaacttgtatgtgaatgttcacagaagcatttttatggtagctgttaattggaagcaattcaaatgtcaatcagctggtcaatggattgacaaaattccctatatttggtatgtgaatagagatagactctgataagctcaattttagaacacttacatcaccccccaaattcttattttggggtgatgttccattcagttgtttcattcagttttagaacattgacatcctgtgttctaaaattgagttattgtgatgattataaaactttttttctttgagacggagtctcgctgtgtcacccaggttgtagcgcagtggcgtgatcttggctcactgcaacctctgctgcccaggttcaagtgattctcttgtctcactctctcgagtagttgggtttacaggtgcacaccaccacacccagctaatttttgtatttttagtagagatgaggtttcaccatgctggttgggctggtctgcctgccttggcctcccaaagtgctgggattacaggtgtgagcaaccatgcctggccaaaactttataaatgtatttaaaatcattgactcttactctcatagtgtgtgaattttataggctatgggatatacctcagtaaagttataaaaacaataggtctaggctgtgtgcggtggctcatgcctgtaatcccagcactttgggaggctgagacaggaggactgcttgagcccaggagtttgaaatcagcctaggcaatatagtgagaccctgtctcttaaaaaacctaaccttaaaaaaaaaaaaaaaaaaaaagacaaaatgcaatatgtccatatagaaagaaaaaatgacaaagtaaatatggtaaaataataattgaatctgaagggtatgggatttttttgtattgtattcttccactttttctacaagtgtgaaattatatcaaaattaaaaaattacaaatgttttaatggctcttaatagtgatctgatttccttttgtgatagtgtgtaaaaataagtttaaaatgtttgtttgtttaaaaaaaatccagccctaaagtataattttatctcagctttttgtttatttacttgtttgatttgttgtttgctttgagcagatacttggttttgcttttttttaattactcattttttctgcaatgtaatggcaggcaggcctagtgcccaagcaaacccttcctgctgcacatgcatatttggcatatgctagagagtatttatacctgtagaaatgatattttgagggtattctgtttctcatctgtgcaaatataagcaaagcaagtaggccctgaatacagctgtttttcttgttttttttcatttctttttctttttttttttttttttttttgagatggagtctcactctgtcacctaggctggagtgcagtggtgccatctgggctcactgcaaactccgcctcccgggctcgagctattctcctgcctcagcctcctgagtagctgggattacaggcgcccgccaccacacccggcttatttttgtacttttaatagagatggagtttcaccatgttgatcaggctggtctcaaactcctgacctcaggtgatccacccaccttggcctcccaaagtgctgggattacaggtgtgagccactgcacctggccactgtttttccttttgacagtatttctgaagtttaaatgatcacacttcactcttctatgttgtttcccctgctcccgaaaagaagttaaatgaacacatttgttgaaagcgttaagttacagtgaagtgtgtaactcttgctaatgtatatttatgtgcttgatttgaaggtcactctgtgagactgctgggtcagaaaaaggataatggaaggcggcttgggggagcacgattggatttgccgaagattaggaagaatccactgatagaaatcatttccatcaataccgggtaagcatctctcaaacttgctcataaaatattcaatatatttcatgaattcagtttttttttcttggacatgtgacatagaaaagtagctgaacattttcttgggaaagaaaaattacaaaatgtgctcaaatacagtttcttctgaaatgtttcctgtatgtaaactacacttatatttgcagcaggcttttataactttaatattattcccatttttggtaataaacataataaacatggatttcatttcccagctatgcccttacttaaaatctttgaaaaaagtagcactttattttgttgaatgattaagacacttgtcatattcgactgtttttttcagtaaaggtatggtaaatgttgcccaagatactaaccacgttttgattattcactatttgaaatgcatattttaaaatgttattattctgagctttaaacttaaaagaagcatcatgacagaatattaagtactcttttaatttccacaccttgatttaaagtccttgattataactcttggtatactcatttatactttgtttcatatgcatttattgaatttttgcattctttaaattatgagtccatcagaaaaagaaacattttctgaaaatttgatgagatgaagggcttctgtttcttaaatcacagggagcacctaattacccgtacaaccacatctcattccccacagatttaagctgttctgccccttttacttcatcctccttcccttttatttgaaattgttttccttctgttctgctctttcttcatgctccttctcattgagaaccggtgaacagcttccttgtccaccatctgcctgtttctctgaatccaatggctttacttcctccaggacagtggcggttgtgttgtcagtagccctcttttctgtagtctcaccactttctggtttatcctccacactgctgtcaaagactagagaaggttgaccaaagtcattcggtttttcccaaaaaaccccatggagtggcattcagtgacttggtgaatttgttgtagaccagcatctggccttcagcgttgaagattcagaaacccaaacttatcaagctcagaaactagtaattaaagcagaatttaacagtgagaagtacagttgtcgcttgactggagtacctcacatattcattctgtctgtctagcctgagccgaattataaatgcaaggctgtttgctttccccttcctcagttcttttttccccttcattcaaacattataatactttcccgcaactcctgattatcctatttaaaattgcaaactttctaacattccttctctttttctcagttgccttgttttcctctgtaactttaattggcattgaaatatataaatgatcatttatttgtattttaatggtctctcctcactggcatatatgctccatgggggcagggcctttttgattgtgttatttaccactctatccccagtgagtagaaaattatacacagtagggatttaatgcatatttatttattgactgaatgaatgaataagttttaaaatttgacagtttagtgggactatgctaaattatcatcatggtacagattgccttgcaaattggacaataatatttggagtttgctggctaatcacactttctcctgaaaaatgcagatttttttttcttttttttgagatggagtctccctctgtcacctaggctggagtgcaatggcgtgatcttggctcactgcaacctctgcctccgggttcaagtgattctcctgtctcagcctcccgagtaactgggattacaggtgcacgccaccatgcccggttaattttttctaatttagtagagatggagtttcactgtgttgcccctgctagtctcaaactcctgaactcaggcaatccacttgccttggccttcaaaaatgttgggattacaggcatgagccactgcacccagctgaaaaatgccggttttgtgtgtgtgtttatgcggggcttttggctagacacatgcctttaaaacattagtatttcagggtctgtcaaactctgttagattaggatccattaggtctctgcatggtaactttccaggtacgtatttggcctactgagtgtctgtttttaactgtttatttttctagtccctatgttcttcttcattttgtcactccctacttcacaccccagtattcagtcttcctgaactacttgaaattctcaaaactccagattcttctctgtcttgactgcaggcctccctgtaggttgaagggttttcctggcatgtctgtccttccccgttcacctcatgggtgagcctcctgcactcaactatgtgctcatttcttgggatgtctgcttgtttctccctcccaaccaggctaaatctatccctcactctaatttgtgtccacaacattccctatgtatcctgattatggcactttacacactatgtcatttgtatcttccactacaatgtaagctccttgggggctgaatgtgtttcagttgtcattacattattatctttgagttcagtgtttagtacaaagtgagtacaattgtccctcggtatctgtaggggattagttccaggacctcctcagatacaacatctatgcatactcaagtacctcatataaaatggtgtagtattggccgggcgtggtggctcatgcctgtaatcccagcactttgggaggccaaggtggatggatcatgagggcaggagattgagaccatcctggccaacaaggtgaaaccccgactctactaaaaatacaaaaattagctgggcgtggcggcgcgtgcctgtaatcctagctactcgggaagctgaggcaggggaatcacttgaacctgggtggcagaggttgcagtgagctgagatcgtgccactaaactccagcctggagatagagctagactccgtcttaaaaaaaaaaaaaaagtgtagtatttgcatataacccacttactttttcccatatactttaaatcatctctagattactaataatacctgatacaatagaaatgctgcctaaatagttgttatactgtattttaaaaatttggcttcttttaattattgcattatttttaagtgttttttttcttccagatattttatttctttttttttttttttttttttttttttttgagacagagtctcactctgtcacccaggctggagtgcagtggcaccatctcggctcactgcaacctccgccctcctgggttcaagtgattcttctgcctcagcctcccgagtagctgggactataggcgtgtgccaccacacccagctagcttttgtatttttagtaaagacggggtttcaccatattggccaggctggtctcgaactcctgaccttgtgatccacgcacctcggtctcccaaagtgctgggattataggcatgagccactgcacctggccccagatattttcaatccatgattggttcaatctgtagatatggcacacacatggatacagagggctgcctgcactcaataaatatttgttgagtaaatgttttataagttatgagttcttgttgctgtacattaattaaaaattaatcttaaaaatatttaaaatttttttaatgtttacaattttaaattttaaaaatttgctttaggtaaccattttcaatagcctttaggtaaaattttttatgtatattatttgaattttccctcttgtagacttaatgttttcttcaaatgggcctgctctttaaaagattgaaagctcactggatttggcatcactctcatcctcttgtatccttcacattagagtagagtgttgatcctcggtacattagcaaataatgcttttgatattaagaaaatttaatccatattgtcccagaatgagaaatgggtttctaattttctcagactgctaatcatcttcctgaatcagttgcagccttatcacttgctctcacatgaaagcattcccatacgtatttgtccacactatcattctataacatattagcttggatttctttttctttttttttttttttttttgagatggagtcttgctctgtcgcccaggctggagtgcagtggcacgatcttggctcactgcaacctccgcctcctgggttcaattgattcttctgcctcagcctcctgagtagctgggacttcaggcacacgccaccacacccggctaatttttgttttagtagagatggggtttcactatattggccaggctggtctcgaactcctgactttgtgatccacccacctcagcctcccaaattgctgggattacaggtgtgagccactatgcccagccagatttcatttttttcatgctggtggagctcattgctttttttcacttacttttaaatgttttaatatgattatactcataattatttttcagtagaaaatgagccttctcagtaaaatcctcacacttttcaaaattttattgcttccacattaaatatgtagatttcactttccataaatttttcatttttcgtttaggaaaagggtcccatttgtagcaacttttattgtatgtattagtaaattactgaagttactattagaaccattagactttgcaaagttgttatgccttgttatatttctagcttaaaatataaaagtatggctaggtgcagtggatcatgcctgtaatcccagcactttgggaggccaaggcaggtggatcacctgaggtcagtagtttgaaaccagcctggccaacatgctgaaaccctgcctctactaaaaatacaaaaattagctggatgtggtggttggtgcgtgcctgtaatcccagctactcgggaggctgaggcaggagaattgcttgaacccagggagtggatgttgcagtgagctgagatcacaccactgcactccagcctgggtgacagagtgagatttcatctctaaataaataaaataaaacaaaacataaaagtacatcagttgctttagccaaggaagaagttgaaaatttcagattgtataaattttggatgggcacagcaggatacggtgtgtgtggatatttatgtagaattttttaaaaagtcaaccaaatgttatggtcagtatcatagggagtcaacatgtgcatgaatggaagaaataagctaaggttgataagctgttttcgtcaggtctcccatttgtgtgactcccttattttttcttatctttttttttttttttttttttgagatggagtctcgctctgtcacccaggctggagtgcagtggcacaatctcagctcactgcaagctccgcctcccgggttcaagcgattctcctgcctcagcctcctgagtagctgggacttcaggcgcccgccaccatgcctggctaattttttgtatttttagtggagacgaggtttcaccgtattaaccaggatggtctcgatctcctgacctcatgatctgcctgcctcggcctcccagtgtgctggaattacaggtgagccaccgctcccggccttgactcccttattttttctagcagtgggaatacggtgtggagacgggtaggaggtagtgtaggggacaaaagtaaaaaattggaaattgtggcataaaggacatctgtgctttattttaccttctctgaccctatgaaagtcatcctttttgacagttctttggcaatttttatcttccaaagccaagagttagatgctgcttaacagttcttatataaattatatcatttttaagatactcctatcagattatccttagcttgaaggtttgaaatcctccctcaggcaaaacacatcttagaaattactgtctgaccctgtgatattttactgatactttatcttttaaaatttatcttgtctttcttgttatttgccatcagacagacatatggtggtaactgagaacctttaaggggaatataattttctttgagcttatattcttgaatttattatcattttaaaaagcatttttttccccctgtaacactctggctttgcgaaaactaactcatatttttacactttatgtctgtaatgtacaaaatttatcagttcctattccatttctggatacgtaggctatctacaaatatttgaatggatatttcaaactcattatttcattataacctgacaactcagctgtcagattataatgaaagcaagtcctagtccacagtctccaaccagaatttagtaagcaagctggcacggtccagctgttcttgtaacgttggtggagtcctcgttgtctctctttttgggtggtgaaatcaaactttgtatgaaaggttcacttgagccacatgaagcaacatactgtctcactgtagataatacatcctcaggcaaccagaattccttacctagtgtctggagtgagagtgtgtcagggaccaagccagaatcatatctttaatggtctaggccagtactaaccaaactgtgttctgtggaccagttaactatagattgttggtctgtgatgagtacacaaatagagacttttaaggcagtttaacgtcactacagtgagttataattcattttcactgtattttacacagatactggtttataagaggttggaagtaaaaatcctgctctgtcactatatatagtttgagaaacactgatttaggctagtgtgtgttgtaagattctttattctgttttggaaaatattttacccaatctacttatcttgagtgtcccttctttaactgagaccctatttcgactgtcttttatgctattaactacttgtaattagtagttgaccagtactttcaaaaatggaaacttattatttacatgctaattagcaaagcttctagtattgactaaagataaaagatagcttaaacatacagagcaatctcctctggaaggtggcctttctgattaaatactagctaagagtgtgactgtgcctaacagttgtagcttacatcaagtcacacaatttatatgatgttcactacattatattctttcaaaagtaaatgtatagttttcctaacatggctctcatgaaacttaaaatctaggtattataactgctatatttgcacaccgtaaggtgagtacagagctgtggttattattcatgttcttctgtaagctttatgggtggcaggaaccttaatctttgtcatgagccgagaatgtgacaccagcctattctggagaaggtagtagaatctataatacattggaaagagctctgcacttggagtttgtagtcatagacactttattttctagctgcatgacttgagtaaattaggtgagatcttagagatgatgtcttttctggcatgggtatagtgctacctactgaatgtatagcttagcacattaatacatattttctttcaaatcttgatgctgctgtatcttctactctaccgtcattctctgagaccccttctacccttgatttctttttattctttctattatttaggtaagaaatttgctgggactagaatgtgaggttacgactttatgctgttcaatgttggttcttcaatttcctatttcacctgttcagttttaagtgaatgtttgacaaacaaaaaaaattcatcttagtctctcctgtagctttcagcgcagtgtctttctcacagtattcactccataaatgtttgttaagtatttcacttgacagcagtgtttcttaaatgcagaaaaaattttctggctaacctggaatatagttcgaattgcttctcttactatagatgattgttttgtagaaaagagaatatgatagtttggactatgaatgaagtgaaagttatatgaaacaattaaatgtgtgaaattgaggcatttatggcaattgtgaactgcgtttttactcttttgtccacaaaccagttgtcctaaaatttgcagccttttttatgtcttcaacggaatcccaaaatatcttattttcactaaaatattatacaaatgaaattttaaagtaatatttatttctagtgcattataagactgtacttgggaaagatcattcataggaacagtggatggcactataggctcatacctgcgaagtaattatccttaagttgcagagctttcaaatgctggcttagtgaatgcttttaaagagagcagctcagtcaaaaagcttggacagtattaggagttaatgttatattttgtaaactttttaatcattatttgaaataaactttgaaatgaatatgtatataattttcttagttactagcatagagaaattactgatttaaaaaaacatttcaaattctagcatgttgtaggattctattgccctttctaaaaagtacatcttgcttatccgatttctaacaaaactatttaatttgaagaagggagaatgaatttggataaaaagcaaaaatttaaaggtactcaaatttaggcaaaccattaaagcaatcttagtttacagttaattgggtagaatggtcaacactttcttcaggttagttcatggagtggatatgcattgatagaacaacttagagatgcttttacagttgagaaagctcattatatttgttatctttaagaatcagcttatttatttcatatgtttgttctttaagaagaccaaagagccctgcaaatgaatgttgatttgtttttttgtttgtttaatttttttgtagagataagatctcactttgttatgttgcccaggttggtcctgaactcctggcttcaagcaatcctcctgccttggcctcccaaagctctgggattacaggtgtgagccaccacacctagccgggacatcaatttgttaaacaaatgtagttgaacataaaaagatgagttcatgtggtatttgcccttgagaatcccatagaaaagcacaaaacaataaagttataagcaacaagcacaaaacaataaagttataagctcacattgtatgacggattgtttagatgagttggagagtgcttccatggaaagtaatatttaggctgtgtcttaaaatatcttataggtggatttaaaggcaatttaagcactggtggggtggggggaaccaaaacaaaacccataagcagtggttattgcattgtgaaaaaccatgtcttacacagagaatgatgagtcactgtggtggtgttttgaataagggaatggtcggagaaaggtagcttgagaatgcttgggctccgaacttggtgacgctggatttttcgtggccactttgccaaccagagacctccacagccagtgatgccccctgatccaggcctcactcagccctgggcctaccactggaggcgccctgcccactcggtccacctgtgctatagcattcggtggttcccaagctcttgtcccacatccaagaagcatgagcttacactgacaattagaagggtgaggatgggcagagaagaattttcttgagtgatggaacagctctcagtggacaggggatgcagggggtggtccccccacccctgtagttgggtggtttctctctctctgtgtgtctgggtctggggctttttagggtctcagaatggggagtgcatgctgattggtttgtgagtacacaaaaaaggttaaaatgaaggcaccattcaaaggtaggcacgacagtgtagaaaaccaataaggaaagggtaggttaaagtaaaattggtggaggaggggggatcaatcagagggaagtgtgccaaatgagaagacaggttctcaatccggtccgtggatttgacttgtagcttggctttcaggctttaaactgtctttggtttgaaagtggggtttcactggggacccgacaccctctgcctaggcatttgtctgcctcctgctgctatcattggcataagttattcaacctctctataggtttcagtttcctcatttataaagtgatgatgataataatagtgttgtgagaatgaaaagaggtcacaggtttaatcagcacaatgcctggcacatagtatctgttcaatatatagtattattaactttattactatgatagctatgagaaggcaaacctcaggcttacgtagactgctatttgcttaaggccacagagctagtaagtggcagaattgtgactcgaaccacatcatctgaccagtttttttcaataaaccataacgtcagtggcctctagcctcattttctgcttctgggtctgtactgtagttgtttagttaattgaaaggaaagccacttagagctaaagtttgagactcatctggaagatagcctattaaatctgagaaacatgccgtacgcagcagagttttacagagagaatggggaatatggggctaatgtagtgagtctgtcaagtggaggtaggctgggagaatttctgctgtgtatctatgttgtattgtcagatgactcctaagatgcatccattttgtccaatggaatggaatttgaaattcctattatggttattttaaaggagggactgctaaatcatatagagatgtatgaccattgtgccttcctttcttgcctttttttttcccacttctactggagctaaggtgcatgaaagtgagttgcacttggaagggcacagtaggagcagatcattggatgtatccaaagagccaccatctgtcagctttcctgttgctttaagaaaacttgttttccagccctatcaagagagagaaaaaaaaaaaccctgaaacttgtgtagcccaactttaattaagtataattgaacacacatgtgattgtggacgagggcctgtcagttttttccaatacaagaataatatatatcccatatttatttttgaaaccactttgcttttatttgactgcatctcagcatggtagcaccagttgttttatttttttctaaccctgacaaagcagaatgttttgtttggctttttaaaaaggcaatagtgcatgtagttaagacctcatttactttatctgatgaaacagtctctgaggagtgtctattttttggtaaatccactaagaaaactgggtttaaaacgaggtcatttttaaaaatactggtttcagtttttaaacaatgtatgtacctttgtgatttgtaatgtatatttttgtggttctttttaggttaaccttaaagtaagtattaattgtgagatcatataggtttacaaagttctttctcccttgtgaaatatattttatgtactgttctgttactgctcttgcggaaaacataaactttctgaaatggaatttttagtccgttctcctcccccactttctcctgtctctgttatttttttctatataagtttatgagaacaagatatgcaagtatggatttatttatttaggaccaggagccccttgtaactggaagatatcctctatcaagattggtggtctgttttattcattggtttgttttattctctactcattcactcatttactcaacagaaatttgcagaacatctctatgtatctgaaaatgtactaagtgcaataaaagaaacaagacctagtaatgtatcactgctcttgggagccttacagtctagtgtagtttagttaactgggaaataattttgttttagtctacatggaatataatagtagttttatatgtgtaggacttagagttgtgtacctagaagtttaccacaaatatggggaatgtatcagacttgtttcaaatgtgatagctgaaaataggctcatacaataatggtgtacaacatgtatgtcatgtgaaccagcagcacgttctttggtaatttgccactattgagaattctgtcactagcatcacatattgttctcactctggaattcagtcaacccgggatcctttgagtgtagatttctgtgcttactcctaaaattaacgcccctaatttcacttccaaaaaagattgcaattgttaaagcccctttctgtctacttcaactttctcattcttatttctactattggtcttatttttaaaattttcctaccttaattctcaattatatgcaaaggaagaggcaaagcaacaaaaataatgacaaggtgtcagtagcggcgttgatgttgacacattgcacgcatcttggaaaaagagatgtcaaatgcccatgaggatggagtatggttgagattctgctactgctgaaggcaaattttcctgttgtttccatgatgcctaataatggcaacgtgatggttggcataatgagagtcttctgtataagtgagttgacttgcacttaaatattttgcagttatttgtcagttatttatcaaatgattgtttatcaaataatttatcaaataattaattttcttaattttattggagatttgtcatccaaatgttacatttggaatataactaacatactttaatactccattaagtttcaatttgtatggtagatattcaaggatgagtgatggaagaaagaataatatagacatttcagggattgtttttttttaattttaaatttaattctttcagatatatattatatatatatatatcctaattaggttatatataatatatatatacatatataaatatatcctaattcaaaatctaactgtgactgagactcatgcatagaatattttctgatgtactttacaaatgcttatttgaacagcatcagtatggcttgcctaatttcttagtttcttttgtttatcccaatactgctttgcttatacatatatatcttaaaggtttctaaacttagagacctgtagatcctagacggctttaattgactgatcttttaatgtctgtattttctgttcccttatcttgtagttttttaaaatccttctttaaattattgttttgttctcttatttttccattttctgtatctgctttttcttttgagcccacacttttgacttttatgtaagaatcatgttttattaaaagcctctttttttggtatagtaggtgagaaagaagtagttgaatttaaatatatctactgtaaatatatggatttgtcttttgtaacactgccttgccaagtgtttggatagatagtagagtagcatgacagttcacacagtgagcaacagtttgatttaagctatttgtttatgtgctacactgcttaaaatctcttaccagctaatgagaatgatctgaagactttttttgtaagagatgggaaaaaacccttttaattaggggtagactttgtaaaatacttaataagtttctttattatttgtagccccatggccaaatacctactacccacacactttcttaatacaaaactattcatagttaattaaaaatctttttggcagattcacatattcatagactgttagagctagaaaggattttagagatttaaaatcttttcatagatgataaaactgaggccccaaggactaatgtccgaaagtttggtggcccacagattgtactcacttttaggagaataaggttcatgacaaacagaggttactctcacaggtgatacaccttcatctttaggattttaggggtcagtgaaaggattagaaagcagattagattttgtttgtggtctgcaagacatcataaaatgatatttgatgttagtttgtattgaaatatatgtaggtcaaaataccagaaactggtatcactgtgaccaatactgtttggtggatcagaggaaaacagtgagattatctgtcaagtgaatttgattacatgggataaaggcactattgagacttctgttttggtgtgagagcacctttggaaaaattctggacttcatatcaccttgttttccttttctattcactcattatttacctttcccatccacacttctggttctgccatttaccttcctttaattcctataggtttatatgtttgtatttctagtacctaatagttactagctcatagaagctctcaataaaaatgtttttacgactcagtttctaaatgctaatggtatgttttcattctaaagtctcttttgctgtttcttgagtcttgaatctctattccagcctttctcagttcatgttttctgagagaattaagcctaaacatatgtgattgaatgtcctaaggcattcattatttagtgaattaaccttctcccaagcatctagaatgatattagctgcatactatccttgagagaattaaaaagtagtcactcagattattttctgcagtgcataattctcttggaatagtggttgagaaaggctgatttattcactttatcagatattccaaataaccatcttaaagcttacttttctaagaaatgccatcattgattgacttcattttaattgttcttttacttcacattttcttagtacatagacttaatttttactaacggctgttgccaagatggtgatatgctgaatgggttatagtaaatttggtttattctttaaaaagaaacataaacaaaaagtatataatagatttctcatgttgctattttttctcttgaaaagcatatactacctgagtgtcaaactggccagtgcttgggtgaacttctatgtaaggcttgttaggtctgtgatgacacaaattccaagggcaaaggaaagagattggaactagtagatgcaacatgtttaaagctgacttggccagtataagtgatccttgagaatcagccctctatttaggcatggcatctaaggcttgtaactgcctgggttcttatttccaaaggagtcaatgttagatataccagggcccagatttatgaaaatacagaaagaaaactgtgcctattcacagatgatatgactgtctacatagaaaatctcaaggagtccataataaaacttctggaactcataagtgaatatagcaaggatacaacataaacccataaaaataaaacatctttctgtataccagcaatgtgtaattggaaaaggaaatacagaaattatttatgttatgcaatagctctaagaaaaatgcttagataaaaatctgacaaattatgtataggatatgtatatggaaatttacaaaacagaagaaatcaaagaagatctaaataaatcatgcaatgttcaggaattggaagattcagtatagtaaatgacaattctcaagttgatgtatagatttaaagtaatttgaatacaaattccagtaagatttttcttgtagaagtggagaaatggatgctaaattttatatggaaaggcaagggaagtagagttatctaaaacagttttgaataagaataaggttggaggaatcacaccatcctagtttaagacttactgtaaagtagcagcaatcaagaggtgtggtagtggtgaagggatagacacattaaatcactggaaggagactaacaagtccaggaaggtcagacccatgcaaatatgggcagttgattttgacaaaggcgcaaagttcatccaagggagaaagcagtgttttcatcaaattgtactggagcagttgggtatccatatggaaaaagaacaaaactttgacccaaatgttaaatgtatatgaaagttaacccaaaagggatccaagttcaaaatgtaaaatgtaaaaccttttttcttattcaattcatgaaaataaaaaataagaggtaaaactttaaaaattgtagaataaaacataggagaaggtttctatatttatggttaggcaaagagttcttagacctgatacccaaaagtatgatctataaaaggataaaagatggacttaatcaaaattaacaacttttgctctgtgaatgaaactattaagataataagaagcaatctgcaggctgggagaacatatttgcagatcacatacacagcataggacttgtatccagaatatataaggaactttcaaaactcactaggaaaacaaccagattaaaatacgggtaaaagacttgaacagagacatcacaaaaggggatatgcaaatggaaactaagcacatgtaaagtttttcgacatcattaacatcagggatcctataactcacctattcgaccaagtaaaatgaaaaatattgatagtaccaggtactggagaggatgtagagcaattagagctctcatacattgttgttggagatgctaaatggtacagccatttggagaatgaattagcagtttctctaaaaagttaaacatgtacttatcatatgacgaacgtcctacttttaggtatgagaaatgaaaacgtaagttcacccaaaaatctgtgtatgaatgtttatggcagcttccttcctaattagcccaaactgaaaacaactcctgtatcctttagggaatgaatggaaaaatcatctgtgttgcgttcacttaattgaataccaccaaacaaaaaaaggaatgaatgattgacatccccaacatcttggatggatgtaaaaagcttatgccaagtgaaataagccaatcactaaaaggctgtatgtatgattgattgctttattttattttattttattttattttattttattttattttattttattttattttattttattttttcttggagacagggtctagctctatcgcccaggctggagtatagtggcgcaaccacggttcgctgcgttctctgtcttctggggtcaagcaatcttcccacctcagcccccggagtagctgggactacaggcatgtgctaccatgcctggctatttttgtattttttgtagagatggggtttcaccgtgttgcccaggctggtcttgaactcctgggctcaagtgatcttcccacctcggcctcccaaagtgctgggattacaggtttgtaagccacctcacctgccctatattatttatttatatgacattttcaaaaagaaaaaactatggtgatggagaagagatcaaggatttttaggggttagagattgggaggtgaggagggcagagagtgtttgggtaagggtatagcacaagggaatgttctagggtaaaagaactcttctgtagtcttttgatgatggttgcacataccaatacataggctaaattcatagaactgtacaccttccagaaaatgaaatttatgtcagttttaaaaaaattattctgtgaagaaaataatatttattaagaaatatttaggtagagaaccagggtagattgaaaattgtgttaaaagcatgcacacgtatgtttattgcagcactattcagaatagcaaagacttggaaccaacccaaatgtccatcaatgatagactggtttaagaaaatgtggcacatatacaccatggaatactatgcagccataaaaaatgatgagttcacatcctttgtagggacatggatgaagctggaaaccatcattctgagcaaactatcacaaggacagaaaaccaaacaccgcatgttctcactcgtaggtgggaattgaacaataagaagacttggacacaggatggggaacatcacacaacggggcctgtaatgggatggggggaggggggagggatagcattaggagatatatctaacgtaaatgacgagttaatgggtgcagcacaccaacatggcacatgtatacatatgtaacaaacctacacgttgtgcacgtgtaccctagaacttaaagtataataatacaaaaaaaaaaaaaaaaagaaaagaaaattgtgttaaaaggtttgcatctcatttaaattggaacaaagtcatctggactgagaggaaaatgggcctgggcccatatatttgaaaagaactgagtttttttttttttttttttttttttttttgagacggagttttgctcttgttgctcaggctggagtgcaatggcatgatcttggctcactgcaacctctggctcccgggttctagcaattctgctgcctcagcctcccaagtagctgggattacaggcacgcaccaccgcacctggctaattttgtatttttagtagagacggggtttctccatgttggtcaggttggtctcgaactcccaacctcaggtgttccacccaccttggcctcccaaagtgttgggattacaggcgtgagccaccgtgcccggcctagaactgagcttttgaactgttgctaagggtaaattaggtatcactgaacttaccctcagtaatgaatggaatatgtcacctgtgggtaatatgcgacgattaataagacagttaccacacctactgtataccactaaaataataaataagaatttttaaaaagacagttatatagcaggattatgtcgtgatttgacttattatataaaaaatttaacgtatgattttccattagaggaaatactcttttgttttggcaattcctgccagtctccatttgttgatcagaagacatctttcagtagtattgtattgctactggaggtaggattgggccaaggtggaatctggttagaacaaaaatgccacagaagaaaatcatttggcttaccagtaagctgatgtgtgcatcctccccttaccttcgtgcacatgtgtacaccagacttgcaatttgtcttgatgctttgagtagagaaagaaataattattgctttggaacttgtgcctataaaaactgtacaaatctaaaagtacttggtcacttgtactcatgatgatttgtttaaatttacccttttgcatgttagtagatactgcgaaatcttaatcaggcccttatatttaccattgaatcatcttagccatatatttggaagaattgcaaatcccccctttgcagggctgcctatgaaaatctatacaatggaaaagcaacagcatggattccctacaatatctcagagcacccagccctgctggaactgctggaccagcatatacatgctcagcagcctttttcttttcttttcttttaaagcagattctcatagcagctttatttgcaatagccaaaaatgggaaacaacccacagtgtgagatagggttacaatagaatattccccagcaacataaagaaactaactctgggtacatgcaaaagcatggatgaaactcaattatgcagagtaaaagaacccagacaaatttatgacacactacattattccaactaaactgtagaaaatgcaaacaaatctctagttccagaaagcaaataagtgaatccctgaggcaaattggtctgggagtggggaagggaggaattgcaaaggtacacaaagaagctttgtagggtgacatatatgcccattgtctcttatgatgatgttttcatatatatgtatgaaacacttctaaactctcatgcccagcttttaaaattcttttgatacttactaggaattttaaactaatttgacatccttcttttttgagggtggtgggggatagagtcctgctccgttgcccatgctggagtgcagtgacgtgatcatggctcatggcagcctcgacctcccatgctcaaataatcctcccacctcagcctcttgagtagctgaaacaacaggcgtgtgtcaccttgcctggctgatattttatagagatgggtcttgctatgttgcccagcttggtcttgaactcctgggctcaagagatcctcctgccttggcctccaaaagtgctgggattataggcatgagccaccacacccaaccaactctttctttcttttttggggtaaacaggtcttgccctgtcatccaggctggagcatgatggtgctttcaaggctcactgcaggcttaacctgccaggctcaagcagtcctcctatctgagcctaccaagtagctgggactatgggcatatgccatcacacctggctaattatttttatttttatttttgtcaagacagggccttattatgttgcccaggctggtctcagactcccgaactcaagtgatcctcctaccttggcctctcaaagtgctgggattacaggcatgagccgccattcctggccccttattctttcatcttgggtttttccctgaagaaattttctatcctcatctaccaccttaggcttgctaacgaggctctgcagatgaaaccatagcaggcttttacattttttcccaaaattttattatgaaaaatttcaaatggacagcaaagtcgaaaaaattttacagtgcacacctgtctacccaccatgaagattgttattaacattttaccatctttattatgtcatatctttcttcatccatttctattcatccatcagtccaacttatttttttaacatgtttcaaatgaaattgcagacatcagaacacttcctctaaatactacatcagacgtgacattatagacatcagtatttgtaggattttatgtaaaattttgaaaccatggaatatatacatcttaagagcaagcacatggctgagtttcgacaaatgcgtatgcctgtgtaactcccatctctattttttaaaaaacctgtgaccagatagtatttacataatttcgcaatggaaatatagtaatccccctgatttataaggatgtgttggtaaatagtctgcattttctgtgttgagatcaaagctgtaatcccctccctgtctttgtccctatagtgatggaaataatagattattttagcccaatgtgtaacatccttcttaaatgtattaagaattttaagtgtgctattatgcaacaacttgataaaatattttcttaaaatatgtgtttttaaccacatgcaatatttgctgttaacctttaaaaaatatgaatgacggccgggtgcagtggtggcaaacgcctgtaatcccagcactttgggaggccgaggtgggcggatcacaaggttaagagattgagaccatcctggccaacatggtgaaaccccgtctctactaaaaatacaaaaattagctgggtatgttggtgcacgcctgtagtcccagctactcgggaggctgaggcaggagaatcatgtgaacccaggaggcggaggttccagtgagccgagattgcgccgctgcactccagcctggcaacaaagcaagactccgtctcaaaaaacaacaacaacaacaataataataataataataataataataatgtgaatgagttatttttctttagcaaatcattttcttcatattactttctaaaatactgaaagtatatgcatgtcctcaccctatagtctcaaaaagaaagaaaaacatcattcctactacagtactctcaacctttgtatctattgtttgattaggcaaatatatatattttggagatatatatgtgaaatatatacatacacatatacatgcattcttatatgtatacacacacatatataagaacatatatatgttcttcaacataagcattctttccagttggatgattgcaaaggggtaccacaaaacaggccttacagtgatttaaaaatgctttgagtcacaggcatttacaggtagttcagtagaaaattttgatgttcgtttcaaaaatgcaaagcatttctcagagcacagaaagatgattgtgaagaaatctgaccctgaaggccagtgagtgggtggggcttagacatcttaaatgtcttagattactctgtgtctgcagaaaacttttttaattggattgcaggaaggagaagagtactgctgaaattaccaggaaagaacatgcatttttaaaatgcagaagagacatcctaacatgttatcttgacagatgtcaggattatttggggacagtaatgggcttgacctacaaggaactgacagaatgtctgaacttaatctggaattatattaaataacctgaagccacgtttgttgccatctctcaagtgtataggattgaaattgtgaaaacttttttacttaatatttgcttatatgtgggtatacatttgtgatagggttccagagagtttgcaaacaaggtagaggaacagtgttattaggaagattaccaactccttagggtggtataagagtcccatggcttcttccagccttttctctcctttccctgttacaactaatactcatcaatgccagcctgcctgtctcaacataccattctgtaacatgtgttaatgcccttgtgtatgccattacttctgctaggcctgcttagccaactatagtcatctttcaaaactttgtcaaatatcgccttttccatgtcaagtgtcaccatccttctcaaggaagagttgttaatcacgtttgtacaatttttatcataatatattctcagaagatgcagagaggagaataattgagaactaaaaataagccattggcggtgatagtaaagtgttcatggtaacctgacagcaattccaggagagttgtttaggttaaatgcagattgacgtaggtggaagagtgggcaggagatgaggcatagggacaagatagtatcttttaagaagtttgttgccagtgggaagagtagagatggggctctagttggggagaatcaggggagctgatgttattcttgtggttttaggaatggcagaaatagaaaataattttatatttaaaagaaatagctactgggaaaagagagagaccaaataagaagtgagactatttggtagagtaagtttccggagcatatgggatcgagaatgtaggtggaagtgcttaggataatataacacttctaccttcaaggcaggaagatgtgttgacaagggtggatgaattttcattatttttggtcctgtttagggaaaaagaaaatgaaatgtgatatttatatcattggtcaacaattttccaatattatatatttaattattttctcttctactgacatttatggtattctgttaaatctttgaatataactacactataacattttacaatgactatctaccaatttgaaaaataacttgaatggtttaagaattactattaagtcattcagtaaaaatgacttaattgagtgcatactattgtgccagctatgatggtaggtgtacggatacaatgatgaaatacagaaacagttgtgaattagttgtaaaaattcagaaaagaaacaatggtagtatgaactcagagagagaaaatagaatgagagaggcaagaataactgggactaagaatacaggtgatcggttagttcaaggattaacaaactacagcctgtgggccagagctagtcagttgcttttgttagaacagcttgtgatctaaaaatagtttttacattttttaaacagctggggaaaataaaaagaaacataataatttgtgatacatgaagattacatgaaatttaagtttcaatatccattactatttatggatatttttaattttatcaggaaacagccacattcactcattttaaaattgtttttgactggtttcatgctgcagtggcagaattgagcagctgcagcagacagtatctatgatgttgtacaggaaagagtcaatagagcaggtctgggctgccatctttagaaggatctgcttggtactggggccatgggggtgaggttaaccattgagtagtatctgggagcctgactcctagaattttccctaagctgataaaagcatttttcctgcctggagtacaaacgcctgctttccttctgctagtctactgttttgatagttgtgactagtcatcataactctgtgaccagcccagaataaaagtcctgttgtttgagcccaggtgtttgaggttgcagtgagctttacttgtgccacttcactccagcctgggtgagagagtgagaccctgcctctaaaaaacaaagaaagaaaaattaaaacctgggattctgagtctctaatgacctgctctaggtagaaagatcatgtatgtgtgttactgcatttcactgctggatggactgtgttctgtatggcttctcctgagaggtaaagcacaggaagcctgtgcacagattcctccagattttacctgatgtgtctttttctgttactaattgctgtactaaactatagccatgagtgcaactgtctcctgagtctgtgagttcttctaatgagtcaccgaatatgtgtgttagtatctagagacccctgaaactggagctttcattgtttgcaatgctggtcagcacactataaattgcagttacaactaactccacagtgttttcagtggatgtatatcactgtttttattttactttattttttattagcagggcatacccatcatgccaaaataaaagcatagtttgaatatctcacttttaaggcacagtggagtgaggattactttgttatcaaattagatggcaaagcgttgtgtttattatgtggtaactatagctgtggtaaaaataatacaatatgctttaacattagcagactaagcattcatcacaatattcccaattcacaggagggcaacagtcagaaaaattaagacaacttaaaatggaaaatctattctcagcagaaattttttgtaagtataaaaaaacgaaaatgagactataaccactgtaagtttctgattggcacatttgttacccaagcaaggagatccatttatcagtagtgattttattaaatcatgtttgattgcagccgctgaagaagtatgtgcactgaaaataaacttaagactatttaatggcgagagcagttgctcaaagagttgaggatatggggagatacagcaatatttaatttaaaaaacaaggcatatgatttcaaatgttttttggggtcttattcttttttaattttcaacttttaggttcagcaatgtgtgtaatatgtacaggtctttatgtaggtaaattatatgtcacaggggtttgctgtacaggtaataagtgtagtacctgttaggtagtttttggatcctcacacttcgcacatcctctaccctcaagtagcccccagtgtctgttgtttctttctttgtatccatatgtactcaatgtttagctccctcttattagtgagaacctgtggtatttggttttctgtttctgcgttagttcgcttaggataatgtcctgcaactccatccatgttgctgcaaaggacatacatgaacttattctttttatggctttgtagtattccacataccacattttctttgttcagtgtaccgttggtgggtatttggattgagtccatgtcttttccattgtaaatagtgctgcgctgaacatacatgtttctttatggtaaaacaatttatattccttttggtatatatgcaataatgagatttctgggctgaatggtagttctgttttaagttctttgagaaatcgccaaactgctttccacaatgagtgagctgatttaattcccaccagcatgtttaagtgttctcttttctccacaatctcaccagtatctgttaatattagactttttagtaatagccattctgactggtctgagatggtatctcagaccagttgtgagtcaacagatttttctagtactattcaattgttgtttattagaggaggcaatgatgagtttgaagtgaatgaagaattagcttatctgaataccttatgtggaacaactacaagcgaggatatttacaaggaaattaataaagcattacttagttcaagctgaagtggaatctgctaagatgtgttacagctgatacggtaaaaatatgtgtgaagcagaacaagtcttagatttacaaatctgtgaaaatgtagagtgtttaaagcatatgttcattgtattattcgtcactagatactgatgaaagtatttgtatctgtcatgtgctgaactgaagtgtcattggtgaacttcatttcatttactcatgaagacttagcctttgtcagttctgggaattattgtcagaaactgaagctgattattttgacttgctctaccacacacagcagtttggtggtttagtaatggcaaagttttactgttatttatttatttatttttgaggtcagggccaaaattgattttttttttttttgagacggagtctcgctgtgttgccccaggctggagtgcagtggcacgatcttggctcactgcaacctccaccttctgggttcaagcgattcacctgcctcagcctcccgagtagctggcactacaggcgcatgccaccacgcccagctaattttcgtatttttgtagagatggggtttcgccatattggccaggctggtctcgaactcctgaccttgtgatcggcccacctcggcctcccaaagtgctgggactacaggcgcaagccactgtacccggcctgaaatttttctgaatgaaaagaactgcccttctctactgtttctgaacactaaatggctttggaaattaggttttactggagactttgataatatttcctaataaaattaatccaaaattaatccaaaattaaaagcaaaatggcacttatatgtaaaacatattactgtaaagtcattttgatagcaacgaatattcatgtcatatgtaatatcaagctgctttctacacttcatgtgccatcaaaagttaaatgaagaagcaagctctttattgccttccaaatttgcagcagataaatattctgagctcaaactacagcaacagttttttggacttcaataaagagcaaagtaaatttctgtacttcaaaatccatttaaggggtgcagtgaggaactcacacctaatcttcattgggattgattaatctgtattgtaaatgacatgctgaaaggtaaatatgaagaatagaatactatagataccttccaagtgatgaatttgctcagttaaaatcacgtttgttgattgctatcagtatttgccattacttatctgtgtgaaagacattttaaaaaatgaaataagtaaaatctcttcatatgtcaatattagcagattaaaatttgtaattaattttgttgctagggcattttacctttgaacccaaattaagtaaaatattattcttccacagagaaaaaattctattcttctccttaagagatttgtattacaaaaaattgcatttattatttttattattttattttggatgttgtcaatgaaaagcttatggtaattgttttcactcttattatgtaagtacctacataataaccttgacattgacttttggcctaggaagtctggtgatgaaaaatatttactatctgtttctttaaagaaaaaaatttgccatctttttgttagttgattggatgtgcaaagggggttgatggaaacagggagagatgacgcccacagttcctggctggagcattatagcagtgttcttgcagacaaggagttcagagggaagaggaattttggtagtgggacaaagataagttagttgaattttggatcagtttttgagatgcctatgggagattttcaacagttggttgaaaccaactgttgaaaatttggttctgggtttcaggagagaagatgggattggatgtatgtattattagtatgaggtagtaacagaaaatatggatgctattttgatgtatcctgtacattatacttatttcgttcacaaaataagtatatttttctactgtgttttctattttgaaacaaggctgatttttcactgggctcctgaaatagactctggtcactaagtaactgctgtctttgattttgtgttgagggagctgtttcagattctcttcttgactacatggcataattctcttttactacatcaaactttaatttttagctataacacttgaagtaaatcttttttgaaggcaaagaccatacatgcattttggctctattaatattgcttgcagaaaccacagtgtttttatcagagggaaagcaaaaacttgtttacagtggaaagcataacaaaatctgtgatctttttgcctgaggactctttccaaaacaacttactgtaacagacatctaaggtcagtatttcctaattaagacttttcagctacagctcccaaccccagtcatcactcacagggccattccttccttaacgcagtgggtatttcaagttattagcacccaggggccatgcgtttcttcacttaatatgttgaagaattttgttctacttcatatcactaatgatttttaacttttttgggtgtctgtttccaaaatcaaatttagaagtacaacaagctgattaggtatcactttttgtagccatctgagagcagaggtatcattttttgtaaccatctgagagcagagaatttaatgtattgatattttactacacttggaatgatttttggatctggagtagttgggaatgaaacccttgcttcctggccttagaggaggcaacatacttttttccttttttttctgttctcatatgctttccccagaatgcatcattctagtgaatactcagtaaatatttgttccattgaattgaataaaatgagcaaaatagaaggctaacaattgaagaataagtaaacgtagaaaggaagaagtcaattcaaagatgagttgctctacttcttgaagagtgtatcaagtgacagaaaatcagagattgattggtgtatcctgactttttattgtattcttagctggtttttgtctcttttaagatatgtaacttccttaagatatttttacttttaagatcttatgaatagaaattattcagaagtatttactatatttagtattcaaattttaacaaatacaaaatggaaaaacaagcatcaagttggtttaaagatagatgaagacatttctaaggaggctgaatcacatctaaacttttagatggacagccccgcagactgatagtgatccttcaattgtgtcctatttttctaccctctgctcttccacagttttaactcttttaaaccattatagaacacttcaaacacatagaaagagaagatggtataatgaaccctcaagtacttacctagctgcagcaattatcaactcatgggcaatccaaattattttatctgtcttccaccacccttgccccttctcttgccccagcacaactaaattgttttgaagcaaagtgcaggagttgttgtatcatttaattagttaatataccagttatgtgtttgagaccagcctgggcaacatagtgagagtctctctctctctctctctctctgtcacacacacacacacacacacacacacacacacacacacacacacacacacacgtggtgtcatgttacgcacctgttgcctgtggtcttagctactcgtgaggctgaggtgggaggatcgcttgagcccaggagttccaggctgcagtgagctatgatcattccactgcagtctaacctggctgacagagtgagacactctctttttaaaaaaaagattatgtgtgtatgtatgggtgtgtgtgtgtgtgtgtgtgtgtgtgtgtgtgtgtgtaatatattgctaaaaaaaaaaagtgtttattcattctctctcctctctctggaaaacaaaacaacccaataacattgtcacatctaaaataaaattaattaggtttccttaatatcattaaacatctagtcagtctccaagctttcacagttagtgctcttgttcattcgccctctttatctccttttctcacccaccctacccccagtatttacaattctttgttttgaattaggacccaaacaagatccctgcaacgctttgggtctgtgccaccacagctctggttctttgtccaacttggccatcagacttgtaagactgaaatggcttcaatactatttttatttagattcatgtaaggaatatgagcaggagacatagcaggtacaacgtcttcatctcaggaaacctagcagttaccctaatgtacagctcttttctcatctaaatagaatattttgactgccatggacaagagccaaggtgtgtggatgctaccttatcaagcaaagacccagccttgatttttcactgattttttaggtcattttagttaagtaggcccaaggcctgtgtaccatttcctagctttctccatccggggcaattctatacagcagatgaggctgacttaacattctgcatttatcttaattctgttgttaccaaggagataaatgtcgagacgctgaggtcattcccaggaaagtctgactcagccctggcgaatgttaaccctttactcaccttgtgtcttaagtatctttttgtctgttgtttcatttttttctttcttcgttttttgcagtttatttaaggaaaccatttcatttgtcctgtagttttccacattctggattttgctaattgcatcctcatggtgttatttaatgtgtgtctttatccccagattgtgttgtaaactggaaatcaaatctaggcacttgaccagaattcagcattatggcaagcatgcttcatagctggtgctgtacactgcatattacatcataacagggtctcatgtctactcctcttacttttgctaatctgcgggttatgtgttgttaacttgatccagcctttgtaagattttatcaattttttacctagtagtaaaaaaaaaaaaaaaaaagcctggactgttggctcaattaggggcagacaaacatattctgtaatgggtgagataataaatattttaggcttgcaagtcacaaaaatgtctatcaaacaattttgtttctttttacatccctttacaaatataaaagccatccttagatccctggtcatacgtaatcagggtataggccagatttggcaagctggctatagtttgtcgacctctggcctggatccattattttattaaggattgcaaaattttgatattttaattttattgcttcttcatgttttagttggaattcctctgaaaagaatttttttaaaaatttggttaccctgctttatagtttctatagaaaggtaggacgaatgcctaattcctttggttttatttaagatattaaaaaatgaattggttctccaacattctgcaaaggtaattgttaagtattatggtttgtttttgttttaatttttaaccatgaatcattatgcacttgggggattttctttagaaaagcatttctaatgtgcttcaaactattgcttattggctagtggaggctccttcaagttggctcctattaatagattattttgacatgctgtcagtagtctttctagagcgttatttgaagagtccgacttacgtatacgtccatgaaaccatcaccataatcatgataatgaacgttttcatcacttccaaatttttcttttgctattttataactcattcttctctgcatccccatctgcagagaactgatctgccttctgtcagtatagattagcttgcagtttctagagttttacataaatgaaactatccagtacgttcccctatttttctggtttctttaatacaacctaacagcctagattgttagattcatttgtatcattgtatatatgatgactgagttctttttattgctgagtagcatttcatggtagggctataccaacatttgtttattcgtttacctgttgatagatacctggtttgattgtgttttctgatttacaaatacaatttttttaacatttatttgtgaatctttctgtggacatatgctcccatttttctagggtgtggtatggctgaattggttgtaccattttatatttacactagcagtttttgagcggtccatttgctttaccttggcaccaacacccaatatgttctgtcaatattagccattgtagtgagtatatagttattatacctcagtgcaattttaatttggatttctttaatgactaatgatgttgaacatcctttctgtctctctctctctccttgtctgtctctgtctctgtctctctcaagagaatcttgctttataggccagcttggtctcaaactgttggcctcatgtgatctccccactttggcctcccaaagtgctagattacacagccatgggccatggtgcctggcctcaggtatatttttaggttgagtgcctactcaaatcttttgtccttttttattggtttgtttggcatactatttagtgctaggatttcttttatatgctagatacaagttctttattggctatgtgttgaaaacatttttctctcattaggttacctgtgtttgcatttacttaacattgttttttgaaaaagcaacagttttatattttgataaagtccagtttatgatattttcaagtataacttgtactttttgtgtttcacatccaacctaaggccactaaccctttctcctgtttgtcttttctccctagaaattctgtaatgttagctcttatatttaggtctgttatttggtttcagttaatttttccatgttgtatgaaataagagttgaggtgctttcttttaaatatggatatggaattgttccagcaccatttgttgaaagataatcctttccctttgtcttggaacactgtcgatactcaactgactctatatatgtgggtctatttctgaactctctgttctgttccattgttctgtatatctccctttacactagtttcacacggagttgataagtgttgcttgaaatcataatgtaagtcttctaacttcattcttttttcaaaaaattagttataatattataaattatttacatttctatagattttagaattacttttgcagtttttacaaaaaaatgcctcttttattattgtcatttggattccattgaatttatggatcacttgggggagaattggcatctttacagtattgagttttctcattcatgaacatggtatatctctatttcatttaggtcttccttaaattcaacagtgttttgtagtttttgttaataggtcttgcatatcttttgtcaagtttactcttaactatttcatattttgtcatgttattgtgaatgatattttaagaagttttagtttccaagtgtttgttactattatataaaaataaaatttttttttaatgttaacattgtattctcccaccttcctaaacttactcattatgtgcagttgtttaatagatttataagaatttttttgatagtcatgttgtctgtgaataaagacagttttacttcattctttatgacttttatgcctctagtgatccgcttctgggactataggcacttgccaccatacccagctaacttttgtaattttagtagagatggagtttcaccatgttggccagcctggtctcgaactcctggcttcgggtgatccacctgcgtctgcctcctaaagtgtcaggattaaaggcgtgagccaacatgcctgacctttttctctgattgcttttaatgttgttatgcagctattgaacagcttttagtttacagttcattttccttcactactaagtcagaaggcttttgctgactctgctcaatgccctatgtattaggaaatctttttcctctgactagaaaggaattgttttgcctatttccctggcccctgtagttcctgtacatgtacagtttggtcagtattctagggagcctttctatcattctccagagttcttttaagcttgttcatctttcatactctgccctacaaattttcactgacttagtgttaatgatagctgaactatttttacattgctaaggctgccatgctttcttggggttccccatctatatgttgagatctggaaactctttaggcaccatgttggagaatctgtgagctcatcttgtctgttttcctcctctcagttatcactgttttgcactgccatttgtctaatatctgaacatgtttttcatatgttttgtcacattttaaaattccttaatgtaggagggtaaatccagtccctgtcactttattttggccagaagcaaaagtcttctgccagttgcatttagcatttttgcattggtattcttgagaacggttgcaggcttttaaaaaattttttgtcagatttcagaattattaccatgtttgtttcctaagaaaagtatcagatactttgtttctctgtttttagtagtttatatagtacttgtatgatctagtctttaagggttgagtagaagaagtgttttaggttctctgtttctcctgtgctaattgaacttcttagacttttctgggttcagttttggtaaattgtatttttctacaaaattatccagtttaactgggttttcaaaatcacttacagaagtttgtataatctctttttctcctttttttttaaataaactttctcttttttgatggttatctgttttttgccctttctaatttttcatgtttttttctttatgctttgcttcctgattagtttaactgactacacttaaaaaaaaattagtcatctttattggattttgttctgattatgaaagtaaacatgttcattaaaaaaaggtttagaaaatttgaaaaaagcacaaatagttggataaaaatcagctagtctaccacccagagataaccactgttaacagtttggtaacttctggtatgttggtatgcatataattgcatgttaattttaacacaactgagatcagttttctgtgcacattcttgtattgatttcctggggctgtcataataaaatatcacaacctgggtggtttaaaataacagaaatttattctctggcagttccaaagaccagaaacccgaaatcaaggtgtaggcagtaccatgttctctccagagctataggagagaatcctttcttgctgcttctagcttctgctcattgctagcaatccttggtgatccttggctttggcagcatgactccattctctgtgtccatactgatatctggacacatggccttaatatgtccccccccccgccttttttttttaaggacaacagtcattggattagggtctcaccctgttctcatctgacttcatcttaacttaattatatctacaaagaccctgttttcaaataaagtcacattcacagattcctggcagatgtgaattctgcagggatactagtcaacccaatacagcattctattgttactttcctttctgttaatgtcaaagctttctttgtactttcatttctatcagtgaattttagtgtctgctgctaggcaaaattggtactagagtgtatcagcattgcaatgtgctagcatttagttatacctacagtttgcccataaacacagatttccatcatgacctgacagtgcttcatcatagaaaagcaaatcagaggtcattaaattttcttagagcttatatcctggttaattttagaaaatgagaatgctctttgttacaatgttcttgaaaataatttaattgtattatatctctaagtgaatagaatatgttttcagacccaaattgtgaatcataaagaactgaataattaatctaattggatcagaaaactaagaaaaaaaaaatagtggcatgagtgtttttgtttggtgtggtatataacaagacattcctggtgctcatcctggtccttatataagctagaacatatctggtcatttttctcatttgttgaacaaatgtttaccacctccagttttatttttgttatctcaagagtcagtagctattctctataataatggtgaattaagtattattgtggctgtgtttaatttaacacttagattagtttcagattttcactaatctaaacagaggattgtggagggcagggtttggaagaacacccaaaattctttgaggacattgtgtgttatgcactgcgctatgttgcatatgctatttttctttaactcctgtaatgctatgaaaggtaggcattaaaaccatgttaaatactagaaaaatgaaaacaaaatcatattactagttattggtatagttggaagtagagctcaggccttaatttcctgagatttttgcttgtagcactagttcttttattaatatacgtacctgcaggctccagtgtaaaaaataggaaatatgtatgaacatcttctatgaagttttctatatggcagcccatttaaaaaaattgaagtggaattttgcttattttcttttgtttacatttgtttacattattgtattcatttgtttacattattaatacactgtctcttcgtagtaaattacaggccaataaaagttctttatttgttagaaggtcagagaaagtagattttatgtttttttctaattaaataattttattgggaaaaaagaaacactttgaacatgaaagcataaagactattattcagtcagtttagtaaatcatgtgccatgaacacaatgtgcggggtggccctggcagactgttcacaacctgcaggaagatgtcatgtttttatgctactcatttttttatgttattgctttaaatgacatggagaattttaggtgtttaaaaaactatctgaaaagagttgactaattattgttgtttgaagcaatagtgatatggtgtcttctacctccggcaagcatacaaacaccatttgtctaaatagctctgtgtgatccaagatatactattatttacttagagtttttatggtttacatcagtaaggaacttttatcatagggtgtttgtgaaaaaagaactgcctgatctcaaggaatgctttatgataataatgacaggctgtattagcatgattgtagcctgaagcctcccattcctgaagaaggggccactactatttcttgagccttttccttccactctgacccccatcagtcctctttaccaagtactcatttacattatagttcatagtgtggtgtcagctgttcccaaaggtgctctcctcaagcgagtgaatcatttctaggataatggcttgtttcagaacttacacaatgtcttttttggtcttgggagatcaaatgacaaactatcacaatcaagggctagattatggttttttgataacatgtctcaaactagggttagcagtttcttcacttgaggtatatttctggattgaattctataaactgttccacagtagtaatgtcacgtggctcacatttttgcttttgttactcacatactatacagcaataaactcaaattattatgcattatcagattgtattataaatagcaatccagcatcaataattatctcttttgagtgttttgtcttgaagaaaagtgctaagatccttcttagtaaaatcaagctaacataacttttctgtctcctataattgaaatcaattacttcaaaaataaatatagttctatattatgacctaaaaaatatagttctatattatgaccattgaaaataatgaagtgtggttatatagttgcccagttgggacataacctttacaaggcatcattcataatgaaagagtaggttttgttaggacagatacattaatcttaagtaaacatttaagaatttataaaattattataaatatatttgtataactatatagttatatacttaataattatatatatacacacactaatatgtatatatttaaagtgcctctgttgtcatggagtcacagtgagataatgtaataccctggggagtagtagagaggttcattgttcaccctcttatggtaccttttgattattgcattatgtttagaatttaggttgtacaaaatgttttaaaaagctctgtgtgttattaactgttataggagtgtatttctttagttcatggataatacaagtgcttggttgatttacactttaaaataaaacaatcattttgttgaactagagttattttgtttcacaaggtactcacttgatctggttgtaaagaacaacttctgggagtaccattttcacatggtatttttggtttttttccccttccacatagttagcattacacaattgcaaaactttgatttaatgtctgctgctttattttcactataaataagcttaaatgcttatttatagtattttttttttgacctacattaatggatagttttggccaaggtgacagtcttctgggatgtcctaataatttttagctgagttttacgcaaccatctctcttactttgataggcaaaataattagagtgtattttttgagaatctctgctaagggtgccttaaagattcttctaactccaggcctctatgaatatgatgattttccatttttaaaagatgtggcagtatattcttattggcaaaatgtgtttttgcttgtattcatttagagctctgtctcctgtttttctgatgatcaaatggatttctgaactttacgtcacacctttagtgacagaataaaattaaccaactagatgttatcctaagatgaccaagtatctaggcatgaagtgttctgaaaatcatttcacacatttatcttgtgctatatcgaacgctttggtcattaaacaaatggggtgcttttctatacttcgaaataaatgtaaagtgtgaaaatattttcaaatgtgtttgagttcctttgtattttactttacaaatggatttttattatagagatcagaagatagcagtaaatacagtgtcaaaaatttttgttaaatatttatttttatttattatttttattaaatatttaagaaatacattgtgggccacaccctcagctagaagcttcacagagcagtgccaaccgctttcagtgatgcctcgcacagatatggaggctgcgtagtaaccgcagcagcactacgtagaagaggctttctctgtctagaactcctataggcttaggaaaccactttgcatggctgaagtctcgtgtgtaacctaccaagggggccagtggattccctccaagttcttgcttcttcttggtcctccccagaattctctaaagtaagtggagggtcatgggcctcaaagtatgtaggctgcattgtcacccacagttcctcccacacaagttgctagcggaagagggtgtaggcttctaactctaatcagagtcacctgtggttatgtccatacattcagtctggttggagtcaacttttcatgcctggaagtcattctgctctaatgatagtaaacacttaatgaacacctatactgtttgaggccttttctgagtaatttacagacattagcttgtttcttcttcccacccaccctgtgaggttaaggacttatattattctgaatttaaaggtaaggcaaataactattaagtaatttatttgcttaaggtcaaaaagctagtaaaataccaggttggaattcttatccaccaggctaacttgcttttgatgcgatttaccctgtccatgtgcatagtgaatgacttctctatttccagttccatgaggatttgccctaagagattgttgatgaggagcgttggccccagtgtcctatattcttaagttcaagtcctggttcggctactcttttgctgtgtgaccttgagaaagccttgattcctcttttataaggtagtagtactttctttcatatattcaaaaatgtttattgagggcctactgtgtaccaggcactgtttgaggtgttagggatattgtggtagggataaagttcctgtcttcatggagtttcaattctagtggtggagacagacaggtaaacagcagactagattaaaatgtcagatagtgaacagtgtaatgaggaacaataaagcaggagatgtagagctgttttggacagagaacttttaggggtggccttcgagatagtgatgtttggtctgaaatatgcaggaagtgagggagagagccaggaggatgcctagagaagagggtctcagcgaagcaaaaggccttggggtggaaaagcaaagaagccactatgagcagagtgtttggagggagagcggtaggaaatgagactgggaggcaatcaggaaccagagcagactttgcattttattcatcatgcaatgggagttggcatgagcaggggattggcatgacctgatggagttttcagtcttgtgtggctgctgtagggacgatatcctgtcgtgaagtccgaatggaagaagagagaatgggttgctcccgtgatagtctagatgagacatggtggaaacagcatcctagggtaagcccctcctctggaggcttgtagtccagaacactcttctgccagctgtcctgggcccaatctgatcacattatttaactttaccactcccttccttccctggcatcccaaagcctggttactcttctgtatttctttcctccatagcacttattgctctctaatgtgtggtatcatttgcttatatattaggtttatttatgactttcatcgcttaccagagcttaagctgctcaagggcagggatttttctattttgctctgtaatgtgtcccagatgctttggaacagagcctggcatagagtgtgtgcttggcaggtatttgctgaatgtatggcttaagtgctgatggaggaggtgagaggagatgtaatttgaagacaaagccaacaggattttcttctggatgttcttgtccatttctggaagttattctagtagactggaggtaataaacttaacttggtacctgacataaaatacaacctcaataaaccattaatatatcattataaggccaatgtgcagtaaagggctacattttactctttcatgggaaaataaattaatagaagaaagtatagattagaggtcagcaaactctggcccatgggccaaaatagcccattgcctgcttttgtaaatagagtttaattgcaacagaaccatgctcgtatgtttacatattgtgtatggctacttttgctctatgacaacagagttaggtagttgtaacagagacctatgggtcctcaaaacctgaaatatttactgtctggctctttccaggaaaaatatgccagcccctgatatagagagcattatactgagtatatggtattatatattttgcagtatagatcataatgccatttgacaagttgttataatgaagtaatgttgatgaaagcaaatattgaacaacaggaaagtagttggttatgaattaatatagacttatcttcaccaaatcagtttatttataaaatatcaaaagacagaatctgaaagtcctacaattaatcaagttgaagtatcactgaatattttaggtcatcattcactcccatactcgataatcagaacatgccacaacataagtccagacctcgcgatacttctcggataacagttcttgaatcacagcaccaggccagagtggcaaacagcatcgttttctttggctcagcgatagggttaggctttgtgtcctcacccaaatctcatcttgaattgtaattcctgtaatccgcataatccccatgtgtcacgggagagtccaggtggaggtaaatgaattatgaggatggtttccccaatgttgttctcatgatagtgagtgagttctcacgagatctgatggttttatacagagctctttcccccttcactcagcccttctccttcctgctgccttctgaagaaagtgccttgctttcccttcaccttccaccatgatttaagtttccaagcctccccagccatgctgaattgtgagtcaagtaaacctctttactttataaattacccagtctctggcagttctttatagccatgtgaaaatgtacaaatacactcagtgtgtttaaaatttttctgtgaatcttggataaattaaatacaaacttctcagcctggtgttcacttgcctttctaaccagactctgtcttaataactcctactctctaataagcacacgtacacattctcgttttctctctctctctgtctctctcacatacatatatacgacagttgatgtccgtccctttctgaagagagatgttgtttctttccctacccttggtatccatttgtgaaattccactttcttactcaaggcctgtctaaaatgctgtctcctttttgaaggcttttctggttccagttatggttgttaccttccttgatttggccattcatatggtccttgtcatgtttccttacagttacctgtgcatttgtattattctaccctattagattctaacggatgacatagtgttttgcatagaatgcgtcttcagtaagtatagaatttaattgaattgatacaaatgtttgtgtgtgatgcattttaatatttgctaatctaaataataaaaagtaaaatgctgataactcataatttagaaaactgcctttcctgttttgaaaaaaagagtgcagcttgctgccagtgctcatttaattttacataaacatgctctgtgaggctgaagcaaatctgactgattttcagtgtgaaaataaaacataaaaaatgttcctggagttacttctaaacagaattaacatcagaactgtctgaattatcagaatcgtctatttcagaaaaattggattcatcaaataactcttcggtgaacaattatttgagaacaatgttaccatcatacaaacgaatgctgcgttttctaggatttgacattttcagcgattgagaattactacattttgtaaatggaaataccactactaaaaacagaatgccataaatagaatgatgtcttttgcttccaaagtcgagatactagagtgatgtgaaaataataataaaagcaagatacttcgtggcaaagttatctcggggtgaatgctccagtcacaaccaccactggtggatgttcttggggcaaatgggacaaaggttaaggtatttttatggttggccaggatggactgttattattatgaattttgggattcccttaaagtctactttcaagtggattcaagcatggatagaacaaccaaaggtgttgtgtcttgctaccgctgcttctactcttactactgctttaggctgtctagtctgtagtgcagttaaaaggatatgaagcctcttgaacctctggagaggaccatgttcttttgagccacaggtaatcatataagtagactggcttgacaagtctaaaggccctgaattagttatctattgctgtataactgcgaacgttgctgcttaaaacagcacacatttattatctcacagcatctgtgagtcaatagctcgggcataatttagggtcctctgccaggctgcagtctaggtgtctgcaagaactagagtcttacctgaaggcttgactggggaaggagattcttccaagctcacatggttgttgggagcatttagttctttacaggctattggattatgggcctcagtctcttgttggctgtcaatcagaggccacccttagtttcttgccatgtggcctgctccatagggcagcctacaacatggcagcttcttcaaagccagcaaaagagagagttttctagctagatggatgttataatgttatataatgtaatgatccaagtgacatctgtcacttttaccatacttaactggttagaagcaagttacagatcctgcctacacgtagggggaaaggattccgcaagggcgtaattccaggagtcaggattctggaggccatattccagtctgttgttaagaggctcatataacatttttattagagctatctgtatagaagtgctatgattttcttatttgtattttaaaaattcttgactgttaaaatggcatgtttgtgataattagctaatatatcttgcttctttttcctcttatagcagataagttgtagttaattggtagttcatgttaaagttttatttatatttctgctttttcctaccatttcttctcatgagtaggctggagagagcatgtgccaaatcccgactccttggtattatctgaaatgattgattagttctgccatctttaactcttcccttacattccaggtagctcctcttctggttcttcctttttcctttttctttgttcctttccattcttcccctttggatcattttctatttcactctgcagtttaatgacttttatattccccatatatattttatatgctctataattgtgtgttgaaagtatggtttaaatgacataataattttgaatttgccttagtaacctgaagtttttacagtgggttctgttgagactgcagggttcttaggggttagaagtgagaagataggcagataagctataaatcagttctgctcagttctgctcagaatgtggactgtgctggcttgtgaaagattattacgagtcaaagataagatatagacagaaatagaaggtaagtgtttagaaacttttgtagggtttggtggggttttttgtactttatttgttaagtattaatgataacattatgtcacacactgtgcttttacaacagctctcatgaacttttaaagtatggtttgattcttcctgatagtacttgtggcatcgaagcataccctgaatgacaggctgtatttactgtaaatactttaaaaaattgttgctaacaatatgagtgtaattaatgaattttaaatggtcccagcttattgatattaacccgttgattatttgttgtaacttagtaaattattgccagattctaaatatgggtatgctacttagagaggtccccaagacccctgtagtcttattaaggcatttctttgttgggtttgtatctcctctccattctatttcttattctgtcattttggggggattactttattacattacatatttgggagattagctactttttctttactcacaaatatgacctgaatttggtcccatcagggtttctgctacttgtaattatatcatttccttttcaaacagaaccttgcttaaatagatgtagcaatctttagtccaagtacagcttttctcctttgtaggggaaactggagtttggaggaacagtttaagcagaagccacttttccactctcatgggctcaacctaggtgtcttcacaagagaatggttggcttcactgggttcatgttaatacagggaggaggggagcccacttaaaaatacagtcagtgtcacaaaaatctttttggttttttcctccctaaatatagtatttctttttgtaatagttttatcctctgatttttaaagcatctttttagtttttcttgcttgcttttcttgtgaaagttgctattttcaggtgttttgaattgttttggaagttataaatggaattgtgtacttcagagaaggtcaagtttagaactcatcatgtgtcatgtgcctatctcccttctttatttttaaatggcacacgagtgtctgactcgcacatggtatttcttgctttttagactggtgccagactcagtgtcttttgtttttaatagataaacgtctggtggtttgtgttttgctgcgagatgcatgtgagtcatactaatcacgaactccgtccttcctccaacctctgattatttttggacaatttacctatacctcaacatcttgaagcttatatgttgaaaatctcaactgtatatctgtttataagtattctgattaatcacctgcacttttcatttccttatagatttatgtatttacttttttggtgagcaaactaccagtcttgttggctttgtttttatacttgtatattgttcacaaaattagcaaaagacttaagataattggccattaatctttgtgacttactttcttcatagtcatggacattaccaaaaatcttaatttcattagtatatctaattctgtgaattacactcttctagcacagtggctcatagttaaaaacaaacaaaaccaacaatactatgatcaaaaagacaactgatatattttatgttattattaaagagcttgttcagcattatcaaaatcgtctttatttccccaatatgttatgacaggtggtatgtgtaatggttaagagcatagatgttggagccagaccgtctggattctaccacttaaccagctgtgtgatgtttttgatatttggcaaatcactttacctttccattccttggcttcatctctgtaaaatgaggaatagtagtacctaccacatggggcagttttcagtattagctaaatatatgtaaagtgcttgtaacagtacctggcgctgccctataaatgctatgtatgttcttagctgccattgtttatctttgtgatggtctctatttgtgttacaatttttttaacaatagcaaagaaacctttacttatgagatattaaaagtatgtactaagatttaagttttttaggctaaaaatttctagtaaagctagtttctataactcttaagagatgaacaattgaagctaaacacttttcattatcaagggctattacaaagtgatgttttagacataaaaaaaaaggtctatggagttgcatggaagactaagttatgtggttctgccttttttagcattctggccttctgtgttcgtttaacatttgcaaagttccaaattgaagacataaagataggtgatttgtcaatgaggtagtataaagtcctacatgtcttatatctagaactgaggttttcattgaattaccacttacattttcttaagactgtcgatatacttctatgttattgttttagttttttttttaattgggaacatttccttgaacattcacttagagtatcaaaagaagtttttgtttgtggttggaaaaaatgtctttaacctgccaacagaatttaaaattgcataagaaaatgggtgttgatgctgagaaatggtgtgtaggcagcagatctcttgttctgtctgaaaacagtgatgaaatacaaacaacaaatgtggaattactgttgctctattttagtgtgggaaagataacttcagagtagggagaacaatttctgctgttttaataaacttttattatatttaagcatgggatttagttggcaatcattatagggataaaacaaagctaatttctataaatagtactgtaatgcctgtttcattattattattattattttgagacagagtcttgctctgtcacccaggctggtgtccagtggcacaatctcggctcattgcaacctccacctcctgggatcaatcaattcttgtgcctcagcctcccaagtagcttggattgcagacatgcaccaccgtgactggctaatttttgtatttttagtagatacagggttttgccatgttggccaggctgctctcgaactcctcacctcaagtgatccacctgcctcagcctcccaaagtgctgggattacaaacatgagccactgtgcttggctgtgtttcattatatttatgttgaaatttaataggtatttatagcttgggtttccttgattatctttaggtaattggtgaactgttggaattgtccatagaattatattttcctcttgaaacttttatgatagattagcattaaccagtctgtcgttcttgtggtaaactaaacattacgtaaagttgacctttttaactatttttaagtggatagttaagtggcattaagtacattcgtgttgttgtacaaacatcaccactatccacctccagaacttttccctcttcccaacctaaaactctgtactcattaaacagtaactccccattccctgcagccccaccattctactctctgtctctatgaacttgactaccctaggtacctcatataagtagaatcgtatagtgtttgtcattttgtgactggcttttttcagctcgcataatgttctcaagatttatccattgtgtaacatgtcacatttcattttttaaggctgaataagattccattgtacatatatagtagtttgtttatgcatacatctgttgattgacatttggtttgcttccacattttggctattgagaataatgtttgctgtgatcattactatacaaatatctgtttaagtctctggttttagttcttttgtgaatttcactagaaattgagggatttaaccagagatggctagatcatatggtaatttaatttttattttgttttagtagctgccacactgttttcctcagcagctacacaccattttacattcccactgtctgtggaattttgtgttgtttatatttttcttgagaatcagtcgttagatttcattaaacctcagagtgaactactgttctagtatttagttcctaacagattcatttcgattcctatatactcaatacaacaagtattacagattcgttatattaggcctatttacttgcttcctcatatcacgaaaactttcttgggtagatgcaatgcaaggcattacccttcaccttagtcatatgggttaaacaaaataggtaactccggaattaggcaaaatcttgtgtgcaggaatcttgaaaaactgtattatttttcaagctctccaaaagattgagttgacaaaagaaaaagtagcatcaaatgttttattttaggtccttctgtactgcaagagcagaagtagaccaatgttaataattttgatttctcagattcactgaagagatgtgggtctacaaacactttaggtacttggatcaactattctcaacatgaatatgatactgaattcatttatgcaaatgatttttacagtaggtttgctgttatttacttttattattattattttttgagacggagtctcacttgcagtggcacaatttcagctcactgtaacctccgcctcctgggttcaggctattcttgtgcctcagcctcctgagtagctggattacaggcatgtgccagaacagctggctaacttttgtatttttagtagagacggggtttcaccatgttgcccaggctggtcttgaactcctggcctcaagtaatccacctgcctcggcctcccaaagtgctgggattacaggtgtgagccaccatgcctggcctgttatttactttaacatgggttattttctaccagttacatgatcatagctgagccttttgtgaacctaaactttagaataaccatcaaaacaaaataaatgatagtagacatatgactctcttttccctttcttcaaaccaataaattaactaaattaaaaacagaaatgcaacaatatgttttgccctatatctttatagcactttacaatgattgtatgaagttgagaacagtaacatgagatactattcaagatgattcaccgtactctgtttcctcaggtaaagaatttgtatgatatgtttcagaaagatattttttaataaataaattttagaattacatattttgggaccaaatttaaaaatataatacaaactagtggtaacatctaacatctaaagtaataagaccacagtaaataaagttatctcccccaatagcatgggtaatgttctaccactgcaccctgcaggtcctccttcccttttctctaccccttctcccctcccctgtgcccctacacctctccttccctccttctctcctctcctattaagaattactgctattcacaggactggggcatatctcagtgttgtctttggcaaggaaaagtagttgagaactattggtgtggaagtattaaaccgcatttcagaaaatgtgggttttgcttcttcaaactaattagctgaatcacttggtctgcatttcttacatgtaaaatgaaaaggttgaactagacaaatatatgtttttagatttttttttttccaactttgattttttttttcttatgattcttgagtcttagcaaaacccagaatttggaagcctaacagattgtctgcataatctattttatatagtctctatattacgtccaccctataatattaggttggtgtacaagtaattgcggtttcataccatgaattttaaatcattataactaggctcaaacacacctttattaatcaaaataggaaccattacaatcaatacatttttgccaacgagaagtgtgtttattccagtagcataaaaatctgtgcttcagggtgtgatgaactcttggaaaacattttctgcatcctgctggtggtggaagcaatttcactgcaaacagtcgtcaagatacttaaagaagtggcagttggttggcaagaggtcgggtgaatatggcggaggaggcaaaacttcatagcccaattcattcaacttttgaagcgttggttgtgcgatgtgcggacgagtgttgttgtggagaagaattgggccctttctgctgaccagtgccagctgcaggccttgcagttttcagtgcatctcattgatttgctgagcagacttctcagatgtagtggtttcaccaggattcagaaagctgtagtggatcagaccagcagcagaccaccagacagtgaccatgacctttttttggtgcaagtttggctttgggaagtgctttgcagcttctcctcagtccaaccactgagctgctcctcatcagttgttgtatacaatccactttttatcgcacatcacaatctgatcaagaaatggtttgttgttgttgcatagaataagagaagatgacatttcaaacaatttttttgatttccggtcagctcatgaggcacccacttatcgagctttttcacctttccaatttgcttcaaatgctgaatgaacgtagaatggtcgacgttgagttcttcggcatcttctcatgtagttgtaaaaggatcagcttcaatgattgctctcaatcggtcattgtcaacttctgatcgccggccagtacgcttctcatcttcaaggctctcctctcctttgcaaaacttattgaaccaccgctgcgctgtctgttcattagcagttcctgggccaaatgtgttgttgatgttctgagttgtctccgctgctttaagacccattttgaactcaaataagaagatttctcaaatttactttatgtctaacatcatttccattgtctaagataaacataaacagcaagtaataagtcattagcaaaaaaatataaggtgagaaatgcccattaaaatgatttataacataaccatatttatgtaagaatgtattccaatatcaaatggcaaattccaacaatgcaaaaattggaattcctttttcacttttctaattttaaggcagggactatctatttatcttgtaaatctcaaatgatcaaatgaaaagcattttgcaaagttgacacctagaaagattgcaaattcaaagcaatttgttagcctggttaacatagtgagaccctgtctctaattaaaaaaaaaaaaaaacaaaacacgtgaaaataaattagccaggtttggtggtgcaagcctgtattcccagattcttgggagactgaggcaagaggttagcttgagcccaagagttcgagggagcactgagctgtgatcacgccactgcattccagcctgggtgacagactaagaccctgtctctaaaaaaaggaaattgttcagattaaggaggatataaaattattttggcaaacaccatttacttggttctttgaagttcttattgcctttaataggtacagtttttatttagatgtataaatttcaatggcatatcataaataacttaatgataatgacatataatgacatagttgaaggtaagaagtataccttaatccagtggctttaccacattttcctgtaattttcttggctatatctcctctgacttttagtctgaggattaaatggtcctgagtgcaattttgtctcaatctctaaaagaaaaggtcactattttaaaagcaaagcagtattttccccagaattcccagcacatttcattgatacgaattttatctcaggcacattcctgaatgaatcccagtttccacgaaaatgctacattctgattggcttaggtctgagttcctgatgtatttattggaatacatttattgaagcatttattggagaatgaaaaggtatttccctttgattagccacgctctattctagaactggttccagcgttagttttttgtgagctttactgactgcgtgagagaagagttgattcctgaacaaaatcagtattcttttggaaagagagtggggttaagtcctgagtagcaacatgcactgtagttcgcaccttttgctccctaacattcatacacatccttttcctatacgtgttcttaactaaaacttgctcttaaacaaaccatcctcgccacttccctgaagagggatactcaaagtctcattcaattccaagaccaggatcttagatgatacatagattatatatctgggtggtatatactcctctctgtgggatctagtgtagctctttatggtcttgcaacctgtaactaaaaagtaactcacctatgtctattcataatactggaggaagaacaggatgatgcaatgaaaaaatctcatcgtaaaaggaaaataatagaaaacaacacatattggtcattctttcataatccaggaatggtaaacaccccctgtacttggtaggaagttaatttcttagcatatttgatagcaagtgatttttagctctgagaatctctctcctttccttgttttttaatgccacatctggggttgcttttaggaaggaccattcatttccagtagctctctctcagttaatgcaaggttgggtaggagagatctcaggttgctttggaacagtggttctcggcatggtccggagaccagaagcaatagcatcatttgaacggcaaatttttgggtgtcagcacagacttcctgaatgagaacaggaaatccagcgatctgtgctttgataagaactcccagagcatctgatgcgttctctaagaatcattgacatagacattcagcaggtttttgtggtttctttggaaaatcagctcccttaagtggactaagtggaatatcagtctgtttgttatggtcagttccatttacggtgacaatagccagaaaccttgcctggtcatcctttctgcacctgggaatttttctattatagcgagaagcctctacctaaacttcaggaccttaattgaaaggccaataccatgttttggcctcagcttgtcccttgcctttaggctacatctcagctgcattttcacaatgaactgttttgtctttgttaggcaagaggatgcttagctgtgcttgggaaaggacaactgtgggggtgggagttagatgtcctctgggttccaatctcatctcctatggaatttctaacataccagcttctgttttcacgaacctaagcttggcttctgggatttggccttttgtttggttggtttatttttgttttaaccctattggagtccacattaccagacttttagcatttgggggttataaaggcaaagaggacctctcgtatcaatgctgtattttctcccttctcttctttcagactaagcttatctttatctagactagaaaaaataggcaacacatttcatcattgttaatttttctaccatttaagtttcttttagttgaagcaactatagtataatgtttagagtagtcatgaaatttaaggcattagcttattgtttgagagttctgatgttaccttctcccacatcggagttagaaattggcattatggatgaggacaggaagcaaaatagaaaaggcaagtccattctctcttgtctagcctttctgtctccctctatcaccccatagtgccatagcttcacaggaaacagctagcaaacacaaatccatggagtagtgctaagcaatgtgctattgacacactgtgtagtgttgatgaaaaaagccagacaaaaagagtacgtactctatgattccatttatataaaattattgaaaaccaatttatcctgcatactaatttatagtgaaagaaagaacaataatttcctgggcacttgggtagagggtttagagggagaggtgacagagagacacaaggaaacctttagggacaatggatatgttcattatcatgattgtggcaatgtttcacagatgtattcatatgtcaacacttaccaaattatactttttaaatatgtacagtttattttgtgtcaattttacctcaataaagcgaagattattaaaataattatttattaaagtaatacatactaagcaataaacaaggtacctccttccccacaaaaggagccttttgagtcttcttagaattaggaagaggtaggtgcagacatgaaatctggcagttaattagcctgtgtactggaactcctttgctttgctttgctttgtttgtcttgtcttgtcttgtcttgtcttgtcttgtcttgtcttttgtcttgtcttgtcttgtcttgtctcttttctttttttttgaggtagagtttcattcttgtcagccaggctagagtgcagtggcatgatctcagtttgctgcaacctctgcctcctgaattcaagtgattctcctgcctcatcttctccagtagctgggattacaggcgtgcgccaccaggcccagctaatttttttgtatttttagtagagccagggttttgctgtgttggcccagctgatcttgaactgctgacctcaagtgatccacctgcctcggcctcgcaaagtcctgggattataggcatgagtcactgcgcctggcctggaaccccttttcaacttcagttttcatatctgaaaaatggagcttctactaccggcaccaagaatctgctggttgtgcttatcaaaatgagatgtatatgagggagccctgctttgtgtactttacatgagcaactaccctttctcttctccttccttctcctggctgttgtaaaagggacccatgggtttctgctccctcaagcctcctttttactccctcctatgtagatgaaaaaggaaagcaggagtgtacctcctatgaatagcccacacctgcacttttcgatagtgactcggtagagtaactatttcattcacttggacatgacctcaagatttagcagtgggaaaagaaaagcatcgaagtaaatcaaactgacgattatgttacaaaggctatctgatttgctgagttccagccatcatattaccaaaaatataatgtttgcatattatacaaacattttcatttttaaaaaagcagcaccgtcactaagttagttatatataaaaattcagcgtaagttgcagttattctgtagcatattcagtggcattacagttgaaaagaatagaatctgggaatccaggtctttcttatgattcacttttgtctctgtcataggttggctttttagggttatactccatgaatatcaccacctcttgggatggaagttctcagctggcacattccttgctcatctctgaaatactgttctttaatgttcttatttaagttcttaaattgacgtatttcctctgttgagatgcattttttcccttttccatccaaatgtttctgaaaacagcacaattctttataaaggaatatacattcctttaaatacatcttgtatttaatgggggtagtttttatcattcccttctcctgttccaataaagaaaagagctctcactgaattgatagggattctatccatcagtcaaggaaaagaggtgtaatgtgtatgtaggagaagaggcactaaaccactgtgcagctgaggtccgcgtgggaaaggtttcttctcatggatatttgggtagtcgccttgatagccagtggactgtgtgctaaggccctaccagttccctcattttctctctctggtaaatgctactttgtcctggccctgcgttaggtagtaatctccaagtcaaagatgggcagttgaattttactgaaattattacaatgttgattaaaattgttagctctcgaatttggagaatttgttgaagttaaaatggtgggtaattacataaatgcttaggcactactttttcatttcactttaaaacatgtcatctctcttccttatgtgattgctcacaccattatttgacccaaacaatttaagttttttcccacacaggttagaaatttaagttttatctgaatttagctttctagtttcaatgcccttgaaatataagattttttttttctttcccaggatgttttgactcatgttagaacaataccttttatcccaggcgccaaaatatggtacctgttacatgttatagaattagcctcaaccactgtttcctgtgagatttcacctcagcagacgtcagcctccataaccactgagagaacaaaaacaatagttttgttcactaatactcctttgcttttagagtatattttatggtccattattcaggttttttggttggtatattttgcctgtggcttagtcagattttcagattaacccttaggtaagtctttgctagagaccactttcccataagttgacctttagaatatctgaaagtacagatttagttttgcttagtttaacagcagacgagtgttaactattaatctgcagaaataaatatttctaatactagcataaatttggcttcacttcagcatataataataataataataatactttttataaatatatatatgccttgttttcattcctgcaaattctaattcagtaaatctgataagggggccaggtatgtgtacctaaaaagaaaaaacaaaaacaacctacaaccccaaaaccaaacaaaccagacatagagaacagttaggggtggagctgggaagaaattgtgtgtgtgtgtgtgtgtgtgtgtgtgtgtgtgtgtgtgtgtgtatacttctatgtatatgatttttatatatgtatacatctacttgtatatatgtatacatctacttttatatatgtatacatccatttttatagatgtatacatctactttacataattttaaaacagtatttgttactgctttttaaactttatggtatattaggaatatatcttacatggcagaattatattcttaaaggataaattatatgtctatttatatgtataatgtatacatatattatgtaaataaaatctcctactatggtaggaagtgtatagttgtgttcacagttcctgtttcgttttcagcttggacattcgtaagttagctcaagtctgtagcacagtgtcactttgtctgggtctcagcttgaatggccaaccaggtgtctatgtcacaaacattatttgacaattacagctgtctctactgctgtctttggaaagtatagataatatcttagccttaatttttgtctgctgtcattgctttataaaactaaaaataacaacgaaggtggaacaaaagaaaattttcggaaaagtatgtactttatggttgacggaatttcattatcttttaccatgctattttagtaaacacatttagaaaacagttgttgctattaagggtgtgggactttgtctcccagggagtaagctgctagctacaaatagaacacattgaaaatccaactggagaggcccgggtgcagtggttcacgcctgtaatcccagcactttggaaggctgaggtgggcagatcagctgaggtcaggagatcgagaccatcctggctaacacggtgaaaccccgtctctattaaaaatacaaaaaaattagccaggtgtggtggcgggtgcctgtagtcccagctacttgggaggctgaggcaggagaatggtgtgaacctgggaggcggagcttgcagtgagcccagatcacaccactgcacaccagcctgggagacagagcgagactccatctcaaaaaaaaaaaaaaaattctaactggaatgatcactgctacttattaattatatttattctacatattgtgtgtcaattgacatattagctgattcaaaccaatattcagttaaaagaggccattttcttgctttttttttccccctgtacatctttaattctaaagatcaatatagaaatgtaaggaaaacttaggaagatgttaaagaatcacctacagcaacagtttctgtagaactcgatggatttttttgctggcctgtgataaaatgagaaatataaggaaaatataatgagatttttatgaagctacatttgtgagccttcattatgacattcctcctgttttgttgtttaaaatgtgctattttttgaaaaacagtaatgatagtacaagatagtttaactttttttgtcctatcttggcaaaataacaaatcggtagcctatttgatgtccagttatgtgtgtgtgcattttaagtgtgttgctctgtgacatcccagcatcggaaactactgatagaaactggaaaaatagttactattgaaaatggatggtctttgatagactatcaggccctttatttctcttgttgcatagtctgcttggaatggtgtacagattgtagtgtgtttataccctgtgtagggtcccttgtcttacagctctcgtctccaagctttactttcctgttcccagcttcctgacctctaagacaagattgttgatcctttgtctggcaagatctgcattattgctctgtaccttctcgattcctgacttccatttccctgcttcattgtattttactggatacctttctgcctagcactcctcctagctgtgtagcccagtattggcttgtcaactggtctgtccattatgaaatcaccaagagatttgtgtatttattgttattctaatagtatacaagtcactgtgttaaatgctatagcagatagtaaataaggaagataatacctgttccttaagaatattgagataagcatgcaactaatcatgtattcttacacagaataagtcagtgtttcttaagagaagtacagagtacaattggtgataaaggaaattcaaatgcaattggaaggatctttgacttggctggctgtataactttgagcaagtttcttgatctttttgagcctcagtttcctctacggaagaataataatgcttatatcaagattgctgtgagggtaaatgaaacaattaatgtaaaatgcataactgagtttctggcaagcatttggcagctgtcttttactatcactggccacttctcccctcaaactattttaaagattgtgatgattttttacagggattgagaggtgataagtataattctttcaagtaaagtgaataacaaaaaaaggtacagagttaaaatatgctggaacaacattttggagcaaaggatgtagctgatgggaatagagtaagagcaaatacagctgcaattgtgtttcaatttagtacacatattttaatgcaggggaaactaactccgaaagttcacaattgaagatagagacaggagagacgattgagtcagtcacccaagtggagggatttcattttaggcaagaggagttttgggcacaggaagcttaaagaaggtagggttttggaagtatattcagctaatttttcaactatgtcatttttccattgcttgttgagaattttgatcttgacaaacaggtattatgttatcatttgaagatcttatcagattctgttggtatgagtatctcctgtattcgtttgaaagatcaaaaagtaattttcctggaaaaacagttaaaccaagatgagggctcacagtaggctatatttaacaatgaagtctggcacagcctacattgtgtgaacttttggtttcttgggtttttgttttttcttcacttgatggtgtttcagtttggaagaatgtggctagaccacagtatggcttttccaagatttagttcttgttaagggcttattattttgtaacattggttttttgtttttgtggagacaaggtctcactatgttgctcaggctggtctcgaattcctgagctcaagcaaccctcttgcctcagcctcccaaagtgctaggatcacaggcgtgagccaccatgcctggccattttgtaacatttgaagctttgagaaagatcatactctatcaatttatgaaaaacaaatcatgattaaattatgtgagtggaatggaaagtggaggctgtgagtattaatgcttgagtccaaatggtttttgcatattcaggttatctttgacctgaagcagagaaaaccagaagactgtgtcacattagtcaccttttttcccccattaaaaaaagataccagtatgagtgactttttaagagtataactctgatttttaaattatttcagaacttgtaatatctaaagatgctctttacaaaaaaagaataggtatgttaaaacttttagttttcacttgctttatgtggtttggatattaagttgaccattatgtgtttacaccctttgaagtattttaatttgtgaaaattcattgttatttcatttgtttagtctatgtaatttaaaaatattctaccataggtgtttcttaagacttcagggttgaactgggcgtgatggctcacgcctgtcatcccaaccctttgggaggctgagacaggaggataacttgagggacccagcctgggtaacatagtgagaccctgtctttacaaaaaaaaccttttttacaaaaataaaaataataaaaaataaaactctcctgggttatactgccagattaaatacttaagctctctctgcttttgagggttttagtcattcttggtctctggccatgtaacaacctgtgcaaagattagtaggtattgtgtgctagctttatccttgcatcaggacagtctaggcctatttggattttgcatcttccttgtagttcaacagccatctcattttggttttggctttctgcagtcaaccttcaaagatcttttgttttctgacagttgaagaaactggctcagtgttctttctcctagacaattatttaattgtttacagataactgaaactatcttctaaaggtttctattgtgaatttctttattttataggaagcttcttatgttgaaatgattggtcaacataattcttggtgattagaaaaactgtttttcaaccaaatagcatcaaaatgcttattctttcttttctgattttacactgcatggcttttttctgtgtattataacaaatctcttctttttaaagctaagacaatagcaaattagatgcttgagttggtactgttatagcaagtttaaagaaacgtactcttgtaccctataaatatatacacttactatgtacccacaaaaattaaaaataaacatacaagcagtcaaaaaaatgtgctcttaagaaatttttactttcttaagataatatacagtattattttgataactgtggataggatgaacccgtcttatacaataaagagtttagaacttcaaaactatcatgttggctgggtgtggtggctcacgcctgtaatcccagcactttgggaggccaaggcgggtggatcacctgaggctgggagttcgagaccagcctgaccaacatggagaaaccctgtctctactaaaaatacaaaattagccaggcgtagtggcaggtacctgtagtcccagctactcgggagcctgaggcaggagaatcgcttgaacccgggaggcagaggttgcagtgagccgagatcacgacattgcacttcagtctgggcaacaggaacgaaactccgtctcaaaaacaaacaaacaaaaaatcaaaaaattatcatgtcaacaactataattaaccccaagggaacaatttaacacagagttttttgaattcttcatgtaatattcttagttgcttattttgagcattataaatgtttcagaatatcactttgtttatttaaactttttggtacagtttcatgagtgattttccgtggggaatacatttccatctttattaagtgaaacagtaggaaaatgtgatttggtttccacagttgacttttaagccaacctgtcagcaacacatctgtccataaagttgagtacacctgggacatgataatgcataattatttcctcacagaattgtttaatagtcacattaacctaccagtagccaacacttactgattgcttactagatacagacaccattctgagtattttacatgtatcaattcatttatgttataaattttaaaatatgtttcttttctctttttcttcccctgccctttccccctgctagtgttccttaagacagttacttttcataaacagcccaagtcagaaatattagcacagattgaatatcccttatctgaaatgcttggaaccagcatttcagataagggattttgaattttttttttcttcagtttttgtaatatttgcagatagatagatagatatcctggggatgagatccaactccaaacacaaaattcatttatgtttcatgtgcaccttatacgcatagcttgaaggtaatttacataatattttaaaaataattttgtgcatgaagcaaaattttgactgcattttgattgcaacccatcacatgaggtcaggtgtggaatttttttcttgtagtgtcatgttgttgctcaaaaagtttcagatttgggaggatttcagattttcagattaggaatggtcaaccaatagcttccattaagattgttcacttaatttatggagctttccattggttataggacaaataagggaaagggatcacaagaaatgaggtagtattagaaggagagatgacaggttccctggaagggtactgatttaacttgggtgaatgccagtcatacgtgggaatcacagcttcatgacaaggcctgctgcattgactgggccatggagacactcgaggaaaaaaaaacagagagaaccctggtcttccagtgtaccataaacagctttgagaacctgagctatggaatttaaaatgacgtgtcaagtccgatgaagtgacatgttttcacacagaaccagcaggaggatgaaaaacagaaattgtaaacaaggatgaaagtgacaggtttaggacactggatggacaagaagcctggccttagatttccaaagaataaaagagagaaacacatattttaattaaatagcttcatatttagcttcaagaagatgagtactggccatatatttgaatatatatgctatattagtttaaatctcatgtcagatgatttgcaggtctttttatttgcatgtttatgcagctaagatgtttggcgctcagttcttgtgggagggggcagcttggtatggaaagaacttggagtttgaaatctcactgtcctggatttgaatctcagctgttacatggccttgagcaggctacttatctgattttttgaggtggattcttgtctgtaagatcaagatagggaaacccaactctgaaagggttaaatgagataaggcatataaaatatcagtaacaggctcactggctcacacctgtaatcccagcactttgggaggccgagaggggagggtcgcttgagcccaggagtttgagaccaacctgggcaacatagcgagaccccgtttctattaaaaaaaaaaagaaacagaaaaacaaaaacaaaaaaaagaaaatatcgacaacagtgtctgatgctcagtaagggctaaacaaaattgagttactctaccaaggaaacgacaatagaatggttttccctttccccttgttatagaaagggcagaatatgtaaagagaagacatagaacaactgggagactagaacctctatttgtaagagaagccacaatttgtgtttattttaaaaatgtaaattacttaggaggaaaagagtgttagcagttcaagattatgtggtcggttaaatagttaaacacgttttaaaatgtatgttactttacttaaggatcccatgcgaaaattctcagaaattaagcattgcatatttgactgctgagtacagtgattcatatgtatcttaaagtcacatattcataaaattacacatggatcagattcaattgttaaaagtacaatttttctcaatatgaaattttaaagcatttgtgtactatggtctttttaaagccttgctactcattatagcaatcgaatcactgaagaaatgttcctttttgtttggttcaatgttattgagtcttatctttttgatataggactattttttattttgtaactgtgtcttttattttgtaataaatttgtttaaggtatattttaatattataagagtagaaccaatattttagttttaaaaagacaattctatatcatgtctaaatactattgggaaatatgcctattttttaattttttaaagctagtattgccattctactttttttactttgattaatgtagtctcagagaattattcattgaacatgctttaatattttttcctgatttcaaggagtgaaaaaagattatctaaaaatttctaaggttgtattttcttatgagaatgctatattatctacttatttattcttatatcattagttaaaagttaaatgagtatgtgttatcatttctgaatactatagtgtgtataaggaataccagaactttctagttatgatggccaaagtaatgtcagtagtttatgaaaaagtaatttaggtcttgaatttcttttgattagtcattgtaagcatttttaaactttcttcctcatagatttgtgcacttttagataatgtgtgatttgtacagtcattcttgagtagttgaaacttaaaagaattgcaaatttttgtgcctggtggagataaaataactctgaggcatggtagatacttggtttttgaatctcttgtataaaccaagcaaatgtttctgaaagagcacttttgtgtatgttttgaggtatccccatgttaagtatatgctatctttagaaatttgagtcttatttattgttatcatttgaacaggtgtctcaatgcttgtacctactgcaaaactaaacacgccagaggaaatttggccagttatccaattgatgaactagtagatagagccaaacaatcttttcaaggtaagagtttctagaattatatgtgaaattagtcttcttaataaattatgttagccttctaagtaatacttcagtttagagaccaacttctttagttttctgaagagttttacaaatatacgaacttaattaataaaagatgtgaccagagttaatcacttagtttatttttacattaatgactcttcttttactacgcttctgttttcttatcactctaaggtaaatgacatattttgaactttatcacccacctctagactccatggaaaagacaaaattaagataaaatgaaatccatgagcctctgatgtctgttaagatttttgtggacaagtgaaatactcagatttttcatctctttctttgacatttttggaccatttagaaaatagagctaattagggtttgtagacgtctttgaagaagataagttttcatatcagccaataaaggaggccaccccttttaaccacatgactgtcagaccactaaagattggtactgggggagaggcctaatgagaatgatttgtgtggggtggccaactacttctgagtcatcacttgccgggaaatgtgattatctaggtctctctcagcatatatagtaagacttatctttaacatgagtgacagttgtgtggacatataactgctcaaaccataaacttcctcttttgtctttgtttatagtatgtgcctgtaacagtggtgtgtttttactcccaacatgagataatctattgtctcataatcttgcaggttaatagttattggcaatgtacttttctttttgtcaagtaacttggagtgctagtttcagtatttcatactctgggtctcagaaagtatgagttccaaattcatttttttgtttagtctgtagaaaacttttagaaacatgaatttgtaatgtttctcttaatagagaaaaatatctccttgtttgatttattgatgcctcccaacagtttttctctacttgtatattcttagctcagtcccctcctcctttcacattcaactagtattgagagagaaataaaggacatttactgactcttgctagcattctccttttacagccagattattgtctaatctaagaaaaagcctgggtggttgtctttactacagcataaccaatacttccaaggattttttaaaaggagaaaaaattttcccagaaactaaatctatttgaaaaagtctttgctggcattcttaattagtgtttgtttttccatgtatctgtcagataatgcggatattaaacatagatgatctatctaccaaacactgcaacttagaaggcatgaaattagtactttttttaacatcatgcatttctaagtgcaactgcatataatttttttaaaaatctatttcattttacttgaaaacgtttttgaaaaatgtaaagctgtaaaatcaccatgtagaaagtgaaaatctcctcttcactcgcttacatctattttcacctgtaacttatgctaacatttggatatgattgcttcatggctttatatggacacatttatgaattatatgtgacttgagaaaaaaagaagacagaacagaaatattactggtggatggtgtccaggttctttgcgttttaaacaaagaattggacaaaatgcacaaacaaagcaaggaaagaattaagcaacaaaagcagagatttattgagaatgaaaatacactccacagtgtgggagcaggtctgagcagtggctcaagggcccggatacagaatctcctgagatccaaataccccctagatgtttcccactggccatttggtgttcatcccatgtaaatgaaatggtggtccatggtcagtctgattggttgtagagagcaaccaatcagaggctgaagtgcagttacaaagttcatactcctatgcaaacatccgattggttatggaaagctgaagtgaagttacaaagttacatgcttatgcaaacgtctgactggttgcagaaagcaagcaatcagagatactttcaatttgccatctgccctgcagaaaagatgggggtttgcaaagagagtaacctctggtccttttgttacttgctggaaagttgttttttttttttttccaatttagttctaggaagtcagggtgaattggccttaggttccctgcctccagaccctgttctcctgcctcagaaacatagtttgtataaagtgattatgactttttctaacaatatccaccttagctctgtgatttatctttagaaatgccctctgagtaaccaatttacagcgtattgcttctgtagatctttagtaagttaacattgtcatatccaggtgggttggactagttaaggcgagtgattcaaataatgtatcagaggttagcagtaacgtagctatttttagagaacgtattagaagattactcttattaacatcagtaagatctttttattcccaaccatggaatgtttgcaacatcaggtttttctgttgccttattatctgtgtattagaattgaaactaaatgctagtttttggactggtgagctaatttgtgagataatccagtgtgttcaggaaatgtggttgtttttttctttctttctttcttttttttttttttggtgacagggtctcacactgtatcacccaggctgcagtgtcatggtacagtcagagcttactgcagcttcaaactgttgggctcaagcgatcctcctgcctcagcctccgcagtagtggcgactatagccatgcgctaccaagtctggctaatttttaaattttttagagagaaagagtctccctgtgtttgccaggctggtctcgaactcctggcctcaagccaccttggcctcccaaagtgctgggattacaggtgtgagccactgcacccagccaggaaaattttaagtcctcaagtacttggtgctttttgctataagcagtttggatttgaaatactgctctgttgcttaccagccacatgatgtgaacgtagtatctcacctctccaagcttatggctttctcatcactataatatttaatgtttttattttaagaatttgagataacatgtataaagtaattggctatgtcaatattatgaagaagagaccaggtgccgtggctcacgcctgtaatcccagcactttgggaggccaaggcgggtggatcacaaggtcaggagatcgagaccatcctaactaacacagtaaaaccccgtctctactaaaactacaaaaaattagccgggcgtggtggcgggtgcctatagtctcagctacttgggaggcggaggcaggagaatggcgtgaacccgggaggcggagcttgcagtgagctgagattgcgccactgaactcgagcctgggcgacagagcaagactccgtctcaaaaaaaaaaaaaaaaaaacattatgaagaagaaatattacttaaactaaaatccgaagccaggaagagaagtctaattttgggtaagaatattgtaacatccatagcaaaaacattaatgactaaaatcaaatgatggatttttcttttgagtccaaattatgttttatgaaaaactgctctgtagatagatgtttagtatgacagttacctttcattttctaaatttgagaagtgcaaatttatgctacgggcggccttataatccctttcaaaaataggaagtatcaatctataagctaatatttttaagacattttagtagcattgtcttttttctgcaaaagacattgagattttaatgctgttatagaaatcctaagtttgagctttaaaattgcaaataataattatgaaagtaaccataatagaagaaatgactcattttcttattactatgacttttgcacatttagttatttaataattcaggtgataggaatattctttggaccagaaactcttaagttctgcattctaccatgattagattgcctgtcttataatgaataagaaacatggttttatgaaaagttactctataatgaaaaacctaaatatgccaccaataaattgtagtactaggtttaaagccactctgtggatgggagttaaatttcccatccttaaagcggcattttctttcttttaatttttttaatggctcctgtatgtcagaattaaaaaatgatttttttaaactctatatcaactgtggaatgaggattagaacccaggtttccagtcatatgatagaatatacaataggatcaaaattttattccaaatagcatatttatcagacattttattttattttttatttttttgaggtgagatctcactggagtgcagtggcatgatcttggctcactgcagcctcctcctgggctcaagcaatcctcccacctcagcctcctgagtagctgggactacaggtgtgcactaccacacctggctaatttttctatttttgatagagacagggttttgccatgtttcccaggctggtcttgaactcctggcctcaagtgatctgcccacctttgcctcccaaagtgcagggattacaggtgtgattatgagacattttatattcataaaaatttatttcttgttagtctaatgaatgaggagactaaaggctaacccaaaggcaaggaagcattcagaagagattctgaaataatcatgaagtcattctgaatataaaatggcttcccacaatactaaaaatatgctgactatgcattcagatgtgaaaaaatgagagagctcattaacttttgaatggacagcattaaagtaaatatttctatgtttaaatagaaatgtaatttcttttgtatataaattacatcttactggttttctggcgttttttttttctctctctcaacctccataattgactatctttaccttctcagtgtgtgttttatttttgaggagactgctgcatgtgagtttaagatttaccaggtaatttctgggtatcattttgttgttctcacagactgttgtgaaaccttccttctcacttcctcctttctgatgagattcaggttttaaaaattcctaggattaacagtgtttgggggctgagtttgctgggtttgacacggttgcattttagatatctagaaaaacatgtcaagtggtgaccaggactttgttggggccagaatgaatttacaagctagtgttttctaggatatttgtattgatttttctctagcagctaatcaatcagtttcagttgtataagtgatggagcaaacctttttaagtgtgcagggtgagtggtgtggaaacaacacctttcaccgcactgtctctggaatcaaaatgtagagatgatggatgagctgtttttatagctatcgtgtgcttttctagatctcatttgtgggttactactttttggctccctcataaatctgaaaagcccctgcaagataagtggcataaactggttatggaaaggtaaaataaattaggatgaaatattcagaacagggagaaaatttcttgatgcctagtgatttcgattaatttcgatattaatgttggaattttaaaaaatggattctgtatttcaagacttgcaaagatactatctagtatgtataagattaattatgaaatgcaactgtagtacattgcttccaacttttttagataggaaacaatatgagcaatatttgattttctattgtataagcttaaaagtgttcagttgtacactttatatcaagtcccatttgactgtaatgatgattagtatacactgatttcgacccaagattaaaagggggccataattgtattctgttgatttatatggcagttaaattaaatgtctctttaattcctttatcttttcatatgtgctgtattcaattgagaaatgcatgttatctgtaggattaatgatgcaatttacatgtttgttataacaattgtcaacttccaaaaaggattttaggcagcttacattaaatgattgtatgtaaaagaccatggaaataagaaccatgtaaaatgctgtattgtgttttgaaagagggaagatgattttacaactgttgagtcctggctcttcagaagaatagtgaaatagagtgatttatataatctgataggagtatgtaaaagaaagtatacactgtaccaagagaagtctacatgtttctaggcactgaaccctcagaattattttcatgcattctttcctaagagacactgaatgatatagtagaaatgtttttgactaatgatagaaattgaagatatattttctacctggctttttcttctgttgattcttgcaaaacccaaaaatataatattaaaatgtaacctttaaaagacattttttgggagaactaaataaatgtaatgtacataatacacataactggatcgtgaacacagtgcctaaatagctatttatcagatattcagtttaaataagctaagattaatcgctgtgacttcagggactgttagtttagactatcagtggcagaaacagagtataatttatgtggcctttgcctattcaggtctctgagtttctgtcagtggtgtttaaacttttcttagcaacaaagggtaccctttttacaaaggaaacttgaaaaagtagaggcagaccaccgtggttgaagtagaagtggggccctgtttaatgaggcctttcctcagaactttgaggattcagccagaatctgctggtttagatgagtgtttctgattatttaaggtattcctgaacactgcaatccaggagtggtgaaggtttccttcaaggacaaatagtaaatattttaggctttgtgggccataaggcctctgctgcaactatttagttctgcccttgtagcatgaaagcagccacagaaaatatgcaaataaatggatatggctgtgcttcattaaaactgtatgatagaccagtcgtggtggctcacgcctgtaatcccagcactttgagagggtctcggcaggcagatcacttgagttcaggagttcaagaccaggctgccacacaggatgaaaccccttctctactaaaaatacaaaaattagctaggcgtggtggcgcacgcctgtaaccccagctacttgggaggccgaggtggaagagtcatttgaacccggaaggtgaggttgcagtgagccaagatcgtgccactgcactccagcctgggcaacagaggggatttcgtctcaaaaaacaaaacaaaaaaaaaacaaaaaaaaaaaccctatatgataggggttattgatgaaggggttccatggtcaattctgggggaaattaatttaaacaaattaatcgagattcttcatggcagaacttctggttctgtgtctaatatgttaatacatattgtcaatccataaaagaaggatttaacctttaagaactaatatagatgtaaaatagattaatgttctcaatctggccatttaactcacttgtcagtcttataaaaccaaaactaaatgtgtctgcgtcataaccctaacaattacatcacaatttccatggatgagggctttgcgttttctaaaatacaggtgactgcaatgatagtcagaggcgagaactacaattaagaaccactattctagaaaattttttggttgaagctgtaaaatgagctgaccctctcaattctgtagtgagaaggagtctgaggaaaaaccctggttgattagtaaataatggccatatggggaaggtggaggggcaacacaatcgttgttaatttgctattaccgccctagatagtgaatggatggtttcaaagtccaaaggtacttatttaagttaaaaggctcagctgtttttgttatcaaccaaggcatcacaaaaggatggctgacatttatggagtacttacagtgcatagataggaattacgatgaaaaccacatggtccctgtctttaaagatcccctcctagtttaggagagagagtagcaagttggactaatgaaaattgaagtatgcagaaacagacaccaaatttgggataacagaagtcattcttacaaatcagccaggtttcctcctcagaatccctctcactaagtttttgttagccactgccattgattatgctgagtattcaggatgagatctacttgctgttctgaatcccgaggcttctgttatgccgaagtctctgaaagaaagaaaccaaatggtgactctttaactaaggtaactattggaactatgtagctgttatttttccattcattcaacaaatatttattgagcattcattagaagcagttcttatttctgctaataggcacatgctttagaaaaggtatgataacagtacattatcacaatcaataattgattacttctgccagtaaggaggacagaaagagaggtttgctgataatggggcagacagcttatccttgccatcggaaacaaggatgtgatcccaagtttgttacatttgttcataattctgagttttcatagttcagagtatgtatagtccaacgcacagaaaatctgctgcttctggaaataccttgttaaatctatccttaatgaaaatcatagtgcagtcatccctcactgctattggtgagttttatttacgttttactcttttgtgctctataaaacagtttacaaacatgcagttaagtataaaagttatttaaaataatgaggctctgggaaaacagataagaatagaaagtccaaaacttggtggaaaattggaacacaggaaagttggccataatcacacatgtggtttttaaaatcaagcaacagttttgactcttagcttcttgaacacttattgtctttaaagaaaagtaataccagcttggcattaggtttgaaagagttttcacatagggagtggtgagggatagagtaggtcccagcagcgtccctttaacactcactcacataccatgtttctgaaagttatatattttggcatttcttgttagaacttgcagacatgctgggcgcagtggctcatgcctgtaatccccagcactttgggaggctgaggtgggtggatcacctggggtcaggagttctaaaccagcctcaccaacatggcgaaaacccatctctactaaaaatataaaaaatagccaggcgtggtggtgcatgcctgtaatctcagctacttgggaagctgaggcaggagaatcgcttgaacccaggaggcagaggttgcagggagccaagatagcaccatggcactccagcctgggagacagagcgagactccgtctcaaaaaaaaaaaaaaaaaaaaaaaaaaaaaagaacttgcagacatgtcttgaaaagcataacaccctgaagggatttattgggtgctaagacaatacaaagtatactactcactgataatctggtctacttccagattccacagccattgggggctgtaaaggactcctgttatagaggctaataccttaggggtttgtacaccataggtcattttgtgaggtggtatagctaggtccaggaagacagcattagaatttgtatttatttgtgttttctcattctttaaatttttcttttctttgtgtatgtttcatattgtatatattagtacaatagtacatgagtataattaataagtatacatccatgggaatacttttaaaaatttttttagctgattcagaaagcgatatgtggagaccactgatttaaaggaacaaatagcctgcccattttccactataaacataattctttcagcgagacgtttggtttgaatagggcaacagacttctgtgttctctatcaagatcctgaggtgcccatattctgctttgattgagtgcaaatccacctgcttttgagatcaaataagcaaataatgaagtttatgtcctttggaggaaaactgatgtatttaatgaagattcttgcctgcatctggtgagagccatgcgtctctgctcagaggtggagagaaatgctgcttactcaggagcacgtgtttcccattgcttcatctgtattttaggacatgggaagacttaaccaagaggggattggggtcaggcgtatgtggcagtgtgaatatgggtttagtaggtgcacaataaatgttgaatgagtggttaatctagaattgattatgcctgatgaaattccatgtatgacttggaacccataatgaaaaagtagtatggaaaaaccatactttttaagtgggcaagagatattgcttagtttcagctgctgttccagcacaattgaatgctgtgtcttatgacatgggcttgattttataacaccagatatgtagaggtggtggctttccaagatttacaacagagaaataatttactttgggaaatcatctgatagttaatgggtatctaacgttttaccaaaggggtatgtccacctagttccacacttacagttataagtaatatatatttgctttgatacctttactaaacaaaattctacaaatgattcttgtgaccaggtacaagagttaaccaaatgtttgcgtttaccatttgagctgaggctgatctgtctctgggatgatgttggagaactttaaaggctgcaagttggttttggaaggttgtttaatggaattttaatagccttggaaagatgtgaaagtgatactgctacctggtggtttgtaaacccgacctttgtgagatattttctgggcaaaagtactactttgtgatgccagcagcctttattgattccgcagagtctgcagttttctaacactggctgtcaattcattccagttgaaaaattattaaatttcttctcctgcttgtgtggatattaaactgcagtaaacatacttgcacaatatcaggtaaggcgagcaaaatttcctgcctggaaaaagaaatgtttgttagtgggaccttggctgttctgcagaggttatacgtttctgtatttctttttatttgttgttctcagtcatgctttttatttctcgtggtgagttccaacacatttcttgttatttgtaatataagaaagagaagtttgatttagattgctgacttttaaaaatacgtcctcttagttaatcatttctggtagtgtgaacaagagggaaacctgggtggtaagagtttttaacctgtgacaatataattgggtaagaatgagaaagaattgatgaaacaaggaatgaataaggaatgaatgattctgtgatcatacagtccacatagatctttctgatttgttgacttttagttaaggaagaggaatgatgatgagatagtaatcatttataaaagtagattttaaacacctccatctttgagaataacctctggagctggcagttattgaggtcattggcacttattgaggtatatgtttgaaatgcaaatatctggccacattcccaattcagtagccttgccataggcccaggaatttgcatttttcaaaacaatcatttcaaatgtttgggaggcagatgatacaaagatcacttctagaaatgtttgtctagagaactttcttaattacgtataccaaaacatttgatcaaagtagtaaagaggattggggaagaaatgtaccatttatgtgagctaataaaaatctgggccagttttctctctgtgatagatataggccccagctccattcctcccacaccagacctttcttcagattctttttggggaatttcttttttgagatgaagtctcgctctgtcgcccaggctggagtgcagtggcgcgatcttggctcactgcaacctcttcctcccgggttcaagtgattctcctgcctcagtctctcgagtaactgggattacaggcgcatgccacgaccctggctaatttgtatatttttagtagagatgggtttttaccctgttggccaggctggtctcgaattcctgacctcaagtgatctgcccacctcggcctcccaaagtgctgggattacaggcgtgagctactgtgcccgtcctcttctggggaattttaaaatacagatttccaggctctacctcaaaagattttgatactgagctaggcttacaagcctgggaatgtttatttttaaagctctgtaagtttgggaatcagtagcctagattttttctggaatttagctctttttattctgtattgacttttttttttcctgtttatgtatcaatattttggtacagtttgagatgagcctttcaaagcaaaatatcacactgtatataattagaagaagaaagggaccttgaacttccttatccatgtcttaataaaactgatacgcctgtaatgtgaaaataattcttcattttttatcaacatgaatgaagtaattagcttatttggttttatagatatatagtaatatataaatttgtgtagttttggaagataactttatttccttgagacaaggtatatctttgcttatttctctttatttgagaagaagtgctaaatctgaattgtagtaggaatctgcagttcttccagtatggacagtgcttcattttgatacatttacatgatggagtgttataaaattgcatgtaataatgtttacaaagttgataataactcagaaaatgtcttataatgttgatttttaagaaatgtaatgtatgtaatgtatgatcacaattacttttaaaaggaagtaaaaataaaaattaaaaacagaaaaaaaggagaaattatgccaaaatgttacttttcttggggacaaagagtatattaaacatttttgctagtttaatattttctatatttttcataagtacatatatcactgtagttagactacataaacaaaataaaatttatttttaaagaattgcatattatccattttttagtataggaaattaaatcacatatgtatctttttttaatgagtcactttttgttacttgactaagctataaaaatagaaatttgactatttgaaacatttgataaactaaaatttatagattaactttgaagttcatggattctctttgatcatgtggtagcctaatattctgaaaattttcttttaacaaataaatggtgttcgctgcactccagcctgggtgacaaagtgagatcctgactcagaaaaaataaaaaacttaaaaaaaaaagaaaaaaaatggtgttatgaagatctgcttcaggggaaatctggaagccacctggctttccctcttccatttcctgcctgactctatggtcttaactacaaatctatgaatacgtaaaagaactgcggaataggaggaagcctttgcagttacttcccttgcccttcatttccagctgaggaacatgaagcctacagagaggtgactccccaagctgctgtcacccaatgccagttctgtcaccactacactgtggcttcttcagctctaacagtgatagcattggtaatatctttttggaaagacaattcaaagaatatgggaggaaaaaaatgatggtgagtatgagagtttacagaaagagaagttttggactagaagattaagcagtggcttcttagaagagaaagaacttgagtagggccagaagtgttctgcctttgaagaggaatacggttcaacttttcatcaaagcccatgagatcccatgtgatctggctgcactttccattccagattcatcctgttgcactttctctaacttgctagcatccaactgttgtttcttagttccttgaatatagcaatttccttttccttgagtggtttttcctgtggtctttgcatggctgtctttttcacattaaagtgtccacttaaatatcacctcctcataaggcccttctttgaccacctttttgaagggaacattttttctcttattctctatcatatcactctgtttatttgtttcaaagcatttatcataattctttttttcttttcttttgagatggagtctcgctttgttgcccaggctggagtgcagtggtgtgatctcaactcactgcaaccttcgcctcccgggttcaagctattctcctgcctcagcctactgagtagctgggattacaggtgcctgccaccacgcctggctaattttttgtatttttagtagtgatggggtttcaccatgttggccaggctggtctaaaactcctgacctcaggtgatccgcctgcctcagcctcccaaagtgctgggattacaggcatgagccacttggctcagccaaagcatttatcataatttgtactttgtattcatttatctgtttattcatttatttattgtctgttctgagaagtaagtgagaatacctttgttattcatcattgcattactagagcttggcatagcatagggcatagagtaggcccataataaatacttgctgggctgggcacggtggctcacgcctgtaatcacagccctttgggaggccaagtgggggcagatcacgagatcaagagatcgagaccatcgtggccaacatggtgaaaccccttccctactaaaaatacaaaaattagctgggcgtggtggcacgcacctgtagtcccagctactcaggagactgaggcaggagaattgcttgaacccaggaggtggaggttgcagggagatgagatcgcaccactgcactccagcctggcaacagagcgagactccatctacaaaaaaaaaaaatacttgctgaatgaatacatgaataaaaataatttataaactaatagaatcctatggaatttagatctgtttagaaacattctgcgtagtgtggtctattttttttttttttttttttagagaaagcgtaagcgtaaattatgtaaatggttctctacaacctcatcctattaggagggtaagaactttccctaaatacctttgccagtagtgaagtgacaggcttcagtgatgggggtaggagtagtagccatgtttcatgagtcaggactgatagaggatttgcacatgggcctgtgcacctgatatgtcaaataatcagacctcagaaataacagtggatcccaaagtcccaaaccagaagggtagcccagaatgtcattaaaacaaagagatctgattcagagatcaaggccagagtgtgaaaccataaatgtaagcgtacgtaaacctaagcatgtgaagattaaatgggagaaggtcccgtctgattaactgaatgggttctgttatttgccacttggagtgctggatttgactcagggttcagaggccatgtgtgccatgggcaaagcccacttttggcataaaaattatttaaatatttaattttagttgattttataggttgcattattgcttatatatttcataaatatattttaaaataatcaaatatttaacaaatttggaaaagcaacaattcctgtttccttctctctctataaaaagtggataaacttgaaaaatccttggtagactattacttggtagctcccaggattcatgttctgtgtagacagaacttttccatgacagctggcttgcacatgtgtcttgctttggctagcagtacattagaaagtgtgatgcaggcagaggtttgataagcacttgtgtgctggggcttgttcttgtgggatgttgctggagccctgagccgccattgtcaggagatctgtctaccttattggcaatatcatgtggacagagagatgcttagccagcccacagaaattttagcttcccagctgtgactccagacatgtgaatggagaagtcatattgaatgttccagccaccacattgatcaaatgacctgcccacctgagcctatcccagattgcagaagaattattttaagccagttattttttgtatgatgtgttatgcagccagacatattttgttactttttgacatgtattttaatagtaaaatattataataccgttacatttaactcataagattagttagataaattgaggtatgttttccatgaaactcaatatgtagtaatattaggattatagttttaacaattactggcatatcaccaggaacttttaagtgcagagaaagctaaaaatcacacagccagtggccaagtggcttacagtttacagcctagcatgtaagccgttatatcacggagtaataagagcagcgattcagttaagcttgtgatactatgacattttgattaaaaccagaataggttcaattctgtttccatagtttctagctctgtgaccttaagaaagttacttactcttatccaacctcagttttcccattgtaaaaataaggataaagcatacttactaaatacctgaaaattaaaatagtataatactaagtctgcaatacttggaaaatgcttaataaatgaattcttattattactgttcttaatgatataacaagagagcaaggagaaaggaggaacaggaaaaaataagtcaccacctaagaaatgactgttgacattctttctgccttgtcttctttccaacttgtgtgtgtgtgtgtgtgtgtgtgtgtgcgcgcgtgcatgcgcgcgtgcgcatatacccatatactctcacatagctatgcctgggcttcatttaagaagaaacactgaggccaggcaaagtggctcatgcctgtaatcccagcactttgggaggctgaggtgggtggatcacctgaggccaggagttcgagaccagcctgaccaacatggagaaactccgcctctactaaaaatacaaaaattagctaggtgtggtggtgggtgcctgtaatcccagctacttggaaggctgaggcaggagaatcacttgaacccggaggcagaggttgcagtgagctgagatcgtgccattgcactccagcctgggcaacaagagcaaaactccgtttcaataaaaaaaagaagaggaaacactggactatatgcatatttataaagtgcatacagatcccctgggaattttgttaacatgcaaattttattttggtgggtcttgtatggggcctgagagtctgcatttttaagctcccaggtaatgctgatactgctggtgcatgggtcccactgagtagaaatggactgtaggatgacatgatgcttgtggccctttgtattttggtctcagttctcttcagccatcatctctcctcattctgcaccacataattggttctgcaatcaccacataattttttcttcatacatcatcaatagtgcttactagatttagacaaagtgatttgtttagatgtttatatcctctacctcctcttcagtaaagaccccttgggtcttacttatcttgatatcactattaatgttcaataaatgttttttgaatgaatgtatgcatgcatgcctctatgattctcagaactgtaaaatggaaacttcatcttttgccttactaattggaagcagcgaacattctcagaatgagcactgtaaatgtctggatgctggattttgaaggaatacccaactagcacccataattggtaatgagaaaaatgggttgttcacagatgtgaggtaatttaaggaggataatatggattgggcacagttaagactatatatttttatgaatattaatgtatacccatactgtaatatgtaagcaaataatgccaaactaggtaatatttgaaatgaagggaatcatttatatatgaaatgttgaagaaaactggaattaaaaagaaaatacatttcctttgaaaaatttgattgtttttacatttatatttgttcactctggttacatctgtgcttttcagacttgaaataacttatatgcaatggtctgaccttcattttatagtcatactgacttggagatgtaattcacttatgtaatttgttttagtaaaaaaaggaggagaggttaggagaaacttggcacgatgttaactggagaataaattgaataaagattttaaaataatttcacttaccgtattagcccagcatttgaatgttttcagcaataatgtatctgtaactaaattaattaataagtaatgctgtcacatgaaaaatatccctttccccattaattttgaaaatctgtaatgtttttacttaactgcaactgacttaacttaacttacttaacttaaaatgcaactgacattttgcattttattgtgtttctagacttaaaatggtgacatttaaaatagcttactttgagttaatacaagcaaattattgagtttttttctagcacattagccaaggttagtgtgcctgttaatcctaattgttattactattatttgtttatttaacaaacatttgtcaagtgcctattaagtggagagtttctgatagtgaaatgatgtttacattttacatattctactatgaattctggaacattagaagaagcaatttgtgatttctaactgtgactgatagcaagttatgaaacaaatatatttttctcttcataaaatataaaattgctaaaaaataaagtgctacttaatgatggttggcttgttcagaataaataaagagaaaactaaatggaaacttggaccagtgtattttaggtaaaatggtatttctcaaattgaatatcagctatttcttgacattttatgatgtagtcaaccactctattgctaagtattcttaaacatcgacttcagaaatcaaaattatcattcctaaataagtaaaagtttattgtacatgctgcatgatatttattatatcctaccatcgataaacataaatagcacatggctgattttatctctttatttttattcttttcttatttataatgattgttttctgtgagcacaggtgtgattataaatacaattcaggcattttgccgttttatggtccttatataaataaaattttctaaagtgtgtatcaaataattttccttgcacttttacatctagcttttcatttcatctttatattcacctcatgaattattgctgctggtgcttgttatctctgttttgctgaagcacagagaggttacgcttagagtctgaagaagagtagtaaaattgagatttcctgattgattggcctctgcactttgcactatagcatgctgttcctcagggaaaatgttgggcttaaatacttggtattgcaaatgcatttgttgctataggtgcaatttagtttattatgataactggggtcatttcatcagtttggatcattttgagagaagcccttagtggaattgccatcacaatgctcttgaatggtggccctgacaatatttccccagacctcagtttcgttgtccatagctgttgcaaaaagattaaatacctgttaaatacaacagaatactgaaaatcagagccaagcaaaacttctaggctctaggaaccttaatatactaagagaaaagtgttttaatatttgtattagtaaacaagactacatttaagtgcattcactaagtagttctgtaaggtacatttaaaactaactctgctgaaattgtaaaaaaaaaaatctgttcttatcaaattttgagattgaaaatatttaaaataaaagaaaaatctgcatttcatgttttagaaatgtgcataaaatggatatagtaatgataatgatgcagaaagattggttctgccacatatacttccattaatttgagacttgggatccatgaagatactttaggtctccagcgtacccatcacagtaacttgattgcctaaaatctatgtgcccctcatgccacaggcttgcattaaatgaactgtgaagtttaatttgaaaactatttgcaaaccaattcctataaaaatggatttatagctggaaaccgagtacttcagaagtgctgagtaaatgtagttgtgtgcctgattttaattttaggcaattgtatttgtgatctgctcttgttttgctttactttttgagaaccagtgccccaaagaaagaaaaaataaacctacttttgtttctagtttatttgcaaaccaggtcagacgcccttgattagctctcagttggaggataatttgaaccttgacagattgaacccaaacagcagggtttctctagtctggccaacagatagaaaaaataaagtaaaagctaatgccagttcacaagctgtacaacaggactgaataaatgtgcaactgttaatgaatagctatttcaaatatttacaaaaggcccaagaaaaaagaaaagattagcatcttaggcagctgttctaagggaaacctattagaaataaacatgataaatgatgctcaagagctaatatatctgtcaaatatcaaatacactcagaaaaaaaactgtttcagacacaaaaactattaagacccatttgggcataagagccatcttgctttgtggtttacaccagaaatttattcttatactttttaaaatttatcttttctaactcctcaaatattcacacagatattattttacagattttaaggccaggagttagtggatagaatcattagagttgtgtccatcgtgattaaattggttagaaatttaaaaattcacccatgtgtctttgtatgaagatacaccataacttgttattttacggggttcctgactacataatagtttgactgtgacagtaacaccattttagcatcaggacggttttgctaggaaatgctacataaaaatggaaattattcctgaagcagcgagggattggttcccaatgcagattacaggtacagttactattgcctaaacatgcttggacatgtttctacaaacccatccttgtctttttatataaaatattccttttgcactaagctaaaattaaagcaagctgtatgtgacatttattggtgacttatacagtagacccttaacattcaggaccaagcattctgtttttaactatttcttcataccgtgaaagtctgtggagagaagcaatttgaatttcctgaggcttcaatttgtgtttgaatagcttgtactcttaggctcaaatggaggatcaagtcatttatttgatgagggagcttagccagcatctcggcatttgtatctcagtgtaatatagagtaaatctcttacaattttttagttgtaaattaccagatctttgtttctgtatggaagattgtcaccgaaaggaaagctaattattaatggcatgacctttgtgaatttggagatttatagacaataaggatctactgtgttaatatttgaacagttgtcaaataacggttattttgatttttggtcattttctaacatgtaaaaagtgtgattcacaccagcatgagtcattttgtgaatgttcaaaaaacacgatttatgtttgaagtgtatcgtgttcagtttagatgactgaactgctttatagttgcagcccagacatcactaatctaacagatttcagacgactgtcagattaggtgtgttgtattattagagacacagtatgttttcaggccaatttcagaaccagtggaggagtttggtcattcttagccccttctgacaggataagtgttgtcacagagaccatggtgaaggctgacacagaatcatgggacttcatggtctggtcctaacctgtttctctgattttacatttcattcctctccaaggatgcacttatttcagcagtatctttgttgaataatttcccctatccctaacccaaactagcactatcaaaagcttcataattacctgtcacctggaatcgcctttaatcaccattaattcattgttgctcactaatgtagaggttaggaaatgggaggtaaatggccaaagtacgtattccatatatagtacatctatatggatgtatagagggggcatgaataggtattaagggaatgaggaagaaagctaggcaaatttgtcctttcttttgagctacgtgttacttctgtataataaacaaatcttatattgcggtttaattagttcagagacacacataggcatacactcatgcatgaggagaattataatttgtgcatataaaaagggaaatatcaacactgttgatatttttaatggtgactttcctatttctgccgtgtagaaaaggtactaaatatcacccccattctaaaagtagttttggtgaaatctgaaagggtctgctccttttttagttgatccagactccattgataacactaaattttcatgctgttctgcagttatagacccttaaacttagactctctttgtacttcatcattgtaatttacacactaggttggtacattctcttcaagacagtttgccttgtgcttccagctgctccccaatagccattgtgctgaataagcacttatttcagtatgtccttgatacaattaatgcaggcatctgcagaagcggccgtggcagcagcagctgcagtgccttatggaagccaacttctgcttagcattgtgataaaagaaatagttttgagctggaagctaatgttggcttatttttagcataaaaagagttgcacctgccagggctagcggaggaccgaggtttgttgattacacgttcttgttagtgccattgttattggtaaaatgggcatgatgtcatccttatcaaactgaattggcaccctgcagagtgacaaataatttaccctctgcggttttatcagcatgggccgtgtgttagaagtgactagagtgctgagttttcacagttgaatgctatggaactgcagaggtgtatgaaaatgaaagggattgatacttgtaatcagtgcacatagtaatggccaaggtgtaatgaaacataagtgcacatttagggtaattatgctgctaccaggtggggccctggggctttgcatgtatagaagctgcttgaggtggcggatgtgcagcgaggaatactgcagcaccatctggtagattctcattttctcattaattcttctgtcccctaagtctgggctacattgactttgaacagcacttcatctgttcagtatctcatctcattttagttgggagttgctctcaacagtggtattgatatgatgtaattcacaatctcggccatgtgagatatattaaaacaaatcatctaattgattttctttttaagtaaagctaactgtccctagtaacattcacatgaccatctgattctaaaccatttaccactcttgtagttatttaaattaaaatagagtatttgtttgatttaaattagccaaatgaactttgttcttcagaataatttataaataaaagtataatttaaagagtaaatagtaaaccacattgcattttccttggtcattttttaacgtgtgtgttttatttctacaggccgatgtagtttttgtctcaaatataacaaaaacttgtttattagtgaagcttcagaataagaaagtacagtgatggttgcccagcagtataaacatactaaactccactgaatgcacagttaagaatgggtaaaatggctaaaaacaaaaaaatagtatttgaggttatatattgtgtaaggaagtaaaattcttaaaacttgccaaattaattttatacgaatgctttcacataacattaaaaataagatttctagcataatattagtaggtcatatatggttgatttccttatcaatatgaatattaatatcatgaaacatttttaaagatccatagtatatattcatataacacaaatagtcacaatgaagtagcatctgatggctgattttttaatgctgtataatttataacggggtgcagtgtatcaaaataagacgatctagcatctgtgattgtaggtaactgacattagtgatttcacgatttctttaataagtacaaatataacatttatatggtctgagtgcttgaacacctttctataaataatagaaatgtccccattaaaatgttccacttagagaatccccgtgcattttgtcattttatttccatgaatgttccaaaaatggaaaacgagagaaaaacctattcgcttcttccaaacactacatgaatgctccctgtgatgcccttgaggtcagtgtttgtcagtgtagtgccacaaagatgtggagagctgttctgtcagtgacgctgctgccatctgaatttcccatcactcatttccaacctattgtccagatactgcaggcttcatgagaggatagatttataagctactttagtactttaaaatgcccaactaacttttttccccatttactttgaataaccctactataagaggttaacaaaatgtatcttatttttctcctattatatttctagaaactcattagggcagcaacaagagttggttgaaaactccttttaagttacatcttgggaatttacttgattattacttaatatacactgtgatgatagaaagcataccagcagtactttccttctttcctgacgtttacttgtttgttttcaaagcattaaaatatcagcatttttttcccctcatacattcagtagacatttgctctgtcatctgtttctttacaggctgtgagtataggaagagcctgggtagtgagattacactgttgaatcctggcttggccactagccaggtatatgactttgggcaaataatttaacctttgaaattgtcaattgaaattgaaagtgtcaattgtttcaacatgtaaataataattctttgccttgcataaattgtgagaaatcatcataatgattgagcatgagcactcagtagatggtcaggactgttatggtgcacatttaccaacaaaagatccatagcataaaaatgatcaagaacccataaactcatatttaaattatcttcaaagaaatcattacccaggaaaaatccaagagtaagttgttatatttactaatactgcgcattcctcaagggcaagggtggcctcatacccacacaattccaaggtacttattgcacacaagtaatgctaactgattgagtggcattaaccaattaggagaagtacctgtggatcccttctcatgatgatatttttaaatgtgtaaaataaaattcataggattaaaagaaagcaagttatattgaaatagcgttatcagtacatgaacattttcgtgatatatgtgcttctttatcaataagctgaataagatgcagctgtgtgtctaataattaccataatttcaaagtattgtatatttcaagatacctgaaataattgtaatatgatatgcaaatttttataatttctcatgggtgaaatcacagccactacaaatagctataacttgttgcctacattcacagttgtagaattggtaaattttggcaagaaataaatgaaaacgaagttatgattttttatttttattttttgcacccaagttcggtctcttcccactctcttagtctgttcagtctcaaatagctttcttaatgaagatataaacaacaacaacgacaaaaattaataaaagcgcttagcaacaccaagaaaataatccaaaaatgattaggccagaaggtttgtgctgtcttggcccttgaccaagacctctagttgatagatccttcaaggttacctctctcagcccccttctagaagattaaccatgtcttagaaattggtgctaagtagttccttcttatttgatgatgattttaaatgcatgtactattttgtctgaactagaatccaaactttccatgaaattaacatcattccctgttgaatctaggtgtcatagctctataaccttcaattagtttacaaacaatatatatgtctccttacctgtgaacaaggaatgcttaagaacacaataggcttggaatttgcaactaatttggcccaatcttgagtagatggccaaactaaaatcttgaagttattttgccccaacatagagcaacagaaaagactcaagcaagttccttagagattgtagctgcatagttctagatatctttaatatagaagggagtagccacacaaaaaatatcatgtttaaaaacataaccaacaacttgtattattgaacatattttaatttaaaaatgtatattttagaacagcaatatgaataaatgaaaacgtgtgtgaaaataattcattattactctgaataagcctacttttcctaattatccctaaaaagtttatttttctatttcctgattatctcttttaaaggttaatttattcttatagctttgattatcaaaattatactcagaactaagtaaacaacatcctagcaagggtcatcagtgtgtagagaaagattaatttgggctttcaagatggtacaggattatagaggaggtgaccttaagttgggtttcaaagaacacattgggtttagaagatgatagagttatatggaaaaagacattcccattctagtctggagaaataatatgagcaaatgctgaaagaaatgggcatgcatatttcagtcagagaacactctgcagtctgaatagctgggtggatacaattctggaggggtgaaattattgaagccttgtgtcctattcgttttccttttaatcaaagagaacatattaacaaatctacatggtaggaagataattcagttgtaatataaaggatggtgtgaaaagggaagacattggagacgaaagattattaaggactgttaaaatgttccaggtgggagtcttaaactttggcagtggttattggaaaggatgggttagaaccaaaggatattttagaatacagattttgaaaaactcgagaatttggaaaagaacgcagtcacaaatgaccaaggattgtagcctgagtggttgaaaagggttgtgtcggtaatggaactagagatcaaaaaaggagcagcatgtcttatagggaagggtaattttaatcttgagctcagtgtagtgttgtctttatttgtagacaaatacagctgcccgttccaaattcttatctgtggctccgtttaaaaattcaagttcaaatgaaattttgagagtcaaaaattggagtaaaagctgaagaggggacatgaggggcaagagatgatgaataagacgatgtttaagagatcattgatgtggcagttaggaacttaagagagcatttcaatagattagttgttctcagtctttagtgtgataagaattacctaggaagcttatcaaaaatgtagatttgggaactctttgtcataggtctctaagactagggcaggacctggaagtatgcatttataaactctcaggtgatgcagataataaataatgattatggtagctgatatatattgaggacttcttacatgccagacattgtgattatatttataatcacgatcacataagaaccttactgagtatgtatgtaattttcctattttacaaatgagacacagaatcacaaagaagttaaacaatttcctcaaatttacatagccaggaagcggtagttctgtggcccatgatcttgatcactctgttgttcccaataagtgctgataatcagtatttagaataggggccattagagatacttgcaggagggccattgtcccaccctcacatccaccaaggcccccacacattgtatttatttccgtgggtgttttaaaaggcagtgctttgtttcatgttacaatttttgtaaccttgcttaatttttaatattctttgagccttaagaaatctaagagaccaggtttctcttaacttccaagaggtcctagtgagtgattgcaaaaaaattggattgcagtgcatcgagttgctaaggggaggtgaaagaatcgaagtagctaacatttggaggttaaggagtagtagggcaggtccggaattctgtgtggaaggtgcttaagggtggcagtcccagatgggggagctgtgggtttaaaacaagcagcctgattttacttagaattatgtttgtttgtactggcttgaaggacgttgggcctgggatatagaagtaaataattggggttagaggtagagttagggggagatggctaaagccccataaaagctactctttggtgccctcaaccatggaaacaatggaaatggtatggtagatgatgaaattgtatggaggaaatggcatttttacattgggggctatttatccatgtttctagatgaaaaggaacaaggaaatagcaagtttttttgtttgtttgtttgttttttttttgagatggagtctcgccctgtcgtccaggctggatgatagagtggtgtgatctcagcccattgcaacttccgcctcctgggttcaggcgattctcctgcctcagccttccaagtaggtgtgattacaggtgcccgccaccacgcctggctaatttttttttgtatttttattttatttatttgtttgtttgtttgtttatttttaaactttttttgagatggagtctcactctgtaaccgaggctggagtgcagtggtgtgatcttggctcactgcaacctccgcctccaggttcaagcgattctcttgcggagctgggattacaggcataagccaccacacccagctgattttctgtatttttagtggagatggggtttcaccatgttggtcaggctggtctcgaactccgggcatcaagtgatccgcctaccttggcctcccaaagtgctgggattacagacatgagccaccgtgccaggccacaatattttaatattcctgaaaagaggcatcttaatagatgagagggcgacttcagaagagatgggaaaggaaggtaatgttagacaaacaaaagattagggacattcctactctgatacaagaaggagcaaagagaggttgtgtcaaaaaacttgagatattttgaactgatgggaggagggttaaagagtttcagaataaataatgtctagcaggccggcgcggtggctcacgcctgtaatcccagcactttgggaggccgaggcgggtggatcatgaggtcaggagatcgagaccatcctgtctaacaaggtgaaaccccgtctctactaaaaatacaaaaaattagccgggcgcggtggcaggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaagtctagcccttttgataagtaggtggcaagacatgcttccaagtaagcactgagcatttgaagagatggttacatatgacttgatcattctgtatctttgtagacctttgaattgataaaagaaaaaaaatagtgcttcccactcttataaaatgtttcagtatgtacagttataatatttcatgttcaccattgtctctgagatgtggggaggggggttggaagattgattccaggagagggcagcagcgctgtaagcatttaatttgggtatatcctttctctgttcccttggcttttaaaaattaagtaataatgtgttctctgtctctattaccttcactaatgaaaaaaaatagggtctgtaaagctatttaataatcttacaatttattaatttattagtttcacattactaaacatggcaattgtggaaaatacaaagctactgaaaattatcctcatatataatagatctatttgaaacattttggtatgatttagacccagttttgtcctgactctgtgtgtgatttgtataataagaaattgaaaaaaaggcttactagcttaaatagctttaaaaatataaactgtgggaacataggactaattgggcttgttgaaagaatttttaacagataaacattaatttttattaagcacagaccgaattgaaaaaggctaaacttacatgttaaaataatttggcaatctaactgcagattcaaaatttctgaaaatgtaaataaattaaaatgtaggcagtgttttaccatctgtaatgaattagcattccatttttaccagctgctgctggggtttttgaagctgactcaggatctgagcaccctggtgggtttctgctgataaatataagaacctgtagtttaaaactggcagagctggactggggattagaaaagtcactgcaactttaagcagcagattctttcacttggggcaggatgtaagggtgtactttctctaaagatgccgtcagtacaaatgcggaggatagattactactgcttgctgctaacatgacaggacattcagggtgccactactgttgagtgtggagtcagccttggaggaaaaaatccccaaaaccttctttggcaattgtctcttatgtagtggacatattttaggcaaaatgacagcatttgtgcattgatgggattaatgcttcattctaaggattaaattcgttaatattttttctttgtgtacttttttattcctaaaacttttattttgagcatgcaggagacagggatttcttggaaagaatatgaattttgaagtcaggcagacctagatatgaatgcaaattctgttgcttcttagccacttgtaacaggcaggcgtagaattcagtgtgtaatcattaaacattttgttttctttcctcacattggtgaggatagttttcttttgagtatttgctttagtgcctttaattaatgaaaaacaactagttaaaaggttggctaattcctttatgatatacacacacacacgtacacacagagctacctatctcctctcttactttttattgtcagtctttttattacaaattagtcttctacatattataaatttaaatgctaactagaaccagctaaaaagtcaatacacttgttcaatcaacacttttatttaacacatagtatgtgctgtgtattggaaggtctggtgatgatggttccaattctggccttctgaagcttatattctaaatggaggatgctgtagactgctgtgaatacggtggaatcaataagcatttacattgtgatgggaaagacttttgtggttagggaagcattcctgcaggcagtgttgtaaaatgtggagcactttacaaaaaatatgttcataatagcaattacgactgagggatatgaaaacacctcaactgttaaataagcatggtgattctgacctggacagatttgtgaacgtcatctacaagtctttgccatctaatatctgatgagatttagggatttttagcctaatatcttgaaagtatccttggagttttcagatcctcactttgtccaaacttgctgtcctgttcctgttttcacagaaacttcaggtgtcctcacaggctgactaggaccaaggtatacctatctgaccattatgcgggccagtctgaggtcactgccctggggctgagacctgtgtcactgatttactagtgactcactgtgtattaccgcagctggcccttgactctgcttcctcagctgtagttcagtatgaactcagaaaacttgtttgtgacccgaaattagttctgtgttcatttcttactcttactcatgcacacatgactcatgacttagtccttgttttaaacttgtgcattagggtagctctgaattatgtcctccttctcctagaagcagaacctcttatcctgttttgacttggcccttgactgcttaaaatgtctgtagttggctttgtatggttataatcctagccccttaggctgggaattttggccatctgtggtctctatttctagccttagccctaaccaccccacttcctgctgctcctgtcaaatgcacttacttatacttttccgtatgtgtctcaagctttcctacaaagatgatgggtctttgctgaccctatttctttcgttcaggatgagctcaaaattaccacattagttttgaaacttgctctaatttctcctaccaggaggaatttcttccttcttggcaatactgtggtatttaatggtattttactgttttgcactttgtattatacttatttgtgttatgtcttgtcgcccctactagactgtaagatgattttatctgtataccattaagtgtctcatacatacagattctcagtaaaattttgctggtggaatggagtggagacccaggctttagatagtaactgggaacaacaagatcgaatttcttatctgttcgtacctaataagctcctctctcccctcgcccataggctttgcttacctgtcacagaacctaccctgccttttttcctacatgcggtattattgtcctgaactccttcaagtgttaagtaaatcagtaaatctttaaagccaaccttagcggccaggtgcagtggctcacgcctgtaatcccagcactttgaggggcggaggccggcggatcacttgagatcaggagttcaagaccagcctggccaacatggtgaaaccccgtgtctaccaaaaacataaaaaattagccgggtgtggtgatgcatgcctgtaatcccagctattcaggaggctgaggcgcttgaactcggggagtgggcggaggttgcagtgagctgagatcatgccactgcactccagcctgggtgacagagcaagactctgtctcataaataaataaatagctaaccatagcaactctatcagattttaaagaaatatcccccttcggcagggcatggtggctcacgcctgtaatcccagcactttgcgaggccaacgtgggcggatcacctgaggtcaggggttcaagaccagcctggccaacatggtgaaaccctctctatactaaaaatacaaaaattagtcaggcatggtggcgggcgcctgtaatcccagctactcgggaggctgaggcaggagaatcacttgaacctgagaggcagaggttgcagtgagccgagatcgcaccattgcactccagcctgggtgacagagcaagattctatctcattaaaaaaaaaagaaaaaaataataaataaataaaagaagtattccccattggtgattgtaccaaaaggatatagaaatacctgcctagtccctaggactgatgtacaggtggactctttgcatttctgtagagaacccacaaaacctctagtaccagtgacaaagtcaggctgccccaaaggggcaaagccactttggtagagtgaggaagaggcagtaagagtctctagttagttttgaagtcttggtcttccctggtcaggaggagtagagtacacctgctggtttcagcactgctctcagatggttaaaaaaccactctcaatatataatatctcccgcctgttatgtaatagtcacttcaacagtttttatgttgtttaacttttcaatacaacctttttggattatcattatttccacttttatagatgaagaactagagattcaaagattcattcaggaagcaaatatgtgttgtatcctggggtcaggctgactgttgtctctgcctgctagtctggaatttaaaccttgttctcctttgtcacttgatattggcaatttctttcctgtccttgctggatttcctgcatttctcacttgtgctctcctctgacttttctgacctctttggttctaaaaattatccctgattcccacacttctggttcctattctgtgtggtgacccctgctgtttgctgcccacacctcggagtgatgctgagtgagggaatccaatctcccaaacaggaagcttaccaagttttgaaagcagagccttttcttgcagtcaattaaaggttcactctgactgtccatttttaaactatggtatgaattttgtctgtcattttcttgcccttgtcttcctgtgagaagactgtgttttatttatcaagatagtagttttaattctcttagaggttggggctttaataattgagtgatttaaaaactttttatgaacaaattctgtgtcttccatatcacacctagagaagcagtgagggacatattttactctttagaattatataagtaatttcctcatgcatcaatagaaagaaattagctacaggcttcggaatgcttagagtgggaatgcgagataatcgtaagtaagctctacatagctggtattactttttttattccatcaaagaaactacatttttttttgctttttttcgagatggaatctctctctgtttccaggctggagtgcagtggcacaatcttggctcactgaaacctccacctcctgggttcaagctattccccagcctcagcttcctgagtagctgggactacaggcacgcaccaccatgcccagctaatttttgtattttttagtagggacagggtttcaccatgttggccaggagtgtcttgatcttctgacctcatgatccgcccacctcggcctcccaaagtgctgagattacaggcgtgagccaccgcgcctggccaagaaactacattctttaagttattataatatttaaatatataagtaaaatgccaccatatatcataatactgttcttttttgtgatttataaatttctctatggcctgtatcttatactgtatacataaagcctcctgaattcatatataatgtgggtctgagaacatatttgacagttgattatctaaaagtcagataattgacatgttataaaggggtggggagggttgctaaataagtttccattaggctaagaaaagattataaaatttcttattattggttcatgcacagttaagcaactcagcaagtgaaagaaaatttacagatggcttgaatgtgttgggtttttgctttgtttttggcaagggaccatcggctctgaagattagggaagtcatccaggcatcttcctttcccacaaacccaccaactctgttacctggagcttaatacatatgtgatctaatacagtatccttccatgtgattaagcttttctcccattactattcattaaacagactattgacatctctaagtgtgatccccaaaccaacagcattggcatcttggttctcaaacattaaggaacagcacagtcgcttggctggcttattaaaaacaaagattgctggaccccatcctcagagtctgcgattcagtaggtctggagtagagcttgagaatttgcatttctgtcaggttccaagataatatgatgttgctggtctgggactacactccaagaaacactgaaaacagactttgctttcacctttgatttatgaatccctctttgccatatataatcatagcatatattttgtatatgtgatatataaattgataaactttcatttttcattctgaattctgtatgcttgttattgagaactgattgtcatctcactcttctgtgaatggactctttctgttttctaacttgatctcttttacatgggcaagctattgacttggctatatttaactaggcatttgattgacctttcctattaattattaatcttgtagctttttagttgattctttgggctttctaggtaagcaaccatattatttctatttttcctctttgagcgattcctaaaatggctgtctgtgaaatgtctttcatatttgttaacatgttgcttttctttctcttcctttttttattatggttgtgcatctcatgtctatactctttgtttttatgcagtctcaaatctcctgtttgtatctccaaagtagttaataatttttattcatatactttaaaatgcactctttttggaaattgtaaccactgctgcaatcaagatacagaacagttacaccacgtaccaaaattttctccttttccctttctagtcaaactctcttatcgctgcaagtactggcaaccacaaatttcttttcttttcctttggttttgccctttccagatatcatataaatggaatcatgcgatatgtagcctgatgggattcagaacacaccaccccaaaatatggcacattgcatattgaatattttaagctgaaggaatttgagaaatggcaggtacaggaaggactctctgaccttcctctgaagaaggtcataagacatgtcatgtgagaggtgccctccctgcacctggagggggaaggggcattcctgtctccaaaggcggaagaacgctgaggattccaaatgaactccacaggccttgctaagtttcccctggtttgctaactcccttttagctcatacgctttgtcctgtcacattttttcacaacctcccactctttatcaaacctagcataaaaacacccaggttaactgtttccttccatctgcgtttccatatgaagactcccatatcatataacacttctattaaacagatgtgtttacttttctcttttaaatcttttgttagtctaatttacagggcccagccagagaacctgggagggtaagcgaaaagaatatttttttcttcccctacaagctcttttagtctggcttctttcatttagcaatatttttggtttcatccatattgtttcatgttcattcctttttattgctgtgtgctattccattgtatgaatgtaccacagtgtttttaatctgttaatcacttgaagcatcctaggttgcttgcagtttggggcaattatgaataaagccactataaacattcacatacggattcttatgagaacatgtccagtgtcatttctgattttcctactaggtttttcattttcatgtagtctttacttattgtgatatgttcttttctcataatggcttcctctgattcctagagtcagtgtccttttgtgtgttgttaagaacaaggttcaaaactgaaaaattcttttattttttgatttacatttcatactgacaagaattagtctttcttcagcactttggtttttttttctcttttgctcctgaaacttttgtatgctctgagataatttttctttgctcatccgtaagagagaaacctacaggcacttttgaggtatagataaaattaggtactttaagtactgctatgagttctgacagattggtacaggggcccacctataattcttccaagtggaccttcccagatctgtatcaaaggaagtaacaaaactcaactttcagtaggtggctggataggaaatggagcagtggggaattcaagctccatgctggtcaccttctctcatacgttgtcttcccagttgttgcattttagttgacaagtgtaactagttccaggcagatgccccttccccacatatggtaggcaaaacctaaaaatggttcccaatattcttaccctctgctgcacctaccttgtgttgttccctccccctgaatgtgggtggaacctgtggatataatgggctgttcctccagtattgtatagccactcatggctgttgaacatttaaatatgtctagaatgactgcgcaaccgaatgtttcatttatttaattaatttaaaactaaatagccgcatgtggctagtggcagctgtagttaataatgtgcttggtgaagtatttggggtgaagtgtcttgatatatgcatctttctttgaaatgcataagaaagtacaatggatagttgtatggtaaagcaaataaagtacaatattatcatagaatctaggtggtaggtatatggagttcactgtaaaattatttcaactttttctgtatatttaaaatgttttacaataacatgacaggaggaaaccttttgatggactttagtgaaaaaagtaattgcacccagtaaagaaaaatctaggaccagatggcatcactggtgaattctagcaaacatttaaagaattaacaccagtccctctgaaattcatctaaaaaatagaagaggagagaacactttctaactcattctctgaggtcagcataccaaagctagataaagatatcagaagaaaagaaaattatagactgatagcccttatgaatatagatgcaaaaatattaacaaatcaaattcaacagcatattaaaaggattttacacccatcatcaagtgggatttatccaaggaatacaaagatgcttccacataacaaaaatcaatcaatataatatagcacattaatgtaacaaaagcaaaaacagagtgatctcaatgaatgaagaaaaggtatttgccaaaatccaacacttcatctcaggaatgatgaggttgatggaaaaaacaaacaaacaaacaaacaaaaacactaaaaaaaccctataagtagaagagaacattctcaacatgttaaaggacatttctgaaaaactcacgattagcatcatgctcattggtgaaagactaaataaaagctttccccctaagatcaggagcaagacaaggtgcctgctttctccattgctattcaacgttgtactcgaattcccaatcagagcagtgaaacaggaaaaagaactaaaatgcattcaaattggaaaagaagtaaaacagtctctcttcacagataatatgatcctaaatatagaagatcccaaagaatctacaagaaaactactagaactatgaaatgaatgtagcaaagctgtaggttataagatcaccatgcaaaaatcagttgtgtttctcttcatcagcaatgaacaatcataatcaatctgaaaaggaaattaagaaagtgattccgtttacaatagcatctgaaagaataaaatacctaggaataaatttaaccaaggaggtgaaaaatttgtacactaaaaaatatgaaacaagttgtgtgctgtagcacatgcatgtagtcccagctactcaggaggctgaagcaggagaatcacttgagcctgaaagtttgagaccaccctgagcaacatagcaaggccccatctcttaaaaaagaaaaaaaaaagtgataaattatgaaacactactgaaagaaatgaaagaagacctaaataaaagtaaagacattcatgttcagggataggaatacttaatattgttaagatgtcagtactacccaaagtaatctacagattcggcacaatccctagcaaaattccaacagcactccccttttttttgcagttctagaaaagctattcctcaaattcacgtacagttgcaagggccctgagtaaccaaagcagtctttaaatgggacaaaattagaggactcacactccccaatttcagaacctactacagagttatggtaatcaaaccaccatggtacttgcataggaatagacatatagatcaatggaatgggactgaatccagaagtaaacccatacaactgtagccaattgatttttgaccagggaaccacatttattcagtggggaaagatagttcaccaaatggtgctagatttctgcatacaaaagaacaaagttagacccctaccttacaccatgtacaaaaatcaactcaaaattgaaaaacaacttaaatataagagttaaaataccaagactcttagaagaaaacacaggggtaaatctttatgaccttggatttaacagtggattcttagatgtgtcaccaaaagcacaagcaacaaaagaaaaaatagataaatttgacttcatcagactttaaactgtcatgtatcaaaggatattatcaagaaactgaaaagacaatctacagactgggagacgatatttacaaattataaatttgatacaggtttaatttctagaatacgtaaagaactaaaactcagcctgatgcaatgactcacacctgtaatcctagcactttgggaggccgaggtgcatcagatcacttgaggtcagaagttggagaccagcttggccaatatggtgaaaccccatctctattaaaaataaaaaaacaaaaattacccagaaatcgcttgaaccaggagggagaggttgcagtgagccaagatcatgccacgacactccagcctgagaaacagagcaagacgccatccccgtcccccacaaaaaagaactacgactcaacaagcagacaacccagttagaaaatggacaaaagatttgaatagatatttttcaaaagaagataagcacatgaaaagatgctgaaaacattcttagtctttagtgtgatgcaaatcaaaacccttcagacttgctaggatggctttaattaaaaacaaaatagaaactaagtgttggtgaggatgtggagaaattggtcctcatacattgctgtgaatagtagcaatgtaaaatggtgcagctactgtggaaaacaatgtgactgtttcttaaaaagttgaacatagaattaatatatgacccagcaatttctctcctaggtatatgctccaaagaattaaaaacagggactcaacctgatacacatacacaaatgttcattgcagcgatatttgcaatagcccaaaggtggaaacaacccaaatgaccattaacacatgaatggataaacaaaatattggatgtatgcaaaatttaatattattcaatcataaaatggaatgatgttcggatatatgctacagcatgatgaaccctgaaagcattatgctaaatgaaataagccagacacaaaaggacaaatattgtatgatcccatttatgtgaaatatctagggtgggcaaattcatggagacaagaagtagattagaggttaccagggaaagggtgaagggaggaatggggagttattgcttaatggatacagagtttctgtttcaggtgatgaaaaagctttggaaatggtggtgatagttacacaacattgtgaatgtaataaatgtcccagaaatgtaaaacaaaattaaagagctctgttaaaatgaatattcaagacatggactgggagaaaatattcacatttatttggtaaagggttgatatccagcatataaatattttttacagctcaataatgaagacaaacaactgaattttaaactggacaaaagatttgaacagatacttcaaaaaagaagatatgaatgaccaaaatgtacattaaaagtgttcaacaacatgagtcacaagggaaatgcaaatgtgaattacaataagatactcctatacatgaagtacaaccaccagaatttaaaagattaacagcactaaatgttggcaaggttgttgaacaactggaattctcatacattgttgctgggaatgggggtttccacccactttggaaaaatgtctggcagtttcttattgaagtcaacatgcacttatcctgtaatccagcaattctactcatttactaagagaaatttgtcaaaattagtcacaaaaaagcttgtataagcatgtttatagctattttagtcgtaaccaccaaaaattagaaacagcccatgtgtttatctgtagaagaatggacaaaatggaatttatccacaaaatgaactattatttagtgactaaaaggaacgaactaccaatttaagcaataacaggaatttaacaatattatgctgagtaaaagaagcattacacaaaaaaagtgcaagatatgatttcattcacaagaatctctggaaataatctgtggtagaaaaaaaactgaatacttgtaggcacgagggtagggagagattgtctgatgaggtgcataggattactttctagaggaaagtattttatatctttagagtagtttgggctacacagtagatgattgtcagaactcactcgcttaagatctttcctttttttctttttttgtagttgttgttttaagagacagggtctgtttctgtcacacaggccagagtagagtggtatgatcatagctcactgcagccttgaactcctgagctcaagtgatcctcctgcctcagcctcccaaatagccgtggaccaccatgcctggctaatctttaaaaaaaaaattttttttggtggaacataatttctttttttttaaattatactttaagttctagggtacatgtgcacaatgtgcaggtttgttactcatgtatacgtgtgccatgttggtttgctgcacccgttaacttgtcatttacgttaggtatttctcctaatgctgtccctcccgcattcccgcaccccatgacaggccctggtgtgtgatgttcccagccctgtgtccaggtgttctcattgttcaattcccacctatgagtgagaatatgcagtgtttggttttctatccttgcgatagtttgctcagaatgatggtttccagcttcatccatgtccctacaagggacatgaactcatccttttttatggctgcatagtattccatggtgtatatgtgccacatcttcttttttttttttaattttattattattatactttaagttttagggtacatgtgcacaatgtgcaggtttgttacatatgtatacatgtgccatgttggtgtactgaacccattaactcgtcatttagcattaggtatatctcctaatgctatccctcccccctccccccaccccacaacagtccccggtgtgtgttgttccccttcctgtgtccatgtgttctcattgttcaattcccgcctatgagtgagaacatgaggtgtttggttttttgtccttgtgatagtttgctgagaatgatgatttccagtttcatccatgtccctacaaaggacatgaactcatcattttttatggctgcgtagaattccatggtgtatatgtgccaccttttcttaatccagtctgtcgttgttggacgtttgggttggttccaagtctttgctactgtgaatagtgccgcagtaaacatacgtgtgcatgagtctttatagcagtatgatttatagtcctttgggtatatacccagtaatgggatggctgggtcaaatggtatttctagttctagatccctgaggaatcgtcacactgacttgcacaatggttgaactagtttacagtcccaccaacagtgtcaaagtgttcctatttctccacatcctctccagcacctgttgtttcctgactttttaatgatcgccattctaactggtgtgagatggtatctcattgtggttttggtttgcatttctctgatggccagtgatgatgagcattttttcatgtgttttttggctgcataaatgtcttcttttgagaagtgtctgttcatatcctttgcccactttttgatggggttgtttgtttttttcttgtaaatttgtttgagttcattgtagattctggatattagccctttgtcagatgagtaggttgcgaaaattttctcccatgttgtaggttgcctattcactctgatggtagtttcttctgctgtgcagaagctctttagtttaattaggtcccatttgtcaattttggcttttgttgccattgcttttggtgttttagacatgaagtccttgcccatgcctatgtcctgaatggtattgcctaggttttcttctagggtttttatggttttaggtctaacatgtaagtctttaatccatcttgaattaatttttgtataaggtgtaaggaagggatccagtttcagctttctacatatggccagcaccatttatttaatagggaatcctttccccatttcttatttttgtcaggtttgtcaaagaacagatggttgtagatgtgtggtgttatttctgagtgctctgttctgttccattggtctatatctctgttttggtaccagtaacatgttgttttggttactgtagccttgtagtatagtttgaagtcaggtagtgtgatgcctccagctttgttcttttttgcttaggattgtcttggcaatgcgggctctttttcagttccatatgaactttaaagtagttttttccaattctgtgaagaaagtcattggcagcttgatgggtaaaaaaaattttttttagagatgaggtcttgctgtgttgaccaggctggtctcacacccctgggctctagtgatcctcctgcctcggccccccaaagtgctgagatcacatgcatgagctaccgtgcccgggctacatttccatttatgtagattttccatcaaataaaaacttctagttaatgatatgaaagaaaaaaataatcctgagcttcgaagatgatagtcacacagtgacaaaacacctgtatgtttatgggactgttagcactcgccttgggcagttactgcctgatgttttacaatgtacacaccatgtgtgttaataactagtgctgtaagctacatcttgatgtttcttattgcttaattatcaagttgtagactctaagcaagatgcataagaagtggtgcttatggagttttccttctcaagaacttcctctctagtgataaaatcatcagcacccggattggaacactgtacacattcatgaggagaaaagtgctcagcaatagatgtggaaaaatcagtgagcaataaataattccatgtattttcagaaaagaaaaaacgtttataaaatcacatttttctactgatggctattgtaattttatacaatctgatggaaaataaatgtagtggttatcagaaccttctggtgacattccaggttttctctcttgagctctctactgtttctttgacgttcgtggagtgttggcttaaaatttgttttctacactcttaccctggggagattctgcgtcagcgggtctaagatgctgtcataccattagtctttttaattagtgcatcaggcgatttgcatcaaattgtttgggaaatattgcatttagattataagtaaaggcatcagacaagaagtaattcttactggtgaccaataatagcttaaaattcaatataataataaaaacaatagtaacgtaagataatactattgaatatttatgaagcaattaccatattttagttcctcatctaaatgctttttttccattaacttgtttaatcctcacaaaagatggaggtgctgcaattatctcctttcacagatgagaaaacaggtgaaaggataaataatttgcacctcccctttcccccgctaccctaggcacaaaagtagtagatgacagagtcaggctttaaactctgacattctggcctcagagctcttggcttaaccagtgatttacatggctaccgcatgagttacaggcactatggtgtgttcattttgagggttggaaggagtttttctacaaggcagtaatgaggtgtaatcatggcccagtgtctcagtccttcctcttcttatctcctcaccactctctagcactagtggtcttgaactgagtaagagttggaaggctctggcttgagctctgacgtgatcatttgttagcggcaggaaggtgggcatgctgcagcctgtccttactgtgagttaataacactccccctggagtgcagatcatgggaggtgaaagtacccaacagacgccgggtggcctgtcagtcatccttcgcttcttattccatctcactctttgtcactcatcctgcttatttcttttcttttttctgtatttttttttttttttttgagacggagtctcactctgtcaccaggctggagtgtagtggcgcagtctcggcttgctgcaacctccgcctcccgggttcaagcgattctcctgcctcagcctcccgagtatctgggactacaggcatgcgccaccatgcccggctaatttttgtatttttcatagagacagggtttcaccatgttggccatggtggtcttgatctcttgacctcgtgatccacccgccttggcctcccaaaatgctgggattacaggcgtgagccacggcgcctggcccatcctgcttatttcttacatgcataagggactcttctgcttttctcatggtcatctgtttttcttttttaattttagtcttatctacggagttgtttttttctcaactctactttcaattactgcagcatccttagagttgctgttttttcatgtcttgcctcttctgcacttgtgcaacttgttcttgttgcatatatatctgtattaaaaataagtgtttgcaccgtctcccctgacagagaaatcttaccaaaaagttgaacttaaatttggttaaggtaatgaagaagacatggggacattcccattcttaaaggatgcagtcagcaaaatccagactgtgaaactctttactggaccaaagacacagttcttcaactaagaaagaggtgtggagcagtagggagggagagggagagagactgaagtggggactccttcacagatgaaaagagacttaaaagagaattgaaatatgtggactgtatatggatccttattcaaacaaactatttaaaacttgacaattataagacaagtacaatattgagtgctgatacaatgtaaaaattattttaaaactttttaaggtatggtaataatgaaatatttataggtgaaatgacgtatctgagattttgcctcaaaatccttggtgagagcatgtggctaggtgacccaggggtgatactagttgaagctgactaataaaagcatgaggatgaattataccgtattgtatatttatatatttatatatatgtttgaggtttcctgtcataaaaattacacaaaacatgtactcataacctttctccatctacagaatcatccagatttaacaaagcagttctcactttaaaattgattctaaggagtttttatttacctcatattaactatccacttccagcttggcctggaaagattttgttgcagtattttctgacagcattttcctagataagccaacctttttggaagcagttgccttaagcatctgtcaatagaatctgatcagattggttaaattgaatgaattaaactgaggcaaagtcaagtggatgaaaacctcctggtctttcactaaacatctgctcctagtgacaggttcacaaaggtcacttttactgatttacctgagttgaatttgagggagcaggtgcagagacattggcttcttttgtcctgcacctgccttacctcaggtaagtagaaacagctgttgaaagcagaatagcattaccctgtaggtgggtctggaatgatcccaaaaacgcatctctctgtgccgccttatttttaatagctggtatttttgacttggcatcacaaaagaagcgcattagaacatcttaataatgtactaattctttggggttttgactggagtcagttagataatcatgattcattcaagttgctgcactgaatgcaggttacagcctagtgccatgaggtgttcgctggccttttgcttgcctcaaagcaaaagaacaatagcactcaacatgcttggtcccccactgtataactgaatggttcaatttatatctcatgcctgtagcaactgcttttcaataatcacaataaagagtaagggatatatgtgtagagatatatggctggattattcaggtggggagggcctgactatgggggaaggataatgtgaatttcaaagtgtaaatatgtcattgcataattttttgttctgggcatagttacatttatttatattgtttctaaggctttctatctgatagtatgtagaatatgcagtggttacatacttctgtagtcaaatgaagcaactattctactatttgctaaatctgtgtgccttgagataataaatttagcatctccatcctcaattgcctattctgcaaaatgaggataataacagaactaacttcatagagttgtgataaggataaaaatgaagaaatgtatgcagagagctaagcacagtcttgggcatggagtaagtgcacaagaactcacgatactgatgatgatgatgatgatcatgagtaattgtatagtagtatgtgaacaaaaagattgagttgtttcttactagagcaggaattaacattattttatgttaataatgcagtccttgtcgaagcattcaaatggtgtgattataaatggaattataaatacatagaaaagaaatatgtttcatatttttgacatgtaattgtgtgctgagtacattttaatcaaagacagaatgaaattgctgtcaaggatattggtagttcattagcttattgactgcacactaagtatctaaagtgttattttggtgacagcctgatgcattaatttctaggtcagcatattattgacctcaactatttaattctttaaaaaattaccttaactattttttggtcagatattgttttataaaatcagtatatattcaatgaaaattattttctccttaccataccattcagatggtcttcctaaattaacagtggtaaatttaccagtactagaacttggaagaattaacctcttagcctacaccccacatactttttttttttttttttttgctgtgttttaaacatataatggatatttctttatgtggcctcagggagaaacttattaatacttcaaatttttttacaggttttaagtgtaagctgctctggttttataaaagaagtttgagtgatgcttttctttataaaggctacacttctgaatcagagattttccatttgggaagtttgaagaaggtctttcacttcatgttgagtgttacaggtttaacaactgcccccattatagagataatggttaatttctcctctaagttatacacttctaaactttagttttttacaaaaataacacataaaatacaaaatgtggtggctcacacctgcaatcctcagcactttgggaggccaaggcaggaggatattttgagtccatgggttcaagaccagtgtgggcatcatagtgagaccctgtgttttaaaatatatatacagtaggtaagataactgatactggtgaattttcctcagagaataaacaatcttagttttgtcatgtgctcttcagattctttttgtttttgtttttttaatgaaataatatgttacagataaagttgaagttctctatcacctcctaccaggttctcttcacctgctgctctaccagaagtaactgctgccgtgaatctgttgtgtatcttttttctctatgtgtatgttttgtaagtttataatattaaataatggttttatactctcaaatattttgcagctttgctcttttcactcactgttttcttttatggacctatccatatttgtccatatatctgttttacttattttaatagctctatagtattccatcatgtgaatttacaacttactcacctggtaatggatatttgggttgtttccaattacaaacaatgcaattgtaatgaacatttgcacttatttccttttatacacatgtgagagttacttcaggattccttacctataaatgaaattgtgggttaatgaatatgcttattttccactttggtggatattacctaaatgcactcctgtacttctctcagtagtgtatgtttccatttccccatacgcttgctcagctattcatttttagaattcagaatctaaagtgtctatcagaagaatgaactcaaatgccttacatctttgtaggaaagatggacatgaatacagatgcattcattcagtatgttcttatcatcatcatgttgatgatttccagaggagatttcaagatttgcaagtaacatctaacatcaacagtcgtgagaagtctgccatgtctccatctctttagcatggttaaactgccactgtttataatcattcctggaaagaaagggaatggcttcccaaaacaacccttctgcaagcactaccatacccaaaaacatgtccagttgcgtgattactatggcaatatgcatatttcaatagtcactcctgaaagttttgtccctcaactttctttatccagtggcccttttgataaatatcttatttctctctctccactgcagcctctgatatgccaccacttacatctggtctccaacattattaggaatatgtaaaacaaacatataaaaatagcattctgagcaatgactgaaagggaacactgacagataaaattgaagagattgggattggaaatggcttctttttttcttttttttcttttcttttcttttcttttttttttttttttgagatggagtcttgctctgttgccagactggagtgcagtggcgcgatcttggctcactgcagcctccgcctcccaggttcaagcgattctcctgcctcagcctcccgagtagctgagactacaggctccgccaccacacccagctaatttttgtatttttagtaaagacggggtttcaccgtgttggccaagatggtctcgatctcttgacctcatgatccacccaccttggcttcccagagtgctgggattacaggtgtgagccaccacgcctggcctctttttttcttttgaagtcattttatgcaacttaaaaatggggtaggaagaatagataagaaatcttgaccaaaacaaattcgtaagtccaacagttaaatacattcatttgatataaaatgcatatttctgtaattgcttaaatgagtagtttctagtgccaagtaaaataaagaatacttattttaaatcaataatgaaaaccatggtttgagttttttggcttagaaataaatatatatggccatgtttgatttgtaaactcatcaaattaatgtggttcattcacttttcagttaacattccagtttaggattctgtgtaccactgttggaaactgagactaccagatattaccaagttgggggtggaaggtaggagggatcaccgagatgaaagctccctccctccccactccctacctttctcaaaataaatctgtcttctcaaagagagctgtgaccttggaactctgttatgtacaattcaatcagatgaaagtgttcttgggttcggaggatggtttcagaaattattttctacttggacctgtgccttagtctacttggactgctattacaaaatgccttcgaatgagtataaacagcatggatttactactcacagttctggaggctgggaaatctaagatcatggtgccaacagattcagtatctcatgaaggcacgctcttgccttcaaaaatggtcccttctagctgtttattcacatgacagaaggggtgaacaagctttcttgggcttcttttataaggacactagtcccattcctgagggaatagctgtcatgacctaatcaccacccaaaaggccctttaattaaagttgattcacttgtagacatttgttcagaaatgagtaagtcaaatgggacaccacaagaaaagagactgtatttcctgacccccagtaggaatgaattgggcacgagtggaggtagaaagatgcaggctcagatgaagaagtgattagtatgccaagccccttatagcagaggcctcccaatcctgccgcaagccagagtgagaatgaggccacatgtcctggcctcttttgaccttgggaatctagtgggcagccagatgcctcagataacatacatctgtaatatagaaaaaacaagcatcagggaagtcttcctagaaatagctctaattttgtatcttttttccaccaatcttcagttatatattcagataagtctacttttttagtaagggactacaacattatcctaattatataggaaaaagtcttcgtgtatgtgtagaaaaaagactgaattgagataaaataaagtgattattatctctcagtggtgggattaaattatttaaattttatattctatggaatatttacagcaagtgttcattatctttatttcctacagtgaacatgaattacctttcttttcctaagtataaaataattaaaagtacatttatttcattattaattagaaatacatttttaaagtaattaaaatacaataaaaatctatttaagattggattatatgaatgactcagtcaaaggtctgatgaattgataaaggtaaaatttccaattctttggagaaaaccatgaaaatgttgctgccctttagggtacagtcttgttaatcaacagatctttactcatttacttctaggtgtggaaggatggcccagctcctcttgggtgtataattagtttgtgacagctgccttctgtaatgtgggacttcttgggctctttttactgtttttactgaattttgtttcatttgcttccttttacctccctgtctcttgttggtttgtatatgtgtgttcctgttctgcttgtctttatccctctagatactctcctggtccttagttatttagtaaatttcattctgtctgctcattcacgtccctcacctccaaccatgcctcctatgacattgggaattctcgttcttgattgtgtagccgtctccggttgggatactctgaatgagatgtgtaggcatgctagatcatgactggagcagcttctctaaatgtgactgccattgcgacagtggcctcctgcttaggctttccctgggttcttgtcaagaatgagctcgtttttataaggggtattataattctgacgtggccttactcttgactattgatggtaactatttttcttggcatctgaaatcaaagagatggaaacccggtccctccttctaaattctatggattcagtaggattaggaatgcttactgagagtactgataaaccaaacattacttatgtctcatcatgaaaattattgagtaaaataatgttttgtgaagtcaatcatatataaacttttttatttttacatataaaattccctatttaaaataattttatgattaaagcttttataaaataattttcacctaatttgtgttgctcaaaggagcttctgctaagattcaagggctcccagggttttccctgtacagaatattagttctaagaggtatcttgaggatcaccttactaaataccacattttatttgtatagaaatggagagtcagggggctgcgtgacttgctcatgttatatgactaactctagtgaacacaggccaatcaagacacagtttcctaggatcctttttcttctaattcttttttttttttttttttttttgatggagtcttgctctgtcgcccaggctggagtgcagtggcacaatctctgctcactgcaagctctgccttctgggttcaagtgagtctcctgcctcagcctccccagtagctgggactacaggtgcccgccaccacacctggataatttttgtatttttagtagagacggggtttcaccatgttggccaggatggtctcaatctcttgacctcgtgatccacctgcctcggcctcccaaagtgctgagattacaggcttgagccactgcgcccggccctctaattctttagccaccacgccacagtacgtcttgttaatgaggtgttattttcagggcataatttgtcttgttcttgctgcagtggatcttgtgaacagaatgatgctgctttttaaaaccacttactggtaaaataatatttacctggtacaatgctaagcaatttctatgtcattaattttgtttttattctctggttgggtgtggtggctcacgcctgtaatcccataactttgggagcccgaggcaggcagatcaccgaggtaaggagttcgagaccagcctggccaacatggtgaaaaaccatttctactgaaaaatacaaaattagctgggcatggtggcccatgcctataatcccagctacttgggagactgaggcaggagaatcacttgaacccaggaggcagaggttgcagtgagtcaagatcatgccactgtactccaacctgggcgacagagcgaaactccgtctcaaaaaaacatttaaaaaatttttattctcataactctgtgaagttgctactattatcctcattttactgatgaggaaactaaggcaaagaggatctaagcgatctgaccaaggtgacataaatgtttacttttatgaccatgctgtgtctgcttcaagcattgataaaatgctcaatgattagagatgctagcaccctctgttcttactattgtagggaaccattacaattctgcttcaccttctcagtattctagtcttcaactttttacccgtaataacttttattgagagagtttaaaattaaatagcctgtctcctttcgatttatactatatagaatttggcacatagatgctaccttagacattgtgtgtttggctcaatccttattaaaaaaaagggggcaaaaaacataaaattattctaaagctaatttctgaggccaatctgtaaagtgatggagtgaaaaccattttttgatggctcctaccatttaaaagatagtcttccaactgctgtagtgaaatatgtcagtgctaatgattctgctgctttagtaagctgtgagaagcacaaggcttctctcctgatcagtactgtcacatggccgtgttctgatgcagtatgcaaataacagcaccagcatcgtaagtagatattgctagtggcacatcatatatgggctacttgagagaaaaaggctgctgttaaacttaatgatgaggctgagtgtcattaactgtgtgcttattcaaagagtttccccctgaaacatctgttcccctgtcagatatgtcacttttaagcaacacctgtgcagtagtcatttccaagtttcttttcatgcaatcaccttgttttttgctaatggacttcttggtaaaggaggaaaatgcaaactttctttttcaacatcttactgtagtatccctgcctaagtaatgtgctgtagaagttaaaaaaatgaataacatttcttaagggaatgttttataaacacatggtagaatattttatcattggtgtaaatttgtgtcctgagagttaaatactaaaatgaaaaatcattatcctttagttattgcataatttgtaatagtttcagtagcagtcatatactgaaaatcaatgagacgtgtcgtctttcatattcatgacaaggtaatgtccattggagctcatgtattattatatgaacattggagttttctttgaagtctagcgatgattgtctcactggtgcttgctctgtgtgggtgagagagagagaggccaggagaggacaggagaacgggcatgtgtccgagagacagataaacatattaagtagccctttcggtgatgtacatatatgaagatagtatttctgcgactgttgcctccatttgcagagtctgtttttttcctcttggatttttatttaatatttttattcaactataacatatatacaagaaaatgaacaaatcttcagtgtatagtttagtgatattttacaaattggacataactatgtcaccagcactcagattaagaaacagctttagaggccaggcgctgtggctcacacctgtaatcccagcactttgggaggccgaggcgggcagatcacaaggtcaggagatcaagaccatcctggctaacatggtgaaaccctgtctctactaaaaatacaaaaaaaaaataattagccgggcatggtggcgggtgcctgtagtcccagctactcgggagactgaggcaggagaatggtgtgaacctgggaggcagagcttgcagtgagccgagattgcgccactgcactccagcctgggcaagagtgcgagactccatctggaaaaaaaaaaaaaaaaaaaaaagaaaagaaacacagtttttccagcaactcagaaactgggttcttctcttttctttcctagttgttttttgtttgttcgtttgtttttttctgagacagagtctctctctgtcatccaggctggagtaccatggcgcaatctcagctcactgcaacctctgcctcccgggctcaagcaattttcatgcctcagcctcctaagtagctgggaccacaggtgcatgccatcatgcccagctaattttgtatttttagtagagatggggtttcgccatgttggccaggatgatctcaaactcctggtctcaagtgatctgcctgcctcggccagaaactagtttcttatctttcagctgtccgtctacagtaaccactgtccccctgacttctaacactgtggattattactgtctttgtaaatgaccaagttggaaatgttgaactttatctcaagaacctttatttcaaggttttagcagtgaaatgacatcatctgatttgcatttccaaaggatcagtagctgctgtgtggagaataaattgtaggggttcagaatgtaagtggagggaccagagaagaggctacttaaagaaatcacgtggtggattcacacacacacacacacacacacacacacacacacacacacacacacaatgtgtttattgggcctttaataaactgagtttagctatgaggtatgagtaagagagggagacattaatagttcccaggtttatggataaggtacaatgtactgaacatggaagactggaagaggcaactatttgagcaagaagttctggagttccagtttgaacatgttattttgaaatgcctgtgagatatcaaaggggaattcccaagcaggcagttgaatatatggctatatctggagtttgaaaaaggaatctggaatgcagatataaaattgaccattatctacatatagattatatataaaaccataatattggggaaattgcttaaggacagagtgtagagtaaaaacaaatgacaatatggatatggcatacaaaaagggagagatagaaaagcgggagctttccaaaaggcaataacagaagaatggttattggtaaggggggtgacggcaggtcatttgggtggtctaaatgggtgatggttgaagagtgcattgggacagaacccatccaggagagcagccgtatgcttagttgtgatcctagagcttttcccataagtagtaagtcatttttctgtcttctacttgggctgtcactgtattctatagactgaatgacattcattgtaacaggaagttgccagttttttgagggaagatgtgcaagtttgaatatgtgacttcagggtggaaaaatcaaattgtttttagcatatctgcttgccaggcctattcaccaaaaattgatgccaaatgtctacatttgaacagccaaactaaaaacacctctcttctcactctctctgtcactcctgctctctctaacacacaaacgcagacacacacgaacaactttaatggtgaatatcttaatttctgtttcaaagcttttctgaggatgttagtctttgaaatactctctcctttaatcttcccaagcatcattatttggagatgtgttcttgaataaagtgctgctggaattggtaagcacatgttcattactttactcagccttagttcctttgagactttataattgaatattagtaatacatatcattttagaagtgttcagcgatctcgatgttcccttttttagctttgctgctttcacagtgctccttatatatttaccgaagaaggtgagatgattttctgctcctatatgctttagtttgatttctcaatcatgattgcattttctatatacttgaacacagtgcctgaggagaaaattctggtaacaaagatgctgcttctaaatagaaaatgagttttattcagaagtgcttataaccctccctctggaacaaatgaaactgaagcccatgtgcatttgtatcacggagcagagttgggcttgctttgttttttcataataaacataagtccttctgggattagaaattatagtctgaaaagtgactatgcagaagaggattctgggaagatggcagagtagaaagcaccaggaatctgtctccccaactagacaacaaatgcactgacagaacctgtttgatgtaactgttttggaactctgaatctactaaaggtgtacaatttccagtggaaggctaggatggtgaattgtggttatgtttggtccttagcatggtagcagctacacacccctatccctcagccttggggtaggcagccatacacttggtctaagagaagcttgcaggcagcttgcacaatgtagggtgcacaataaggatccagatattggagatgtgggtgctgattgctgcttttgatcaagagctgcaaacaaagtggtgggcaaccattgtttttgtgccctccctgcattgttgcaagcccctcctcctttaactgatgtgagtttcagggaatttaaaggtctagtccagggctgggcatggtggctcatacctataaccccaacactttgggaggccaaggtgggaggattgcttgagctcagaacttcaagaccagcttgggcaacatagcgagaccccatctcataaagaaaaaaaagattcagtccctttttcaccccttcatttttttctatttccattttgggagccagatcctggaaactagggcattccaaagcaactggacacgtatgaggaaagttagaaagtcactacatgtgggtctggcacggtggctcatacctgtaatcccagcactttgggaggctgaagcaggtggattacctgaggtcaggagtttgagaccagcctgaccaacatggagaaaccccatctctactaaaaatacaaaattagacaggtgtggtggcacatgcctgtaatcccagctactcgggaggctgaggcaggaggattgcttgaacccaggaggcggaggttgcggcgagccgagattgcggcattgcactccagcctgggcaacaagagcaaaactccatctcaagaaaaaaaaaaagaaaaaagaaagtcactacatgtggccaggaagacgcacagactcagaaaagatgtgagaggaccttaagtttacacctcaggcagattattgacttagagactgcctatatcaatcaaatcaaatcaaaacaaaacaaaaccaaaagccgcagcaaacccttgggaaggaagaaaatttcatttccagaatcaccgcattattagattcaaatgtccagttttcagccaaaaatcacaagggatacaaagaaacaagaaaatgtgtcccactgaaaggaaaaaataaaaccaacagactgttcctgataaaaatctgatggcctatattttagacaaagactttaagataactgtcgtaaagatgttcatgaactaaaggaagacatgaggaagtcaagaaaacaatgtataaacaaactagaaatattaagaaagagatagacaacctatcaagaagccgaaaataaattttaaagctgaaaaataccgtaactgaaataagaaattcactagagagattcaaagacaattgtgagcaggcagaagaaagaatttgaatttgaaaataggacaatcaaaattatcaagtctgaggaacagaaaaaagaatgaggaaacatgaatggagtataagggacctgtggaaccttacaccatgaaacagatcaacatgtgcattgtggaaattccagaagagagaaaggggcaatgagaatatttgaagagataatggtggaaaacttcccacatttgatgaaagacatgaatgtaaacatcccagaagcccaacgaactctgagtaggatgaactcagagacccacatcgagacacattatcatcaaactgtcgaaacaaaaaaggagtatcttgaaaacggcaagagagaagcaactcttcacatgcaaaggaaccacaatgagattctccacagatctctcctcagaaaccttggagcccagaagccagtgggccaacataaaagaaaaaagaaaaaaacaaaacaacacaaaacaaacccagacagccaaagaacctatatctaacgaaactgttcttcatgagtgagatagaaaataagacattctcggtaaacaaaagctgagggagtttgttaccaccagacttaccctgtaagaaataccaaagagagtcctgcagattggcgtgaaaggacactggacaataacctgaaaccctttgaagaaatacacatctcagtaaagataaaggcatgggaaattattaaagctagtagtatcgtaacaacagattgtaactccactttttgttttctacatgattttagagagtaacgactaacattttttaaaaaggcgattgttagtctaaaagctagtattattataactttggtttgtaactccctgttttgttttctatataatttaagagactaatgcatttaagttttttttttttaatttatgttttcggacacacaacatataaaggtataattttgtaacataagcagttgaaaggagtgaggacagagatttaaaggagcagagtttttgtatgttattagagttaagctgatataaatccaaattagagtgctataagttcaggatattaaatataatttccaatgcaaccacaaagaaaatacatataaaatacacagatgttcctcaacttatgatggggctacttcccaataaacccattgtaagttgaaaatatctacgctgaaaatgcatttaataccctgttaaacccattataaagtcaaaaagttgtaagttgaaccattgtccatacactcctcaacttatgatggggtcatgtccaaataaacccaccatgaagttaaaaattataagttggacattaaaagtcagggaccatttgtatacaaaaggaaatgagaaaggaatttaaacattgtttcaccacaaaaaaaacatctaaacacaaaagaaggcagtaatatggaaaatgagggacaaaacaaataacaaagtggaagaagtaagtcccttcttatcagtcagagtctgacatatactagaacacagaaggaaattctaacaaatgctacaccataaatgaaccttgaggatgttaatattaagagaaaagagccagtcacaaaaagacggattataacagatatataacacattatgcaattataactcatatgaaattatacatacacattataacacatacatgagtacttaaagtagtcaaaatcatagaaacagaaaggaaaatagtgattctcagggattgagagtagacggaattggggagttattgtgtaatgggtatagagttgcaatttggcaagatgaaaaagttctgaagattgatggttggtgatggttgcacaacaatatgaatcattcaatatgtcttaactgtatacttaaaaaatgtttaagatgaccagcctgggcaacatggcgaaaccacgtctctataaaaatataaaatttggccaggcatgatggcatgtgcttgtagtcccagctacttgggagactgaggcaggagaatcgcttgagcccaggaggtagaggctgcagtgagccgagattgtgccactgcactccagtttggatgacagagaccttgtctcaaaacaaaaacaaaattagttaagatgatacattttatgttatatggaacataacgttaaaaaattgaaaaaaatgactatgaagaaaaaaatagtaataaaaacttacaaaagacaaaataaaaaatactcctaggtagtcctccaacaattgtggactaggaggtacgtgtagcagttaagggttaatcaagggaagccaaaccactgtgagccatgggactaagggtttattacaggaatgagagctcccccgtgtgtgaggagctgagtggcggcgggagggccaatggggagttggggcatcagaggagtcagcagccagggagtcagaagctgagcacagcccaccacccgaggtggatgggaatgggaaggtcctggagggccttggggagcatgcctctgtgtggcagctgcttctgtgggtttgctgccaagcacttcttgtgggcaccatgccactgttggtcaatagggtccactggggcagaagagctggacacagaatggagaagagtaaggatgagctgggaacgctgacatccacggctctgtcaccacttctccccataatgaccttcattcagagagcactggctgcagcttcacttttgctccaaaacttgtgcagatttcttctagggccagtattaacccagaaccttaccagcgaagggccttctgggaactccagcataaccatgggcacagaacaaactaccgcaatgtggaatctaaataaatcatataggcttctgaaagttgatttttttttctctaccacttcaaataccagaattattgaatggagacaaaagaaaggttaatgtatttttcactagaaggtaaatgacagtcttgaatatgcagatcaccataataagaattgaattctgtctgtatttatcacatttggatgggcctaaatgtaattacttgaaaatatttaccattgattaaaaatgtcacattttgtttaatataggaattataaatacaaatttaatcaaacaattaaaatgaattccttgctgaatcttgactggttggcaaatgaaaaggtacactgggctagacatcacttgatctagttttaaaagcagttgtgtcataaaccaactatgtgactttgcataaatatttagtttttttatctttagattatttataaaaattaaaaaaatacgtggaaacagtgaagcattttataatcttgagatattacaatgtctttagggaaaaaggtttcctccagttgacaataagttgacttatacaataaacattttaatcctaagtaataatcttctaatgaatagactgcattacatattaaatcaaattccattgtctgtcttaaagtgattgcaatgtgacagttcttattaaaatttaaataatcttatttcttggttatttttctaagaggaattttcatttgtattttccatgaaagtggtggttttgcttcagtcatgagaatatgattcattttgaaccctagaagttgcatccttgggtgtcatgctacactatgattgaatgagtaccagacattagatctgtttcaatgcatttttgaacgttctggctgttcccccttggttgttgctgcatccttttctaataaactatattaaataaaaatgcaaacaccataatttaaaaccctaaagctaaaatcatctgtgatacaatgaatgtgtgtatgtgtggtttatgatatgaaattgtatgtatatgtatctatatatgtgtgcatgtatgtgtgtgtgtgtgtgtgtgtgtgtgtgtgtgtattactcttgttgaatttaagcccctatggtacagaattcaaattacacagagctcagaaatccttctaaacatctagtacaagaagaaaattgggattagggaatcagaattgatgatgggaccaaaaatgggtcagaccgtccaaagaatatatcccagatcagcatcttttcgaattaatccagtgagtctttacttactcgctgtaatttagttttgtaaaccaatgttgttttgctttaaaaggccgctagttacatctaagctattattgcttatgcagtcagtgagatttacttaaatgctttaggtgctttatttaaaatcagcataaaacacagattttattttagtgtggtttttgccttggttttgcttgttattttattttttcagcgttggaaacatatttcaatgctttgagctatagctagaccacccacaaactaggcacagttctgccctcagagcctatacttgtaggaaggaagattatttccctgtgccagggaggttgagaatgcagaggcagagggagcaccttcctaggtaggcctcaggtagtgttaaagaaggcatggtgccaggagggactgagcagcaggtcctatttccttgaagagggtggccttggtcatagtgtactatgagtttagcgggtttgcacctggcattggaataagcccacgggaaaacagtcttactaatacaatgattaaatccactttcacctccccagaagataagcattatttgtagttatctagtcatttctcctacattctcatattctaaattagaaaagcatttgttaatcccagcagtttatgttttgattttgttttcactttatcattcttccttttacttcttatactaatagctctaactgttccttgtcctcatctaatccattgcttcccagatgtctttgaaaagaatgacttgagctactggttaaacatagctttccagacatcttcaatggagaacatgattctgtgggtctgggatggagcctgggaatttgtattcataacaagtacctcaggtagttcttatgggagatgtttaggtaatgctgcctgaccttgagagctcagcgtggcaatgcaacccacctgtgggtagagggccagcttaggaaataaaaatacaggaggctcatgggatatgcctaggctgaaaatagtccattgtttattggaaatttaaatttaactgggtgtcctatctggcaacctttcctgtggagaaaatagattcgtggtgcagaagtagctgttcaaatttgttacctggggccagatagagtctgtctggccaggaattagattagagttctcttggacttcaatgcaggtgttacctcagaccccctctgtgtgccctgatttgctggcttttttgatggagcatggtgttgtgggttaaatagtgtcaccccaaaatacatattttgaaattctaaccctgaatacctcggagcatgagtttatttggagacagggattttcacaggagcacaagttaaaaatgaagtcatttagggtaggctctaatacaatctgattgatgtcctataaaaagcagtaatttgtagacagacacatgcacacagggagaagagcatcatgtgaacatgaaggcagtgatcaaggtgatgcttctactggttaaggaaccccaaagattgccagcaacccacccaaagctagggcagaggcctggaagagattgtctcttacgggccatagaatgaaacacccgtgggcttgcacctctagccttcaacaggaatttctgttgttaaagccaccctgttcgtagtactttgctagggcaaccccagcaaactaatgcatgtaatgcaaactaatagcctttgtagagtagtggtcatgtgccagatactttatatggagtatctaatttgatatttatgataacgagtaagttaggcactattcattaactccatttcatgaatgaaaactaaagctcagtaagagaacatgttgtggtatagtcaaatagtagctacccactaagtagtagaaccaagaatcaagaccaggtccttcagttccaagcactgttttctatacttctagacaagaaagatgcccaccagtgtataacattgcaaaaggctgaatgaggaaaaggaggcgctctgttgagttagattgtcttcttgttgctctagaattctacattttgtttcacacgttaattttgcatatgtgcacatgaatcagtaatctcttatgtgggcagggtgacaccaaaatgcctttgttcatgaattttaccaagaattaaaggaatttgctacaagtaaggttttcacattattacagacattcttatttatgctcttttagttttgcccttagaccagaataaacatggttaaatttaattcctgagttttatgtccttagttcctaacagtttccctaaaagattgctggcaagaaaacctttctgatgcagggaataatacaaattttacctgttcctttctcttgtgtcttccccaacctctgagatttgtgacacagacttttattcctttggattttcactgtgatatttctattccagcattttaacagttaatgtttgcttcatgcgctggaaaggaaggtttctcaccagaggtgatttctggactgcagagtgtgtggctcatgagatttattatttttattgggtggaggagtttctccaggctatttctgtgaatgagagatcaaagtcagatgggatctgacaactttcctctgagaaggaccacccaatagtttgctagttcttgtgtttttccaccacatggtggttgatgtacccaggatccactgccattttgttttgaatgagagtgcatgaagaaatctctatttctgctgttttttgtgtgtttgtttttttaccaattttattattgtttctttcaaattcgtaaaaatttccagtgttcttcctcctcaaaccccctcctcagctttctttttagctaatatttgtttattattccttcatctgaactggagttaaacttgactttgctgcttgggtggggaggtagcaggcttccctggtctgcatcctgggttaaggagccaagactctcttgaaatgaagttggtctcctactttcagcagacgagtacttttatgagggaagtgtagtgtgttggtcaggccttcagttcctaagcaagggtgagacatgcaagagtctagacacatatggggtggagttgatgccctgattctgaaatagctgaatgaggcaagtaatcaagaatgaaatcaaagacaccttgtaaaagccagatagcccagtaagtgagagaccagagttggatgcccaagtgttcaaatagtggaacctgaggatcaaccttactagacatattttttttaactttttcagtgttaatcttttaacagaatcataaagaaggtaatttagctatctattgctatataacaaattacaaatatgcctgaacatatttttttacttagcttactctggtgggtataagattgaatatatggtagtttgtttctactccctcttacagaatttactttctgaattactagcagactttaaaataagatgttgttacatcatatttactgattctccattaaactcttaatccttagctatccaatatgtacatatctaaaagaaatatatcaatttattgtgaattggtttatatgttaaaatcacagattatttatataatggcaaaaaaaaaagaaaacaaaaaaaagtgttgagagcagatatctctgcctattttccagtcttaggagatgtatcagtcagggatctccagagaaatagaaccattgaaccacagttgtttacacacacacacacacacacacacacacacacacacacacacattaccacaaatgtagaagcttaaaacaacccatattttttatctcacagtctctgtgggagtctggcatagcttacctctactcagggtctctcacaagttagtcaatgctgaggtctcatccaaagactcacatggggcaggatctgcttccaaaatcacttatgtggttgttggtaggattcagctccttgtgaactgtagggttgagggcttcagctcctcactggctgctggatggaagcttccctcagtttgtgggcctctccaatatggcagctcacaacatggaaatttaacttcatcaaagccagcaagagagaggacctactgcgagaaatgcatccaaggtcctgccccagctctgtggaaaacacaccccacttctgcagccaacacagcagacaggtttctggccttgcctgagcacaccgcatgggcaggagcagtgtgactccacactgcccaactgattgaaatttctgaggttctctctttccatccatcttcttccaggaggtcaccccagatttatagagtttgtgttggtgatggcttatccctgtaatctcagtgctttgggaagctgaggcagaaggattgattaaggtcaggagttcgagaccagtccagacaacatagtgagatcccatctctaaaaaataataataaataaaaattaattagctgtgggtggtggcacaccacatagtcccaactactcaggaggctgaggcaggaaggattgcttgagcccaggagtttgaggttacattgagctatgattgtgccactgcactccaggctgggtgacaaaacaagactctgtctcttaaaagaaaaacaacaggctgggcatggtggctcacgcctgtgatcccagcactttgggaggccgaggcaggcagatcacgaggccaggagctcgagaccaccctggctaacacagtgaaaccccgtctctactaaaaatacaaaaaaattagctgggcgtggtggcaggcgcctgtagtcccagctactcgggaggctgaggcaggagtgtggcatgaacctgggaggcgcagcttgcagtgagccaggactgtgccactgcactcccgcctgggtgacagagtgagactccatctcaaaaaaaaagaaaaaataaccaaagtttatgttatacccgcatgccattttctcagaaaggtcttgcctgtccactctctctaaaatgcacccaccgccaaacacttccatcttttaatctcttaccgagttttatggtttttttttcatgagaatttatcatgatctgactttattgtgtttatcattttttccttctaccccaccctagctaagtgtagatttcttaagaatttggactggatatattgtttattgctataaccccagagcctagaacagtactctgtacactaagatggtcagtagaaatttgtttttgaatttgtgaatgtctttatggcagagatattaacactacttggatatttctgtactgtcttctaaaatgctactatttaaagtaagttttttaaaatttttgcttctaccgcatagaacataataacagttttctatagctgcacatagcctcccctaagaagctctgtagtaaacatttgaaattttcctgcctttttaacgtgtagattttttcatagctctggtgtcactttgacaaaatttgaatatcagttgtatcactaaggtattgctcacctctaaactcacgtaatatgcctgaacatatttttttacttagtttactatggtgggtataagattgaatatatggtagtttgtttttactccctcttatagaatttactttctgaaatactagcagactttaaaataagatgttcttatatcgtatttactgattctccattaaactcttaatccttagctatccaatatgtacatatctaaaagaaatatataaatttattgtaaattggtttatatgttaaaatcacagattatttatataatggcaaaaaaaaaaaggaagaaagaaaacaaaaagaaatgttgaaagcagatatccctgcctatttcccagtcttaggagatgtatcagtcagagatcttcagagcaacagaaccattgaaccacagttgtttacacacacacacccccacacacacagattttaagaaattgaggaactggctctcacgactgtgggaaccagcaagtctgcaggcttgggcaggctggaaatttcaccaggagtcattgttgcagtcttgagtttgaaggcagaattccttcctcttctctgaactttagtcttttatcttagatccttcagctgattgaaagaggcccacccacattttgggggataatctgctttactcaaactctacagatttagatgttaataacatacaaaaaatttttatgacatctggtctggtgtttgaccaaacaactgggtgccatagtctagccagcttggattaaccacttaaaaattaattatcccaggtaccgtgtgacccagcagtcttactcctggatatttacactagagaaatgaaaacttttgttcacacagaaatatatacatgaatgttcatagcagctttatttgtaatagcctcaaactggaaataacccatatgtctttcaacaagtgaatggataaacaacctgtggtatatccatacagtggagtactactcagtggtaaaaaggagcaggtcttgatatatgcagcaacttaattggatctcaagatccaattatgttgagttaaaaaaaaaagctaatctcaaatgattacatattcctgaggtgacaaaactatagagatagagaaaagattaatgactgctggagtttagagttggggagaataaaggctataaagggatagcctgaggcagttttggggtagtgatggagcagttctgtgtgccgactgtagtaatagttacatgaatctataatgcaataaaatttatagaaccacagtccctttcttcctctaaaagagtgagttcatgatggaaaaactggtagaatccaaataaggcctgtagttaacagaattgtaacaatgccaattttttgttcttgataattgataccatggttacacaagatgatatcattcggggaacctgggtgaagaatgcaagaaaacttcctatttttgcaacttctctgtgagtcagactaattcgaaattttgagttttttggaaggatggaggaagaattgaaaaatctacagatgttagagaagtcactgataaatggcaaataggtgggcagaaggcagaagaaataacaagagtatagcactgaagcgggactgaacactgggggtgcaggtcagtgaggaaaatggtgtattgaaggtccatgtgttgagaagcagtgggcaggaagattggatgcagaggatagtgccctcttagacacctcagttgcttgctcaaggcatttgaaaacttaccttcagtggggaaaattgggagtgttcatgggattcttcactaaatgaggatccatcacaatttaaaaagacatttatattttaggtttaataaatgaatccaaaaaggctatcactaagcatctgattgtattgcttctaccatctcctttctatcaattattaccagttcttccttaaaagaaaggtctcactgtgtataaaactaccttaggactaaagtataccaaaacaataacaaaaaaagacaagatcgggcgcagtggcttgaaaggctgttcttaataatgttgttactgaagtattataaaagcattcgttcatttgtctttttgtttgtttttgtttttgttttgagatggagtttcactcttgttgcccaggctgaagtgcaatggcatggtcttggctcactgcaaccttcacctcccgggttcaagcgattctcctgtctcagcctcccaagtagctgggattacaggcacacatcaccacgcccagctgatttttgtatttgtagtagagatgtggtttcaccatgttggccaggctgatcttgaactcctgacctcaggtgatccgcccgcctcggcctcccaaagtgctgggattacagacatgagccactgcacctgaccttgcctttttttattattgttttggtatactttagtcctagttttatacacagtgagacctttcttttaaggaagaactggtaataattgatagaaaggagatggtagaagcaatacaatcagatgcttagtgatagcctttttgtattcatttattaaactaacaagtaaaagtgtataatacaaagtatacttgttctgtgattgcttatggttatatttatatcacacatttttcttttttatttcagtaggtttctggggaacagatggtatttggttatatgaataagctctttagtggtgatttctgagatttcggtgcacctgtacactatacccagtgtgtaaatttttttccctcactcccatcccaccctttcccctgagtccccaaagtccattgtatcattcttaagcctttgcattctcataggttagcttccacatatgagtgagaacatacagtatcacatgtatttttgaaagattaaatatacttgctgttttctgaatgtttgtgtccctccaaaattcatacattgaaacctaatgactaagatgatagtattaaggaatggatcctttgtgggatgattaagtcatgagagcagaaccctcatgagtgggattagagaccctatgaaaggggcctaagactctactaaaaatacaaaagaattggctgggtatggtggcacatgcctgtggtcctagctactcaggtggttgaggcataagaattgttttagcctgggaggtggaggttgcagtgagctgagatcacgccactgcactccagccagggcgacagcccaagactctgtttcggggggaaaagaggcgtaagagagctacctagcccttattgcccttctgccatgtgaggacacagagaagcctccatctatgaggaacaggtgctcaccagacaccaaatctgctggcacattggtctttggcttccaagctaacagaattgtaagcaataaatttctattatttcttaattacccagtctaaggtattttattatagcagcccaaatggactacagcaataccattcaactatcacaaactttacctgttttaagacatagttgcaaaatggttatttttaaaaaagaaaatgagaatcataataaccttgaatttcgttagaagatatttttatgagtttgtgatatttggggggctatattccagtaaacaagtctgcctgcttccttccgattggaagctgtaacacatgctcattcttgtacatcacaaaaagcatgaagaagaataaaacatacacattctatgattctacctagatgtaaggactgtacaattttgtgtgttcttctaaacatttttaaggcatataaatacatgttgtttggttttgattttaggctggagttgataattctcttacttccgcttctcagtttctttacttactcatattcctatgcctaaatttaatttgcacatgggaggctatgtaaaatgatgcttcctgatggggcattaagaaaacactgatcaattcatcttccttgtgtttgtccctataagatgctgaggtgagcaagaatgcctgcatttagtgttcatgggcatttccaccctccagtattggccaacagcaatattgtgcttatcatatcctggaattcctcacttcttcagtcaaaacaaagtgttctcactacagaagaggttctgattaaatatgcgtgcttaatgatggaagtggttttccgtgagaactcagcaaaaactaatacatcaatagtcatgtgggttactgcagggaaacagaaacagagtattaaaggggacagaattagccaggatgtgactcaagtcaggatggggtctacagcatcattagctcctatccattttgaaaagaggaaggataactgataggtattagaactgggcactaggcactacagaacactgtagacttttcttcattattcacagtagatttaaatcacgatcagagacattgctatatccacaccatatttgtttgctaaatttatgatttaattatttgcacatctcttttctgggatgaaggaatgaagactgctcattttgtttcttttgtttaatacttaagttctggggtacgtgtgcagaacatgcagttttgttacataggtatacatgtgccatggtggtttgctgcacccatcaacctgtgacctacattaggtatttctcctaatgctatccctcccctagccccccactcccacttacgagtaagaatatgcggtgtttggttttctgttcttgtgataatttgctgagaatgatggtttccagcttcatccatgtccctgcaaaggacatgaactcattttgtttcttatgtgggtgttcatttggtattagcaatttataatcctgtacaatgggcatgattggtatttttttggctgcccagcaccttttgaacaccttactataatctgggggaatttccaaccttacgagaaccatcctcccacaatagaactcagagaactaatctgctttgcacctagggcacaagaatgtaacctagattccaccaacaaacctaagttctgaaatgagcaatttgaggagagaggctctgcttagattccaggtttgctagccagagtggtggtagtggcatctggctcttaggggtggtcgtgtttacagtgttgaattcttggtgcagctgaaaacagtgacagttttctcattaagcctattttgtgctggattggggattgttcctagaagcttagtattgagcctcattcttaatatccttttaataaactcctttcctgtatgattactcagaaccagctgctgttgcttatgactaagtagttgaaagatcaattctcagttagcactgtgaagcatctcttttggtctgactgtgttttgggtgagggcaaaggacagggtctgagctcaaaagttgaataatgtcatttctagaacgagacctgaaaatgtacgcctacaagtaagaagtgcagactgagttaaaaataaaggttttatgagaaataggagcccaccataggaaaaagtaactccaagatgagacgaggatagggatcaaagtcagtgaagtgaatagaataatcagactcatgcttgactgacaagttgaaatccgtgtgatttttgtcttggcattagaaaattttatattgcaatactattctttgattcccacttccctttgtcatatttccaagattgtaaatcttaaaatagtttcaaagaatcagattctttgttcactgtatacagaattaactaaatcaaaatcatgtttattgtttttaggattatatactgccatccacaattctatttagttagtattaaaataataatgctaattttctaattgtttgtgggctgtatgcccaagaaagcatttacaatgaaaaaaattcttccgggagctgtgaacctaagaaatcattattcaaatactcttagtttagtagactgattggcatattgaaacattcacttaccctttatatagagagatactggcccagtcattttggaatatggcagtcaggaagcagtgttaccttaacaatatggccctaactgctaaatgtgcatgtctttcttgagattcagatggttctgatggttaaagcccctctcctagatatgtaactgaaagttttctctttagatttttatattagataaaaaaagcttccatttatcaagggtcaactgggtgcagtcattgtttggatgctttacataatttatctttgagccgtacacaccccagccagccaggttgttacacctgtctttaaaaaaaataataaactggcaaggcacggtggctcatgcctgtaatctcagcactttgggaggccgaggtgggcggatcacgaggtcaagagatcaagaccaacctggccaacatggtgtaactccatctttactaaaaatacaaaaattagctgggcatggtggcgtgcgcctgtagtcccagctactctggaggctgaggcaggagaatcgcttgaacccagggtacagaggttgcagtgagccaagtgcaccactgcactccaccctgggaggctgagcaagactccgtctcaaaataaataaataaataaaccaaacaaacaaatgaactaaggctcgagaggttacatgacttgctcctggctatccaggtttattttaagttgatgtttcagagcaattttgtaacctaaggtacttttcttaggaattttaatagttacctattcccaacctcatctcagtgtctaagtagaatggtcctgtggtgcatcctagtttctatcaaccctcagcctctggcccagctctgtggcttgatttcacaggcttttagcaactggcagtaactactaagaatcacttcatttcattgcctattggtgatgtaatttctcagatttgggctttactttctgtagttcttattcttcctacttggccaaaacagcaaatgagtaagagaatgccatgtggaaaatttaaaccctccctccgtagtttctcaacaattgcagttatctctactattttcttttaggaaggaagaataagttaaacttttcttctcaggttgagggatgccaggcctgatttgcagttactttagcggccttagtttatttgtgtgctgtaactgtcaatgaagtacctcagatggtcctgggctgtcttcttaaaagcgcagaatgatttgaataaagtgtagtgggatacgcgaacaaaattcaaactggttttgtgataaaggcatacattctgagccaatgccagagaaaagaaccatctcaaacttatttgaaccccatggtactatttttggaacaaatctcgtgttcgaataaatcactgccccatcagcattcagagggtctactgcacttccataatgaatcacatattcaaagtcagacacgaaaggaatcattgtaaagggtttttgacattttaggctacaaagaaatcctggttttgaaatttttctttcttcaccctcttacagtattcctgattgctgggaagtttggaaggggtaggagaggaacatgagaaaacaatgaactcacctaagacgcataggagccataaagaggggacagtatctaaattaagattttaagccattgtacatctagtaggatagatacgtgtatgggtgtgtgtactattttgtgacaaataacaggcaagctgctgctgctgtggtgaatgaatgggaaaggtaaactgaggggtgcttactttccctatgcattgcaatcattattaagctttaatcgagtcaaacgactcgtgtgtttcacccaaaacaacaatcttcagtttataagatctgacttagaaccgggatgagaacagagacatagaagtttgtatctgtagttatttaagtggtaacccatcacttgggaagcttttgttcattgcaaaaagtttgttttaatgagtccatataatacacagaaatttccataatttaccaaatgatttataatttaaactgcatctgtatatcctttgagatgatctattaaaatgaatgaatagctcaagttatgtttaaggcataggtcataagtttatttaagaattagtcataagagtatttattaggagggatggtatttgactcaaatactttgaaaacctagaagtcatagaagaaagataaagtgattttaaaaggtatttgggggagaaaagcatctgcatataaagtcttctctctctctctctttttttctttggtagaaacagggtcttgccatgttgcccaggctggtcttgaactcctgggctcaagcaatcctccagcctccgcctcccaaagtgtgggggttataggcacgagccaccatgcccagcctacatataactcttgggtacaggtatacctccttttattgcactttgctttattttgctttgtagatattgtaagttttttcctaaattgaaggtttgtgtcaaccgtgcttcaagcaattctctcagcaccgttttttccaacagcttgtgctaactttgtgtctctgtgccacattttggtatgtctcacaatatttcacatgttttcactattatatttattatggtgatctgtgatcaatgatctttgaggttactattataattgttttgagatgccacggactatgcccatatgagatggtgaacttaattggtaaatggtatgtgttctgactgttcccccaccagccattcatctccctctctctgtctgtctttcttccagcctccctattgcctgactcacaacaatattgacattgacttagaggcctacaaaggcctctaagtgttcaagtgagaggaggggctgcatgtctctcactttttgtcaaaagctagaaatgggcaggcatggcggcacacgcctgtaatctagcaatttgtgaggctgaggtgggtggattgcttgacctcaggagttcaagactagcctgggcaacatggtgaaaccctgcctctacaaaaatacaaaagattatccaggtgtggtggtgcgtacctgtagacctagctaccagggaggctgaagtgggaggattgcttgagtccaaggggcggaggttgcagtgagctgagatcacactactgcactccagcctgggtggcagagtaagaccctgtctctagaaatgattaagcttagtaaggaaggcgtgtcaaaagccaaggcaggctgaaagctgggtctcttgtaccattggtcatgttgtgaatgcaaaagaggttattgagggaaattaaaagtgctactccagtgaacacacaaatgataagaaagtgaaacagccttattgctgatatgaagaaagtttgagtggtctagatagagttagccaggtgtggtggtgtgtacccatagacctagctactagggatgctgaagtgggaggattgcttgagcccagggtgcaaaggttgcagtgagctgagatcacaccactgcactccagcctgagcgacagagtaagaccctgtctctagaaatgattaagcttagtaaggaaggcatgtcaaaagccggcaggctgaaagctgggtctcttataccgttgggtcatgttgtgaatgcaaaagagaagttattgagggaaattaaaagtgctactccaatgaacacacaaatgataagaaagtgaaacaaccttattgctgatatgaagaaagtttgagtggtctagatagacgatcaaaccaaccataacattctcttaagctaaagtctaatccagagcaaagccctaactctgttcaattctgtgaaggctgagagagatgagcaagctgcagaagaaaagtttgaagctagcagaggttgattcatgaggtttaaggaaagaagccatctccataacataaaagtgcagggtgaagcagcaaatgctgatgaagaaattgcagcaattatccagaaggtctaagaccatcgatgaaggcgcctatgctaaacaacagattttcaatatagatgaaacagccttctattgagagaagatgccatctcggacttttgtttaaatggcaacaaaggattttgagtattacataaacttagttgctaaggcagccagcagggtttgagaggattgactccaatttgaaaagcagttctgttgtgggtaaaatgctcatgctacagagaatcttttgtggaaggaagaatcaaccaatacagcaaactttattgctgccttccttgaagaaattgccatgggcatcccaaccttcaccaaccaccaccttgatcaggcagcaaccatcaacattggagtcaagacctttcaccagcaaaaaaaaattacgactccctgaagtctcagacgatcgttagcattttgtagcaataaagtattttaaaatcaaggtatgtacactttttcagacatgatactattgcatacttaagagaccacagcataaaaataacttttagatgcactgggaaaccaaacaatttgtgtgactcattttattgtgctatttgctttattgcactttttcccttattgcagtagactttgtcatgtgaaataattaactctctggcttatattataaattctatgttagtgatgtttaggaatgtacttactatagaatatactgttataagagtagagaaataacaataccttgcttaataaactattaaggtgaacttattttacatttttacttctcagtgagaatacatctgataatttagggaatttagtgattatgtaaaagcattttattgttttttccttagtagtgcattttttaaaaagacatgttttacattgttggtatcttggattccagaaaatatagaaatcttcttttaaatagacttaccgataaatgatactaatgataacacataggaagatactagaacctctatcaatagtcaaaatatcaagccaaagatattagttacagagtactgtgacattttcaacactattatcaattttgttcctctcttttatgattgagtgatactccatctaaaaatgggggaagacattaatcctcattatctagacttaaatgaaagtcttgacaagttccaacatattttttctataagatttttagaaaaataaattggtacatctttcaagatattacacagagctctgttaataacctgaggatggttttctgaagatgatattgttagcttggaacaatattgccttttatttagtaaacaatgaaaaacatacaaaggatattgatacatgacatcagtatgggagaaattgatggcatcaagagaataaaagaatctatggaaattcgctgcagaagggttggtaaaaaatctaactatatggtatgttgaactctatagttgtttacataaagaatttggactggacactgacccagcaggaaaaaataatctggtcagtacacttatttatgtcaaggatatgttgatcttgtaagagttaacattactttgggggcatataaatattgagaaatcattctaatattacactgtggagaaattcagtgaaaatggttaaaaaaagagacttcaggaaaattaaaataagttgaaattgtttgatttggacagaagaatcaaaagattaggagttacaaggagaagaggcacagctgttctctatttctgtgaaaacagagtaaaaataaatgcatattcatgagaatggaaaatatgcaggttggttattggaacagtaccagaaagaagaaggggcatcttaccttggaaattttgaatgcaatatataattgcatctgataaaaactgtatgtactcattcgatacgtatgcattgaatgtcttccatagaaaagcctaatattaagtgttgattcctgtttgaatataagaaactaaaccagggacttgatagaaggtgtccatcatagttctgtgacttttatgaacatagtgggctaagtgagacttcttgagaaatggaaaatcaatttcataccctttcagtaggtaatataccaagatgtttctatatatttatatatatatgtttatgtatatttacatatatatttttatatatatatatagagagagagagacatgaatagaatggctctatagagttagtcaccctttggtatcaattaagctgcccatatctaaatgtcttttgaccattccttaagaaatgtcaagagaaataagagaaagttagtaatgctgctcatattttctttgtcattatttacagtgtattatgcatacagtgtaatccatcagccaactttaatttcgtaagctattcattgtgtttaaacagcgcctttcttatattaaatatttatggcagtctttgggaagaatacattaaaatagcagatgggggtcgttttaaacatttccttgattgaaggcaggggacccccttgtgaatttatagtctgctttcaaagaaagttcacaatgtctgataacccaaggaggcaagaattccaccaattcccagcactgtgatttcaaaaagcaatggctgcaaacagtcttcatgcttcagcacctcctattttgaaactgttagcaagagcagtgaagaacggtgaacaaaaccgtttacagttgtattgcctattaataatgcaataggagtacacctcttttgcattaatattactttttaatcgatttttaaccatagtagcaaaaataagtggaaagtcaaacctttgacctgcggtggacaggaagatgtatcctagactctggaattctgattctggaatttaaaagatgtttggggaattatgtcctaggaaacgttttctaaaacaggaatgtgcttttttgctttatattttctatttgccttggtaactaagaagtctgaatccaggaataatgtttttttttcccccaaagtagtctcttctcctggtttaagcttataaacactatacatctttaattatattattttctttagtagttatcttgacctttaggagtgttactgaatataaaaattattctatcagtttttattaaaatcttagattattagactgtataatttgacttcattatcatttgataattgagatgtttcttaaacagtcttactctgttttttctaagcaaacagcttgcatttgatgcaaaagggaaatgttttgtctctgaaaaatcttatgtagctttaaccaactatttcattaatgtttggtgagagctctgatagtttcaggccagggaaactatgactcttgtagtacttaagacacttgccaatcaatagtaaccatcctcagctgatggagtgatcgttttacaatcacatagaatgtaaaggtatcatggaagggggaaggtgccacgggcaggctggtaatatcagagtctctttaaacttatattttgcaagtaattgttcaatagttcttcatgggatgtgaagaaactagttttctagtggtaaaaattgtatacctttgtttttaaaaatgttttattatgtgcagtgattgtaatatcacatttaaacatagcccaggagtttttcacagatgtgctctcaaggatctgtgaatcacctgaaatatcaaacccatgttgtatgtagcttgtttttggaagggtatccttagcttccatcagtatcaaaggggatctctaatcccaaaaccttaagctgatctgatctaagatctttattttctagatgaagaatctgagatctgacaaaatcaagtgactaatttaaagtaagacagtattgaaagaactacaattaaaatcgtttattctactggagattgtccatgaggtttacaatattcttttttttttttttttttttcatttttgttagagacaggatcttgctatgttgcccaggctggccttgaactcctagcctcaaaccatcctcccaccttagcctcctgagctgctgggattatagacatgagccactgtgtccagttctccagtattcttttataagttagatgttaatactgtagaattgaaaaaaattatgaacctttttcatacacaaatctattcaactcaaaatacttacgaagtcgagtcctggattcataatatctcagcatattgttttgagttccatctgagcttgaggatgatatctataaagccagccaatattaattacatcttcaagtgaaagtacattacccgcctccctgcagttttaaccctatacagtggaagtgtagcctttccttcttccaggaattgttagcataaatcctgacagttccagacagtatggaaggatcccagtagatagggaaaagatccccactcgaaggtccaagcctagtgggatacctttcctgggcacatggtgccaagagatgacttaaatatctacaaccacttgtcagctcagtttttttggggactactccaggtcttccctggggaagggacacatattcttcctggtaataaagattaaccttgggggcaaggatagcattttcctctgcagcacaacgtaggagtaaatggaagggaaaacccaggaaagcagaggtgttccctcacagaggcagtggtagaaaaagtaaggtagaaaaaagcagtaagacagggatgtttggacaaggcactcattcataagaaaggaatgatagcagattggatgttttttgtttatgccttatgtatttgacgttactgccagtgatttttgccttacatctgaccttttttaacgttcaaaagtgtcaaaatagattttgttgttgttgcagttttgtaatgggcgggtgtattattatcaggatggaggctgatttattcttttaattttattttttgctggctgacacctgaagatctactagctctctgcctctacggtcaaagtgtgttcttccccactgacagttgggctgctgatggctccttttaattcccatcagctgagggctgactcagtcaacatcttctccccatcctggaccccaaagaatacaaggaaaaaaggctcagagacttagcacattatttttgttttaagatgtcagcacctgatgtattattttagtgcttgtttaaatattctgaaactgtgttttcttttttcctttaatttaaatttgtcttcataaagttggcttacaagaacatttctttatcaagtttatctggattttctgggtcaaaagtataagtgatttctggacttttcttgacaaaaagtaccaagaaaagctgcattaaaacaacaaatctaattttaaaaacacttagtgagctaaaacgcagactcaaaccaaactaatgaaagctatttaagagaagtcagttgaagtagtttccagaatttatttcattgttttttcaactctttgttaacaccataaacgtgaattaaaaaaaaaaaaattaacttgtttttgaactctataaaaagtatttttttttcttttaattaacttcattgttttttaaagccctgccaagctctatttctgtgcttgggtagttcccatttgcaaatagggcaatttctgcatataggtctgaacaggctatgccacaattatcctttttattgtaactttactgtcaaagaagtagtttttgtctccaaatggaaattccagagtaattcaaatgccttagtaaacataatgtcatttcgtatttccaaaggcaatggccgctggtccagtaaacaaaacccatgtcgaaacctggagtggacccacatcccctcattgttactttagtatctttcataataatgacagttgctaggatttgttttttaccaagtgccaggaagagtgggaagtgtttatatggattatctcatttaatgtttacattaactttatgaggtacaggtattatgtgtatttttttttttttttgagacaagagtctcgctctgttgcccaggctggagtacagtgacatgatctcagctcactgcagcctctgcctcccaagttcaagcaattctgctgcctcagcctcccgagtagctggaactacaggcacctgccaccgcgcccggctaatttttgtatttttagtagagacggggtttcaccatgttggccaagatggtctcgatctcctgacctcatgatccgcccgcctcggcctcccaaaatgctgggattacaggcgtgagccaccgcgcccggctgcgtatcttaatctcatagaccaggaaacctaagctcagagaccagtaattaagctgccttggctacctagctagtaaacagtagaaccagaattctaacccagactgactaaagcttagcctaactgcatcactgttttatactgacatatgggatgtacatttaatgatatatatgcaatagttttctagttataattcatctttaaagtcacttgagcttggaaaagttgctacatatcataattggcctcgtgccagacaccaggccctgtgctatgttctctactggtaaatttgctgtcattgaatggtaagaatccagtgtcaccatacaattttacaaataagacataggagatattaatgtcctcatcgtcattgcctggtaagaggcagagtcaggggagtttcgctactaacaaaactattctcctggtgctgaataagaactacttgaacaagctacacaaaaggattaaagcgcaattaagttctttccaaaaatgtgtggtggcatttgtctccgtggcatgtgattatctttagaacacattctaaagatgatttccaactcacagtaatattgggaaaaaaaatttggaaaacatttgcccttcctaaaaggtgaaacatttgaagtattttcctttctgcctcatgcctttccttcctttagcaaacattaattgagaacttattatgtgctgtagtcactgtgctgtttgtacctaaatgaataaaacacagctccttacccgaaagaacctgaaaatatttttcgagcaactgtcatttcgtgcttgctttgaagtttatgaattaaggagtagaaattcagaaactcttcagtcgattgattttacagtataggttatcttcatatatttaatacacatctcaaatgtcaagttctttctctctgcgttagtgcccacacagaaccataaaatcttgcctttgtatcatatgcttatctctcccagttctttatttctttcaaccgtagtggtaaatctatatatcatggtgacacattaatcatttctaagctatttttaagaaactggagtctgtattcctttttgggatcaataattgggataaatgaaataatagtgtgagaacaaaatttaaggaggagattttaaaagtttctctgaaagtctaaaattattttctttcttgttttaaggattttgataactaaatatatataagttgttgttgtgttctcttatgaacccaccgagtgtttctcaaagttggagtgtcaggatcactggggcacacagttttggacaccatgctggacctacctaattagaatcgtgtccacccacgttcccatttgaagttgtaacatactttattggcaattctgaagcacagtagcacttcagacccatttttcctatcgattttatttatatataagcataaacagaagaaactttggtgtgggtaaaaaagaaactacaaagggattcctgctgactcatgagccctaagcctccttagatttctgttaattgagttgagacaatgccctttcccaaaacctctttccttaacagaagggaatttctacaatggttctaaactaggatggcgccagagtcccctaacaccaaattccagagtcctaaaaactttccgtttttagagaatatgatttccttgccaacaccaaaaatgtttccctaaagaaaaatgagggagaggatattatctacctagttccaaagagaacctttttactgatgaaatcatataagcctcatagaaccctcctaggggaacccagcaaacaatattagcttttattatatgtttgctatggagccaaggacctgtactagatgttttttgtgttattgaatttgattgttattgtatttagtagcctactgagatagttattatttatcctcaggtcaattaagtaacttgtccagacattgagttaatcaatgaaggagccaggaatcaaaccctggttggcagaatttcaaaactgtcttcccaaggagagaaaaaatggaatatagtgcttccccctctgaatcacaaaaactccatctcaggaagccaccattagcagtgtagcatgaaggaaaaggagtttcttcagccatcgtaaagaaagagaatcatctcctttctgaatttaagtatttaccttacccatgagaaaacaataccctttgcttcagggcaataagataattgttttggtttcaaaggtctttccttctggctcctactggattaaaataaacaaaggtgatgtttatgtcaacaatgttatttagccaaataggtggcactgtcagtgtgaaagctagatggtagttgactctaagaaagggatgagatagttattaactaaaaggagagactcaaaattaagaatgcctctgcaactgcaactttagcacatttgcctgaatgttataatgtattcactgtaaagtctagaaaccttataaatatatgactggcagttgcctcaggcagaaatcttttactgatgcaatgagataaaagtaattaagctacatgtagactgatgggtaattaaatccatgtgaagcattttgtaactaattgctatgttctaatcacagattgctttctatttgtcaaggtaagtgtatataattacaccgtccttattttctttaatctgaaatcatcctagttgggtgaatgtttttaagcaccctgaatcttagaatatttggtacatttcttgcataaaggtaatttgcatattttgtaatttaaggacgttttatagtaaaatagcttttagtgtcactaagaattctgtggtcaatagagatttctaatctaggctcattgttcattgtttaatcttttttttttttttaaatagtaaaaggttatgttatttactaatgccggtaacattcaaggcattatatatatatggactgtggtccttatcacagtagttagaaaagaccaaggatcagtaaagggattcaaaatagatttcgattgacacaggttgtaaaacaaataaacagctttgagggctcaagagtctcagattgagagagcaatatgattgaaggcatggctggatctccttgacgggttatagctggtaagacaagggcatttctagaatcaggggactagagtggatttcatctactctaagtggaagtagaaatgtggatgtagacatccatttaaagccaagttttcaaatacaagtcacctttgctgcttggtgacactagacagtgctacagatgtcttattcatctttgtgcttttagcatggtgcccagcacctggagctcactcaggtaatatttgtgttattgccatgagtaacatgtagaccaataatgaatcaacagatcattttctgcagattatcatcatttgtggccttctgtttctcattttcttagttgtgtagtctgttttctgaccttcagggcatattataaagtcactgcattaacaaaaaaaaagtcctaggtaggcatggtggttcatgcctataatcccagcactttgggaggctgagacagaaggaacacttgagcccaggagttcaagaccaggcatggcaacgtagtgacaccccatctctacaaaaactgaaaaaaaattagctggacatagtgggatgcccctgtagtcccagctactcgggaggctgaggcaggaggatacttgagcctgggaggtcaaagctctgcagtgaactatgatcacgccactgtactccagcctgtgcaagagagagagagaccttgtcgcaaagaaacaaagcaaaaccctgtacttaattacttaattccgccttatacatttttttttttttttttgagttgaagtctctgtcacccaggccggagttcaatggcgcagtctcggctcactgcaacctctggctactgggttcaagcgattctcttgcctcagcctcctgagtatctgggactacaggcacgtgccaacacacccagctaatttttgtacttttagtagagacggggttacaccatgttggccaggctagtcttgaactcgtgacctcaagatccgcctgccttggcctcccaaagtgttgggattacaggtgtgagccaccatgcctggcctgtacatactttttattacatcaaatgtttcacatcattttttattgctaatgacttttaatagctttgtaatttataatgaacttttagccttctctaagtggaaattattatgataggcatagtttactaaggctgaattgtaatatatttctttggaaaccagatccttactccctcattcttctcatttttgttgagcaattaaagttgccctgtatggtgtggaaaattagacttttttttttttttggagacatactttcactctgttgcccaggctagagtgctgtggtgcagtcttggctcactgtaacctctgccttctgggttcaagagattcttgcgcctcaagcctcctgagtagctgggcttataggcatgcacctccacacgcagctaatttttgtacttttagtagagacagggttttgccatattggccagactggtctcgaactcctgacctcaagtgatccacctgcctcggcctcccaaagtgttgggattacaggtatgagccaccatgcccggccaaaattagacttttttaaaaaatagaaacaggatcttgctacatagcccaggctggtctacaactcctgcgctcaagcgatcctccccctttggcctcccgaagagctaggattacaggcatatggattcctcttctgctcactgcacaccagacctgcttccccacactcttggtgtaagagtgccagcctgccagccatcagattttttctttcctcggagacaaatgttatgttgatttcttcacactgctgcaccttgtcccatagcttctcctttgtattagtgtagatatataataatgaatagaaatgtaatgcattttatctttactgtatctaactttaacacctcaaaaacatagaataattattcttttctaatgcctgctgacaatattatcttcacatctttctgtttgtggttatgccgacctatcttataaatttatttaacttaaagcttttctgtacatttttttaaaaaaattctgtgtcacagtgtctcataatttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcccatttttttttttatatatcccttggggaacttcacatggggcttggtgacaactacttactaaataccacttgctgatgacaatggcagtactatgacacgcttcaggatgtggtctttgagtttctaattgcaaatacaggcattatcttttttatgtagtgtgtgaggcttcttatttaaagaaaaatgtgttcatttgatggatttttaaaaataggtgataattttagaagcaccataacagtagccactttaaatcaggaaactttgactccgtgctgaggaaataggttcttgatttacattagacaaagagtatgttggccctgccttacttaaatttcacctgaagctcctagagtctgttggttaccagaggtttcacgtattctgagtcctttgccctgataacccgtactctgccttcattttcttccttgtttgcttttattgtataaaaatcccagagttacagaagtgttacaaaaacagtaataagagtacatttacccttcttcaagtgttttttttctctctttcttttcttttttttaaagacagtgtttcactctgtcccccaggtgggagtgtagtagcacagtcacagctcactgcagccttgacctccctggctcaagccatcctcctacttcagctcctgggctgggactacaggtgtgtaccaccacacccagctaatttatttgtattttttgtagaaatggggtttcgccatgttgcccaggctggtctcaaaccaactgggatcaagtgatcatccctccttggcctcccaaagtgctggaattacaggcatgagccaccacacctggctttaaatgtttctattttaacatgacattatataactatcaataccagaaacttaacgttggtaaaatactattatgtaatctgcagaccctatccaaatttcacccattgtttcactaactttctttttctggtcccaggtccatctaggatcccacattacatgtggttaccaagtctcctcagtctcttcacttccaatctgggccaggtctcctgtctttgtcttttataaccgtaatatttttgaaatgtgctggtcaattattttatagcacctctctcactttaagtttgtctggtatttccatgtgattaaattcaggttatgcatttttggcaagagtaccactgaagtgattgatacgcacttttcagagcatcaaggtacatgatgttaagattctcattactggtgggtttgatttttattacatagttaaggtgatgcaaaatttctccactgtgaggtggttttttttttttttcattttaattaataagtgtcttatgggggaaatgcttaaaaactgtaaatatcttccttctgcccactaagtttagcatccatggatgatccttgcctctgacaattattacttgtggtgtttgccagatgttgattttcctatcttaccttttacattcagtaattaaaattatattatatggaagacctctgctttttcctccatttattttttgaaataccttttctgttttggactcatggatatttattttgttctatactttaaattctactactgtcattatttattctgttgatcagattgtcccagattggccattgagagcttcttcagtttgactcctttgttctcttgatttgccctcataattttttttagtactttcttactgtctggcaccagaaagtgttttaggcttactttgtactttctgtaactcaaatcctggaatcacccatttctctaagcaattcttatactttatgttgggagaacagagttttgaaaataagatatgatcgctagttgtgttcattgcttccggggtatcatcttctaacttgatcttttaaatttcgagtttgtggagttctcttggaactgatagatagccagtgcacttctatgtagactgatggtcttcaaatgattctctagtaaaattctcctttttttcctattaaaatgaaataatatttttttctcgttttaaagggaaaatggattaagttaattgatagaatcatctcaattttctgtatttctcaggaaaccttttcttcccatttttgtggctattctccatttgtgtggatatataaaagatgataaattagtgcgtaagtaggaaacattaacagaagctcaatttattatttttacaacctttttttttctgttgaatatatataggtattttctgattgtgtactttctactccaatgggaatgagcatttatgctttgttttctgtttgaaatactgtgaaaacttgaatactttcttatgttcttttctttgtaagcaaatctgagaactgcacctgtaggctccttcttcctttcatgttgtcatctcaatgtcccctcctccttttcctccttccccaacccttcatgcttccctttcttcctgtcttcttattaatttcttcattcagtcaataaataaatattcactagatgcttaatatgttctcagtcactgtcctattacaagagttagttcagtgaacaaaacagagaattgcagtcttattgtagctttcgttctatttgggggtggggtggagaggcaatacacagtaaacataattagaagtaaattatatagtatgttagaggtacttctctccacttttttctgtctgttccttcctcctgctgcatttactaatttctctccattggtcactgttggagatctttaaaataaataatgaatgaaagagaacctttctaggacctcagcttaatccttaaccagctgaagccacaggaaataacaaaaaagaactggggagttagagaatacagaatgaaaatgtatttcacaagagttttgtagaatatttaagtgaactcaagtttgaaatatcaaaatggtttttcctagaagagatttggcagacttaatagaggtaataaagcatttttaaaacttaaccagggcacttatgaaagataacaaagtaattttgctgtatttggctaagcttgggccagtgcaattactataagtactctattttctttttaaatccttgtaagtaaatgccacagtaatatattggctgcagaggagacaaaggtggagagtttctctgtaaaggttttatggaggggggattgagagatggtgtttttatcaagttaacaggagtgctttggtaatgataattcattttttcctaaacaagaaaagttgtatagatcacacctggaaatgaggagcttttaaaaatatttctattccacccatgtatggcaaattacatatcttacctattttctgtgtttcttcatttataacttataaataatggtttacagttagaagcaatttgtagatagaaatgctatttgcagtaagaactactaaatatttattttaatagtgagaattaaggactcaaaactttgaagtatagttttaaatacaatagtctctattttgtaaacactgtgaagtgtataaaatgtgtatgtccaagataacttaaagataatacacaaaatgattgttgtacagttgcatttgtgaatgccactttttaatttattaactatgtaatataatgttttgaattttaataaaatatgtcaatacaatcaagaaatatacataaatgaagcacaaaatcttatatctatcaatcatatcacttcactgtgaagaattttcagtttctgttgattaattaggagaaagtataatttattaatatatttctattatgtgaattaaaattcatgttaattcttttagttcttcattgtaggcagttctataccttataacagtgctgcccagtagaaatatatgagccatatgtataatttaaaatgttctagtagccgcattaaaaaagcaaaaagatacaggttaagtatattttaatcagatactttaactcgttatatccaaaatgctaatttcaatttgtaatcaatttcttttggcggggagcgggagatggagcctctctcttttgcccaggctggagtgcaaaatggctcaatcatagcttacaacagccttgaactcctgcctcaaccatgcaagtagctaggactacaggcatgtaccactgtgcccagctcagttgtaaaaattattttaaaatcttaataagatagtttacattcttttttcatactaagtagttgaaatcagatgtgtaccttggcacttaaagcacattttagggccaggcactgtggctcacgcctgtaatcccagcactttgagaggccaaggcgggcagatcacgaggtcaggagatcaagaccatcctggctaacacagtgaaaccgcgtctctactaaaaatacaaaaaattagccaggcgtggtggtgggcgcctgtagtcccagctactcgggaggctgaggcagaatgctgtgaacccgggaggtggagcttgcagtgagccaagaatgcgccactgcactctagcctgggcgacagacggagcaagactccatctcaaaaagaaaaaaaaaaaaaagcacatcttagttcaaaccaactgcatttcaagtgctcatcagccacatatggcttgtggtttattggatagtacaggttttattactcttaatgcatctcatgttatttacacattgttttggttttcttcaatcatttcttatttctaatgctactaaagctggcttttgagatttttggttggtactactcatatcataattatagtcagcattttataggtcttctccttgagtcactaaattggcattaaaaacaattatgttggagttccttcttggaaattaagagattaattctaatccatgctgtgctgctgcttattgtatcactttgggcaagtctgttaacctttctgtcacagtctctatttataaaatgaagtggataaagagttttggcatttcaaactggataattcttattttaaaaaattgtctgtgtttgttattcaaatacattgattgattacactcatatgcattgtgttacccatagtgccaaaaaaggtttatctactaggatctatttttagtgaacgatggtgataagccatgaagagggagagaagtatccttaactgactttcaagcacagaattattaaaatcttacattatatctgggtacaaattggagagccctgaattggcactttggggcaaagaaaaggtgagatcattgaagttgttggtttattgttttcgtcagtgctagcaactaagtatgttttacctttttgtgaaaagttgaattattggcgataaggaattatcactttttttccatgaggtagttatttcaaaatgacattctgcttttccccttcggcaagaggataactaacatactattttaaaatactgaatattagctctctagattagcctctcatagcagaatttaataatgatcattgtacttaattagcttataagacagcttatgtttaacacatgtagacttcatttgttgatttagctccttttagatgttttataaaatagaaaaaagatggactttaccaaaattaccactttgattgattgatggttgccctcaggtttaaatatatacccttagcttatcacaatctacgttcaaataatattttactacatcatttatagtgtaagaaccttgtaattttatatttccatttcctcttcttgtcctttgtgctattgtcagttttttgcatcaagtgtaaaccccaaaatatgttattatttttgctttaaatgtatatatatacttttttttttttttttttgagatggagtttcgctatttttgcccaggttggagggcagtggcgtgatctcggctcactgcaaccttcctctcctgggttcaagcgattctcctgccgcagccttccaagtagctgggattacagttgggtgccatcatgcccagctaattttgtatttttagtagagatggggtttctccatcttagtcaggctggtcttgagctcccaacctcaggtgatctgcctgccttggcctcccaaagtgctgggattacaggcgtgagccaccacgcccagctgaacaattatattttaatggtggctcatgcctgtaatgccagcactttgggaggccaaggcaggcagatcacaaggtcagaagatcgagaccatcctggccaacatggtgaaaccccatctctactaaaaatacaaaatttagccaggcatggtggcgtgtgcctgtaatcccagctacttgggaggctgaggcaggagaatcgcttgaaccaggaagtcagaggttgcaatgagtggagatcacgccactgcactccagcctggtgacagagcaagattctgtctcaaaaaaaaaaaaaaaagattaaaaattatattttatatatacccacatgtttgccatttctggtccaattcttttctttgtgtgtcatctggtactctgctttttatctagtattgtttctctcctgtttaaagatctttctttattagtctttggagtagtgctggtattgagttcactcagctttgtctgaaaagtcaacaaaaatctaggttaagagtgtttcagtcttttgaggttatgtctccattacactctggcttgcatcatttctgacaagaagtcgtctgtcactcttttctttgttcttgtatacaatattgcttccagcccccagttgcttttaagattttctcctcattaccttgttttttcaaaaaaaaaaaaaaaagaaaaagaaaaaaagaaaaaaaaagtaatttgtttgtgtactttgatgtggcttcttttgtttattctgatgaaggtttattgaatttattgaatctgtgatttatagtttttgccaaatttggggtaaatttagccatattttagggactctactcatgtgttagtgtgcttggtgtggttctgttctgttcatttttattatgaatgttttatttctcttcgtttcattttgggtagcttctgttactactaggtcttcaagttcatctctagaagttccactaggttcttttcaaatatcttcttttgttttttttttatcatgttcatatttttttaaacgcatagaccacatgtacaatagctggttttatgtcctcgcctgctaattccatcatgtttgtcatttctgactgtgttcctattgattgatatttttttttttccctcctggtcataaccacactgagccagactcagtggtgcatgcctgttgtcccagtactcagaaggcttaaggcaggaggattaaaagtacgaacccagcctgggcaaaatagtgaggttctgtctccaaatatataaataaataaccatagtcaatagtttagcccacatcagtactcagccagagacttgaggggagccctcttctgatttttggagctccgtctccatagacagccctctcctctatgatatttaatcctatcaattataaccttccaaactccaacctctgtctcttcaactcagaaaggtcactgggctctgtttgttttcctacctgtctgtactgtgacctggaaaatgcctccagatagtaatatgggaactcatgttgctcatctcctttgtttctctcaagaatcacattccttcactgtgttgtttcttgtccaattattgttgtctcatatattgtgtcaatttttctagttgtttacagtagtagggtaatttctataacagttaatccttcatgtgtagaagtggaagtcctcacagtatgtcctttttgagacggagtctcactctgtcgcccagctggagggcagtggcgtgatctcagctcactgcaacctccacctcccagttcaagtgattctcctgcctcagactcccaagtagctgggattacaggggtgcaccaccatgctgtgttaatttttgtatttttagtagagacagggtttccatgttggccaggctggtcttgaactcctgacctcaagtgatccacccgccacagcctcccaaagtgccgggattataggcatgggccactgtgcctggcctgtccttttaattgtttgttatcatcagtacggtcagagtcaacagtttgtactggatattacatattcctctatagaagcagacatgttggtagttatcattttgattggcataattttggtcaagttatagaactggttattgatatatatgttattataatggtattaaaattaccttttgttgacattacctgcaaatgtttgtagtgttttgttcttagaaattttaaattgaagatgtagctggttattaaattcttgctaactggtatatctgtcagaccttcctattctgactattcttcctttcctcagggctgaatcactagctgcttcttaaaacttttaaacagtatttctttgtcctagaattgcactttattctttcattatctagaaacagtgcatatgtgcacacacacgtacacacacacacacacacacacacaacctttttacttaagaatgtaactatcttctcatctcctacatccaacctgtaaaaggcacataaggctattttaactaaccccttttgagtatccctaatccaaaaatccaaaatccaaaatgctctaaaatctgaaacttttttgagtgccaacatgacactcaaaggaaatgctcattggagaactttggattttgtatttttagattagggatgtttagctgctacatatgatgcaaattttccataatttgaaaaaaatctgaaatctaaaatccctctgtcccaagcattttggataaaggaatatttacctgtagttcaaaagaataaagtgatccaaattatcatatttataattatagtttccaggtttttgggtagtaggttcttgagggtgagcctatttttctattcattttcctacctcatagaggccctatatcacatattctcatttgtcctatcttctgaagccaaagcagtggttcaaacgttaagactctgagtttgtggcaagtattggtttgtttgctggatttcaacttaaataatgctaagtgagaatctggggcacagtagtagtatttagactccgttggatggaaagaaataagaaaagaaaagaaataaaagacaagcaccactttctttccctctaggtgataccaactaaaaaccatacattgttactggtctgggttccttttatttatttctatttacatttgtgagtgttgttttgtatattttggtcaattatagtaataaatttcccctccaaataaagaatgaatgaaattaattttgttctgaaagactggacagttacattatctgtcatttttttcctgccccttcttatacaacgtatctagtgatttgagaattttgaaactgcattcagttttcatgagcataagtatgaaaatatcttaaagtgaagttattgagagctttcactggcaagtataatatacatattgcataattattggctatgacagtgcattgtttatcaacatgtcatctttgctctctcagccctgccctgtgagcttgagccccttataacaacttccattaacactggctcccattgtacaattctttctcaccacgaaactctcactcacttcattctaaccacactgacctctttgtggttccttgggaactgcaggcatactcatactgtgtctttgcacttatattccctctgcttcaagggctcttcctttagatagcaaatctgcatggcttagtaccttgattcattcaggttttgtgtcattgtgagtcttcctcaactattccctatcaaaaataagtgtcttttcccaatcacttcatcattctggactcaaaacatctgccctccttggcctcccaaaatgttgggattacaggggtgagccaatacggctggcctttaaatgcattttcaacttacaatggatttactgggatgtaatccagtaccacaatccatacctttttttttttttttttttttgagacagagtttcactcttgttgcccaggctggagttcaatgaggcaatctcggctcactacaacctccacctcccgggttcaagtgattctcctgctcagcctcccgagtagctgggattacaggcatgcgccaccacgcccagctaattttctatttttagtagagacgggggtttctccatgttggtcaggctggtctccaactcctgacctcaggtgatccgcccacctcagcctcccagagtgctggggttacaggcatgagccactgcaactgacctcatcatccataccttttatcttgcttttaaaatttttattagcacttatttttacttgacaatatgttctttatctcttagtttattgtctgtttcacttgaatagatttcacgtgggcagagaccttatctctaaggtttagaacagtatctggtacataataggtgttcaacaattacttgctagaaggagtcaatgaatgaatgaatgaatgaatgaatgatgttttatttgtatgaggacacctaaactatatacctgatataccttcaaactgaacatataataatataatagaaaatagaaaactctctttgctgtttaagtacagatgctcctcgacttatgatggggtcacatcccagtaaacccattgtaagttgaaaatataagttgaaaatgcatttaaaggccaggctcattggctcacacctgtaatctcagcattttgggaggccaaggaggacagattttttgagtccaggaatttgagaccagcctgggcaacatggtgaaaccctgtctctacaaaaaatacaaaaatttgccaggtgtggtgccatgtacctgtagttccagctacctgggaggctgaggtggcaggatcacttgagtccaggaggtcaaggctgcagtgacccatgatcacaccactgcattgcagccttggtgacagagtaagaccctgtcttaaaaacaaaacaaaacaaaaaaagaaagaaaagaaaaagaaaaaagcatttcatacacccaacctactgatcatcatagcttagcgtagcctaccttaaacatgctcagaacacttttattagcctacagttgggcaaaatcatctaatacaaagcctattttataatatagtgttgaatatctcatgcaatgtgttgaatactgtattgaaaatgaaaaacagaatggtgtatgtttactggaagtatggtttctactgaatgcgtatcgctttcacaccgtcataaagttgaaaaatcctaagttgagccattgtaagtcgggcatcatctgtgcttgtataagttttaaagacaaaattttctaattttaattatagaatttcagttctgtttgactgtaccttgagtgaaggtcacttttttttttttttttttttttaaagaaacaaggtcttactctgttgccctggctctagtgcagtggtgcaatcatagctcactgtaacctcaactcctggggtctagtgatcctcctgcctgagcctcccaaatagctagaactacaggtgcacactaccatgcccaactaatttttttagtttttgtagagatagggtcttgctctgttgcccaggctggtcttgaactccttaactaagggaatcctttgtgccttggcctcccaaagagctgggattacaggaatgagctactatgcctggcccaaagggaaagacctttaggaccaaaacattagtcataaaaattctgtcctttaaaaatctgaacttttatttgttcttcattccataattgagctcagtggctgaaataatgaaaaatcctttgcttttttacttttctttaccttctaaactattctgtagctctttgttagtcttgaaatctcgataagtttttatcaccattatcaactgattattaatattttctgagaacagtgtactgcattgcaggcatctaatgattttcttctttcctcttcctcctcctttgtgtatccataatgtttggactgctagcgttgagcctgttgtgatttttaaagatagaattacacctctctcgacatcctgctgaaacacaagaggacctgttcatagacactgctgtctgtattttctctaggggtattaaaaatgcccatatatggagcataacatactgtggtattaagaggataaacttaatctgcttcattgaggcttattacagattttggagactggggagtctgaagccttgttttcagaaagtgtatcatccttttatggtatttagtttgttttgaactttccattatttccaaattcctgcagaagtatggaaataaacagtattctttctgattatgaccttttgaaagaaataagttgtttttgtttagcaacagcattatcaatttatgccaacacattttttctataaccagtataattacagatagcagtaaggtctggaaataccatctctttgttaactctcattattaaggcaataaaaaatagtgttaaagtttgttttctgagtattgatctgtctgaacttctttgtaactaaaaagaaaatcatacctgtaagtgaaaagctggttgcattcagttgctttgctggccagctgttgttgtagggtaataaggaaccctaagtgagactgctaatcttgtgtagaagttaagagactatgcaagaaactttgcaacattcaagctgcatttccatattgtccaaagaatattcattttggtatttcctcattgcctaatacataacctcctccacttttgtgcacaatctctgtatgtgtgcgtgtgtttgtatatgtgtgtttatatgtatgtgtgtatatttatgtgtctgtgtaggaggtgcttttcaaatgttagctgaaatatacttaatctgtgcatctcttttttttactgaaagcgatcccatcaaatatgatgattgatggaaccaaaattcattgaggccctgctgtttgctaggcatcatgataggtcctaggcgtatgtgttttagatttttgcagatctgcctgggaaatgcttcttttctctcagggaagacaaaccaataattataacacactgtattaacagaattatgtacaagagggttggaggcacaggagaagagcatgtaaattattctcagtggtcgcgaaagttttctgaagaagtatttcttgagatggagtctcatgcagtctcccaggctggagtggagtggtgccatctcagtttactgcatcccccacctcccaggttcaagcaatccacctgtctcagcctcccaggtagctgggactacaggcatgcaccactgtgcctggctaatttttgtatttttagtagagacgaggtttcaccgtgttggccaggctggtcttgaactcctgacctcaagtgatccacttgtctcagcctcccaaagtgctaggatggcaggcacgagcgcccggcctcaaagaggtattttttatgcaaagaagagtagaggtcattttaggcagaggaaacagcatgggcgtaaagcatagtggccggagctatagtgacttcccctgggaactacaggtaattcaacctctgcctcctgggttcaagtgattctcctgcctcagcctcctgagtagctgggattataaccatgtgccaccacgcccggctaattttgtatttttagtagagatggggtttctccatgttggtcaggctggtctggaactcccgacctcaggtgatccgcccgccttggcctcccaaagtgctgagattacaggcgtgagccactgcacccagcgtaatttctgaattctctaagattatttttttaagaagaaagaacccctaaaaatttaatatgcactgtgacccttaaaagaaacagcaggaagtaaaagctgattaatttaatgcatattaaataaatataacatatatgtttaatgtattttccttagtgggagaatacaggctggaactggatggtggagaaagactcaaggataaaattgagaggaaaaaacaaaggataggaatggagaacaaaagatggggaaggggccagacgcggtggctcatgccggtaatcccagcacttcgggaggctgaggtgggcggatcacctgaggtcagcagttggagactagcctggccacgtggcgaaagcccgtctttactaaaaatacaaaacttagctgggtatggcatggtggtgtgcgcctgtaatcccagctactcaggaggctgaggtaggagaatcacttgaacctcggaggcggaggttacagtgagccgagatcgtgccattgcactccagcctgggtgacagagtgaaacagtctcagaaaaaaaaaaaaagaaaagaaaagaaaagatggagagtggagagcacacaccgggtagtgggaggtagagttagcagattttccaaggatttttaaatgatgtgtacttgatgtaggtttccctgccatccagtgctctttaactatagatccccataatcattatttacagtttttgtatgtttgtggttatttttagagactactcatgaataattgaaacaacttatcttgaaaattttcctcaaagataaagcaggaactactagagaaatgctacttcttgactagataaaatcagtcttcacccatattttaattcattacagtgaagctcatacatagttatagtgagccataatcttttgaaattgaattttggcaaagtttgatttttcaaagaggattttctttgtggtgagactattttattgaggatattatccttcttttattatcaaacttttaggtcttctacttccgtctcctgtcatctcagattgctatggcgcagagatgggaatctagctgttggggttgctgtttattcagggaaaaatggcttgtgtttcatctacaggctggtctgtaattgcttgggtaagatgataatggaatctcatagctaaacttaaggcttttttcctgtacagtgcatttcattcttcctagtatttgcttttccttttaccaaaattaatgcatcaaaaggatggtggacgatctgatgaacataatgttcatttaaaaagttgggtagactgaacaatttttgggaaaacgaaaacaagtcaggtagatgaacaattttagaaaaaagtaaaatcttcccttggatgcgtgaaaaaaccctaatttctgtctcctactttcctaccccaccactttctttttttgcatgtatttatttttacaggcatggaagtttttaatgggcattcacttctcttatcttagttcttcctgcttttatctctttttcattttctttttttttttttttttttgagacggagtcttgctctgtcgcccaggctggagtgcagtggcacgatctcggctcactgtaagctccgcctcccaggttcacaccattcttctgcctcagcctcccgagtagctgggactacaggcgcccgccaccatgcccggctaattttttgtatttttagtagagacagggtttcaccgtgttagccaggatggtctcgatctcctgacctcgtgatctgcctgcctcggcctcccaaagtgctgggattacaagcatgagccactgcgcccgccccctctttttcattttcatgtgtttattttcctgacatatacttaccaaattccaagttatagtgcagactgggactatcttactgaacctgacattgtgtccattttaagctagcccagcaggcccttcattttggtctaaggctgtgttcatgaagactgtcccattgtatccccaccaccaatagggatggatgcaaagggtccaggacgttagtcagtgtccccttgccagctcttagctaatagccagtttaatggtgaatccatatctatcgtgagctggaagagctgaagggcacacggtaagggccaaataaaggtttggatgaattgagaactgaacgtgcaaagaaataaagctcataactgaagtccttaagaaatgaagctttttaggcaagcacttctgtccgtaagtctagccaattaagtgtgcagatataagcatgtgtcccaatgtgtgtccatgagtgactactgaagccctcaggtgctctggtgacttcatatgcaagcgtggcctggcaggaactgcctgtgctatgactaatcaggagactttccagggaaaaggatgtcaggcatggggattccacatttagcgtcacttttagtatgtaatgacttccatatcctatttgaaggatccattctcattaggattcttcatgcttgaaatacacccttacaaaagctgaactttctcacgttgactaagaacaagatcatctttgacagatttttgaattgaattggcaaagcaaaattctcctcaagtccaagggtttcattttgctcatgctctttcgttccattgtgttttaaaccaggttgctattatatagagtattttagcagccttgatcttggaaacatcaagaccattgttcctattgttgctgatttagtgttacagctgcttcctctttatgtgatttaatttgaggtttcagcccaccagggggctattggtccccacctatgcagcttgaagagctggctgctgtttctctatggatgttatttccattcctattcatagcgatttttccccttctatattcatctagcaacagcaaggcactgttccaggaacccacactctctacataaggcataacatggaaccatttggatggaaaaattataaattaaaattattctgttcattttaaaatattcatattgtgttgctcaaatgccagtaactggaaaatcatggataatgtcctgtttttataacctctttcagaatgttttaaaatctgtttatgttgttacttagccatctcttttcctggagtggattttgtgataagattttgttaaaaaaaagattgtatgagtccagcgcctaatggcagatataatattaaagatgataccactaatttcagtccactttttaaatagaaaaagatttattccgtgtacagagaatatttataaaattgtacacctctaaaaatagcctatggacatgccagactatttctttggaggataaagctttttattaaatgattaagattaagcaaaggtttattatttctggaagtaggtatttaatttaaactatgaaaacccatatatccataatactactaattttcagatgctaaaaatatcttcagcttttaaaatgtattgagctttttattttttaaaaagctttttaagtgctcttttttctatgtattctgttctcaatgctaagttattgattctttaatttgggaaaactaaaatcttatttctatccttgtattttccatgttgtgtgggtgtgggtgaggatgtgtatgtctcagaaagatagacaggcaggaaaaagtgaaaatgttttcatatggtttagttttttgctgaagtaattatatttcttatgctaaaggaaagaatagtgattggaaatctttttgctgtgtttttttctacctcatggaacatattaagaggagcgaagatctttattttatgcttttttattctgtgagttttaagtccacgttcacataaaagccatgtgttttatttgttgtctctcttggctaggaatatttaaatgtatttttgaaactcttctgttctgtcaactaaaggtaatttaaaattataattttaagacactttctagaaacttatactttggttcaggctaaagtcttcagtttgtgtgcctgtgtgtgtgtgttgaggttcttcagaagcaacaaaccacttgagcgtgagcaaatttcacaggctcccttcattgtttgttttagcctcgttaatcatttggcctttgaaaataggctgatcatttcattgaatatggattgagaaaagttctgtgtgccatgaaaggcctgaatggctcttgctgactctgttttattcattttaaataacatgagggggatcccaaagtatttcctctggacttttgaagcattatcattgcagggtatgatatttgaagtcaggattctttataacaataataacgacaagaatatatatacattttcctaaagtctgatttgtggaaaatagaaagcaaactgtcagtaaacaggttttccaacacaaacactcagtttaggcagcaaccaacttttttgaatgcagcaacaaaatgaatactatttttaattgaataatgaagacagactagaatagttgctatgagaaaaatggataccttataattaataatatgtgagctaaaccttaactacacttgacatttttccttaggttggtgccatactgattaatgagttaactgctgatggtgcctattctgtggagtgactgtttcagttccagggcttagagtgttcaataaaataggtattctctgaggtgggactgaggctttagtcttgatcaaagtgctttgggggaagcacagttgaactgattggctgtgaatgttaatcacttcataggacacactgataatttacagcattgttgtaactctctggtgttcgtaaaatgaacttaataacccactggcaccatgggataagctgctttttctctgcaattgaatacccagactgcctgaataatagtgttgagaaatactgcattaaaaacagtgagcagctgtatgatgaaggaaacagctctgccacagatttgttaattatctcttttgattcacagagggtgtttgtgagatatggttgaccagtgaagacacgggggcttatggcagagatattggcaccaatctccccacactcctgtggaaactggttgaagtgattcctgagggagcaatgctgaggcttggcatgacaaatccgccctatattttagagcatctggaggtaaggaaaagcaccctatttgcatgctaacatagacactaaccagtccagacagtgtggcagcctcagtatcatcacatcagcttcatttaaaactccttcacattttttttttgtagtcccgcatttccaagaatgaatcaagactttcaaatccccttctttggcaggcaacacttttttacttcctcatcattaattaacattgcccaaatttttcaatacttgccaccttgccacagttctttgtttcttgtttgtagtccttcagtcttccagcacataaatttgcctcagttcctccattttgaccgctcgtctgattcagaactgctaatgtgttgcattaatttcgcaacccacagtcaatattgtgttatccaaactactgttagccatatcagaaaagggactgtgcttgaagctcgaggatgaattttcaatttcatcccttcatctggagatacataggggtgaagttgaatcagagggacacagagcaaggtactcttccacttgatttgcacatgcattactgtggcacctgtattcccattgtaaggcccatccctgaatacatgacattttctttcagagaatttccttccttgtttttcacttatcaacataatggtaatcactgtgaacaaaggtgattctgagatccctgattttgtttttatacttttccacagatcgggatgcttacccttaagtagctgtgtcaaactaggcaaatgggcatatgtccaggtaactgtggtacctgaaggcaaatgacacagtaaatatgagcaaagaatatggacaggagagcaaccatataaatgaagaagtacttgctaggatccatgactactatttgagaaataaaataattactttagacccatagttatggaaataaaatctgattagtgcaattgcaaagtcatgtgtaaagcatgaaaatgaataacttttatttttttcaagtgtgttctttgcagtatgtttgtgcagaaaaataacatcccaaaaagctaaaagcaaccactgctgctgaaatttaatgcaaatgctaatgaatagctaaacatttaaaagattatttcgctgatttgattttaagactatacttgttgaggtttttgttgaatggcttccttaatatcaacaacctatttcagaaattctgaaaacagagttaataatttggctgctaattataaatacataatgagggagtttagcaattttaattttattatttacatttttctagctagctctttctagtaagggtatatgatttatatgttaagtttagtgctttagacagtgtgggatgattatgatttgctatttaaaaataagttgcaggcatgtcaacttttacttaacactttgactcaacacttgataaagcaaagtgattctctgtaaaaaaaaaaaaaaaaaaaaaatcaaatatgctaagagctgtgacagtcttgctgtgtttgcagtaaatgtgaggcatacatcgtgaagaccaggagatatactagacgtgtggagggtaggaagggaaacaggccccatcaatataaggtttatgataacagccactttttttggattggaaaagatctgatcagggatccagggacccacaagagatagagtcaggtaagttcaaaaaggaagaagcacaaggaagaaaaatcttgtgttggctctgaggtaactaaccaaatactccttggaataaattcagcattttaattgattgcaagattgcagcagctaatactgtgtgtatagcaaatcctagtgctcagcacctgaagtagtgccagacttggggagcgtctaaaaatcaacaaaagatctgaaatataactttatactttgcctggaaaacaccagatgtttagttcctagatcgtagttggagtgataacaagttttgatggtcatgacattatattttttaaaatcctctgaagtatgtatcatgttggcctttcctcctacattgtcatcttgaggcaacaatcttgttatatctgtctgtggatctatcccacccagtagtggctcaataaatgagtgaatatgagaatgaatacaggaagagctgcccaggctcagtggctcacacctgtaatcccagccctttgggaggccgaggcaggtggatcacttgaggtcaggagtttgagaccagcctggcccacatggtgaaaccccgtctctagtaaaaacacagaaattagctgggtggagtgataggtgcctgtaatcccagctactcaggaggctgaggcaggagaatcgcttgagcccaagaggcagaggttacagtgagccaagattgtgccactgcactccagcctgggtgacaaagcaagattatctcaaaaaaaaaaaaaaaaaaaaaggaagagccttcttcataaaataaattatagagcccacactgtagtcttgaactttgaaatcctaacccctggccagaagaggcagcaaaagatgatgaagtaaatgagcttcaagggtgagaattgttccccacagaaagccacccactactctgcactttatgtgcaggaggtaatccaggctgtgataccacacccagggagaaagccatccaaaagaaacagagcaaaaggaaacaaagatatgcaagaatcaaaggtctacaccatctcaaagtaagaggttttaaactcttcctttgtttcctggaccagaccttcacaccttgctgtttcttctcatcctcctctgcatggcagagcccagaacactcaggattccacaaacacatcgtatgtaacagaaaaggtgactgagccccagaaggcttacatggcttcccagtgtcaaaacgggcagtagggaagggagcccaaatctggtgctcctcagtcctgtgcacagcaataccttgtacatttccattttcctctcactaggcttagaccactctacagaaattacttgacttatctcaagggtactgaacagagttcaccaataagaaaaaacagaagatgaaaacagaaaaaaataacagcaaatgaaggtggtgattttttaaactatagggattgaaggaatccactcttgaaataactaccctgatgctttaaaaccttcagggcaaggatttcttgagaattttattgggaagacagccttcttgtgtttttagaagatgcttcacacaacagactttaattagagagtacttggctggtttgttttccttcctcttcattctgttcacttcttattcacctgactctcagattttttaaaaacaacttttaccaacttaaaagaaaaaaaaccaaacagtttaaagggaaagttatataaaggaaagcaccaaagtttttatcattatttaaaagtatgccggggaaagatacatctattgagaatacattttattcaatctccataggaatagaggatgcacattacacttaacacaggatcacttttaaggtttcttcaagagtctagcattgtgtgtggcactttatatagcaaatactgaatacatgtgtactgaataaaaggaagggaaggagaactctttatcactcataggcagacaagtagtgaagtgtgtgtttgggacatctgcaaactttatttttagtatcactgcccttaaaaaacaatataggattcatttgaattatgatatagctgacaaaagatatctcaaacatatatattgtgaaaaaaacactctggaattgaagaaatatacctatgagcttatacaatgctgtagtaaacttgcatatgataatagaatcaatagataaaacaataaacatgctttatgtcaccttaaagtccctattgcctaaaggataagaataagcccttgaggacattcagggtacttatttttttctattacattcttattcatttgtcccttgagtagtgccctaatgatatctcctctatatctttttttttttttaccatttcatactcctgaaatgtttacattacctttttctcatgatatacttaccatatgatgacagttggtagtaatgtgttaatcagacatactaatatttgctactacatgtgttggctaatatatcgcccctgtagtggcaaataagatgtattttccctgtgtttgctttcctgttgatattgctaatgtaataacctttgcatattcctctttaatgaactctgaccttgtagaaagtgaagcggtttatgaatttgattactcttaaaactacattgcttagttttgtcctcctagtgataggtagcctacagctaaagtattaattcagactgaaaataatacatgtgaacccaacaaggttcacatgagaccagtgatagtggtataatggctgctgctaatgaggcacctgaaatcactgctaactgataaaatcagtacaatttatcaagtgcttattgtttgcaagaaactgagtgctttacatgtgtgatctgtttttcctcttagaacaggctagctatatagatattattatcctcaattttcttttgcccacttttttgagatggggttttgctttgttgcccaggctggagtgctgtggctatttataggtgtgatcatagcgctctacagccttgaactcctgggctcaagtgatcctcctgccttagctgggactacaaacatacaccactgtgcctggctgttatttttgttttgttaattgagaagccatgggttcgaaaggttagataactggctaaaccgcatagccagttagccgctgaactggtttctaatctattctaattcgcaaatgctttctactctactgcatcttcaaggaagccttcccaaactcttcccacatatgttctgtgcttcatagtacccctgtacaacaggtctctgtctctttgggcactcataatggtgcatcatgattacttatttatgtagaaatccaacatgactgttatcataagggagatgttgtcttatccatctttgtatatcagtgcctgtgataacacacacttcatacacctaataaatgtttactgaatgatgtgatagctcaaagtttagtttattaactgttccttgacttcatgcctcatgtactgaagtaccttcatatctgctgagcatccagttttggaagagtttgggaacggttgtcatatatgtttctcatgagtcacatttctgtgaagatgtactggatggttagggattcatctaagggatgcgttatgtttatttgcccagctaaaatactatagcgatagatagtatctttagggctgtctagaacaaatgagcttattgtatgattatcgaatttgtagatgatccaggctcttaacttctttctcctcttcctgcttgttaacttacactgctttttaaaatctccactagagaggatacattaaaatcagacagtttgtcttggttttagtttcgtgaattggctgatagggaaaagatgttaaagctcttgggcagtaaggaaaagagtaagtatctggattttatgtatttaagacacatgcatgcatatgttcattgcagcactatgcacaatcacaaagacatggagtcaacttaaatgcccatccacagtagactggataaagacagtgtggtatgtgtacaccatggaatactgtgcagccataaaaaagaacaagatcatgtcctttgcaggaacatagatggaactagaggccattatccttagcaaactaacgcaggaatagaaaaccgaataccacatgttctcacttataagtgggagctaaataatgagaacatgtggacagatagaggggaacaacagatactggggcctgcttgagggagatcagggggaggtgggagaggttcagaaaaagaaaatatcggctgggcgcagtggctcacgcctgtaatcccagcacttcgggaggccgaggcgggtggatcacgaggtcaggagatcgagaccatcctggctaacacagtgaaaccccatctctactaaaaatacaaaaaattagccgggtgtggtggcgggtgcctgtagtctcagctactctggaggctgaggcaggagaatggcgtgaacctgggaggtggagcttgcagtgagctgagatcgcaccaccgcactccagcctgggcaaaagagcaagactccgtctcaaaaaaaaaaaagaaaagaaaaacaaaaaaaaaacatcaagtactacgcttagtacctggatgactaaataatctgtacaccaaacccccaagtcataagtttacatgtataacaagcctgcacatgtacccctgagcctaaaataaaagttaaaatgtttattttaaaaagttattctggtcctccctctgtcatgaatagttcaaagtaacttatctccctttaagagacttgcgtgtctcaaaattgtatgagaattttagtgcattacttacaacctgcgccagagagggcaaactggttaatctagattgcaagtgcttattaaggactattcctatattcaaattataataaaacaagttatatatttttaaacatattactttgtaaaatattgccaaacaacattgacactaacattcacattgatattatgctacattttatttagcttgaattaaaatatatagtattgctcaagatttatagctagtatacttatggtacatgtcatcataaggttaattacaaatagtgatattttaaatatctcttctgtttttggtttggaaatcttttaatcaccgtaacaaatcagcttcctgctaccctagatttttgtatgtttacttctacttcaatgaccttatattctaacctaattctgtatttagtgaaataaattcatctgctgaaagacagtagatacctgtcaaggacttttgttgcatggtaatttatgaacattaataatatgtttgcctttgccgagttttaaaaaatgcctcatagtttcaaaataatagcaaactcaatacatgctgtgcttatgtttcatcaaagcaatacagattttccaaactgaactcagcagttcaagctgtgtctttaaacatttcttttccttagggtttatactttctggaataatagaataatatgtaaatatattctctactgttgtatacaaaatatttttccccttttgatgaataaaaagacatgctagattacttattttcagcaaggaaatggaaaggaaaaatcttttatttcaaccatccacctgtagcttttgagacatgtcagtatgtggtttgatctaactgttggcactgttttttgccatttataatcatcagtgctctatttgattcttaccctggcacttgcgaataaattttaagaggtcagtgaaacacctaaaactagaaacagaagtttgtgtctttctgaatattaaagagagaaaacttttatcaaatattaaaagggctcatatacattttctttttaagtttatcaggcttcattgggaacctaattctgagagctgggaacagcctctctggaagggaggatgtggatgaaaggaatgtcctttcttgcctgccaaaggatctaatactgataaaagatgaaattgaaatgctacttccccttagcaaaattataggctctacctaacattctaactcttcaacttctctgctagtcctgggtttgagcagcaggaagctttagttaggcccttccactaaaaaaaaaaaagacttgcatctctgcccatacctgggtctcggcctctttgttctgtgatactacttgcttgtgcccttgtccaggcctcagcccctaattccagctctgcccaagaagccaaagcttttcttgatctcaactactcctcagaaaaatttaccgagcttgttgcttcctactactgagcctttgtttgtaatgttaagtctgggtgagtaagcctcatgattacatgtagaccgaaggaccccaaaataaatgaacttataaatagactttatttcagaacagattgcactttgttgctgctgaatgttattttatccttattgtgccaggtgtattttctgggtaaatgtttctcatgttgaaaatactgggtacctctgtcttcctgaggaacacaagaacatgcctagatcatacttaaaaattctctttatatggccatcaataatttatacagagacctatcttatgtgcttcactggtattctcagttccagtgtctatattatgagaaagcaggcatgagagaataaatctagtgtgagaatataaacagccaaatcattcatgtttgtcctgaaatgctttaatccacattgtggtataaacttctgaacttcccaaacttagataaatttacaagaataaaacaaccccattaaaaactgggcaaaaaacatgaacagaaacttttcagaagacaacgtacatgtggccaaccatcatatgaaaaaaaaaactcaacatcaccgatcattagagaaatacaaatcaaaaccacaatgaaataccatctcacaccagtcagaagggctattattaaaaagtcaaaaaataacagatgctggcgagggtacggagaaaaaggaatgcttatacactgtggatggaagtgtaaattagttcaaccattgtggaagactttgtggagatttctcaaagacctgaagacagaaataccatttgtcctagcaatcccattactgggtacatacccaaaggaatataaatcattctgttataaagtcacatgcgtgggtatgttcataggagcagtattcacaatagcagagacatggaatcaacctaaatgcccatcagtgatagactagatcaagaaatgtggtacacagactatgcaaccataaaaaaagaacgaaatcatgtcctttgcagggacatggatggagctggaagccattatcctcagcaaactaacacacaaacagaaaaccaaataccacatgttcttgcttataagtgggagctgaatggtgagaacacgtggacacatggcggggaacaacacacactggggcctgtcactggggccatgtggggtgggaggagggagagcatcaggaagaataactaatggatgctgggtaatgaaataatctgtacaacaaacccccatgacacaagtttacctatgtctcagggctacccatgtacccctgaacttaaacagaagttaaaaacaaaacaacaaaacttctgaacttctcaaccactgtcatcattttttccctcttgccattgacccaaattattgaatattgtttataaaatgcagtgacacacggatatttgttcccaaaagagacggttaattttcgtgagaggaaaagaacatagggataccatggttgtcaagatgatgagtgaaaaggccttagcaaatcctttataaataaactgatgtttggccaggtgcagtgcctcacacctgtaattccaggtgtttgggaggccaagacaggaggattgcttgaggtcaggagtttgagaccagcctgttcaatacagtgagatccgtctctgcaaaaagttttttacaattagcttggtatggtggcacacatctgtagtcccagctactcaggaggctgaggccagattatcacttggacccaggagttcaagactgtggtgagctatgatcatataactgcaccctggcctgagcattgagaccctgtatcttgagaagagaagaggaggggaggggaggggaggggagggaagagggaagactgtagtgagctatgatcatataactgcactctggtctgagcattgagacactgtatcgagaggggaggggaggggaggggagggggaacattataatcatagttgaatatctatcctgggtcatgtctctctctatgtatattttttgaggaaaaatactcttttaaagtaaatataaagatctctctcactctaacatacttgaaaaacataaaaatttacatatttcaactgacacacatctattccttcttcatcttttagtattctagtgtacacttccgtttatatagaagagcattagatatgtatatggtttaatttacatcttaaaaggcatttcacattgccagtcccctgaatccttaatttcacccggagtagctgagaaggctttcatgtcacctgtcaaaattagtgcagttcaaactccataatacaccagctgtgggctttatcttcctcattaatttaggaagtcagttatgctcaaaccattgagaaaagctgcctttgacattccttcagaagcacagagaatggctaacacataaggcaatccacgtagtttcctttacacttttctattctacgatcctctcggtattgacttctttgctttaatagcctatgaaaggctaccttaggcacttgctaattcagcacttagtaaaatgaaatcctcatattttacatcaggtaggtaatggaattttcaggtgattcatgatctagaacagacgggggtaatgaagttaatggttcatagaatagttgagggacattctgcatatttgtcagaaagcaaagtccgttcccttcatctgcttctgtttatttctaagatactaaattgttgcttttaggtctgatgtacatctgttctctacatcttcctgaccctaccacagaaatgctccacttgaaaatgttaagctttcaaaatttaagttcaaaaattctttaatatcatttaacagtaaataatgattatgtcctaagttggaaacataaggattattgttattatagactcctactgctcagaactctttgatttgcatatgttgtatcagaactatcgaatattaaatatgggcacaatccatgtttaataaatcacttttaggatcagaggatgctgcatgtaggccagagaaaatcaaactgattgtttagcataatcctgaaagatccccaattattcattagtttgaggggggaaatggtttctgtttataacatgtattattgtgtgtttttaaaaactgttgcagaaagtttactatcaatataacattgattagagaaaatactgtcattaagtctgtttctaatatatggtcataaaaaagtagtcttcatagtttaatgttaaaatatttttaaaagcatactctgtatcagcttttattttgcaatgtcatgtggaatatcaggctaccttctgattggtggaaatttcagacattaatcttttagttaagtggctcctacattttcagtctttatttttcctacctcagcagactctttttatttttttgttgttgtttctatattcttccattattgcgtttgtattggtttatctgttgtaacaaagtaccacaaactgggtattttgggaactctgagagagaatttgttctgttcttgtcccgcagcttctaatggttactgacaatacttggcattccttggcttatagacatatcactccaatttttgtctcagtcttcacctggcattctttcctctgcctctgtttccagatgtcctcatcttatacaccagtcattggattagggtccaccttaattcattatgacctcattttaacttgattatatctattaagaccctgtttccaagtaatgtcacattcacagctactgggggttaggacttacatttacatctttttaggggacacagttcaactcataacagcctccttttgtagtaaatagaaattctttagtatgacattttaattactttgttgtttcttttactatatatattttaagtcatttttatagtggttaccatagggattacaattaatattctaatttataacactcttattttgatcaatattaacttaattataataacatatgaaaactttgctcctatgtagttcccttcccaccccacttctttttgttgttactgtcataaacattacatatatatgcagtgtatgctcagtagcacagacttataattagcactttgtgcagttgtcttttaaatcagataatataaaaacaagagttacaaacaaaaaccacaattatactgtcttttatgtttacatatgcagttacatttactgctgctctttatttcttcctgtggattggagagtcctttcatttcagcctgaagggttccatttagcatttcttgagaggcagatttgctaacaactaattcctcttggttttcatttatctggaaatgacttaatttcgtcttcatttttgaagagcagcttctctggatacagaattcctggttggcagtctttttctttcagcattttatatcatctcacttccctctcttccatatggtttctttggagaaaccaaatgttaatcttactgaggatcccttatctataagttgctgatctcttgctgctgtcaggattcgctttttgtctttgactttcaactgtttgattatgatgtgtctgggtgtagatctctttgagtctatcctacttgaagtttctagagcttttaggatgtgttgattaatgttcttttttgttctgggtttttttttttgttttttttttggaccagggtctcactgtgtcacccaggctagagtgcagtggtgcagtcatggctcactgcatccttgacttcctgggctcaagcacttctctcatgtcagcatcccaagcagctggggctacaggtgtgtgccaccacacccagctagtttctgtattttttatagagacagagtctcactgtgttttccaggttggtcttgaataactgggctcaagtgatcctcccgccttggcctcccaaagtgctgggattacaggtgtgagccaccgcacccagccaattagtgctgtttttcaaattagagaggttttggccactatttgttcaaatattctttctgctcctttctttcctttcctagaactcccattatgtgtttgttggtgtgcttgatggtatctaaggctctgttaattttttctttctattccccccatcaagtcatctgaattgacctgtcttcaagtttgctgattgtttcttctgcttgttcagatctcttgcagagcccttctagtaatttttaaattttagttcttatacattctatatcagaatttctatatggttcttttttattatttctgtctcattattggtactctatttggtgagacatcattctcttgattttccttaattcttgggacatggttttctttagttttttgatcatatttaaagtgctgatttaaagtctttgtccagtaaagtctaatatctgggctttctcagggacagtttctattgtctccttttttcctgtgcacaaaccatattttcttgtttgtttggagggttttcttatggtttatgatttttgttattgaatactggacatttgaataatataacgtggcagctctggaaatcggattcttctcactccctacagtttgttgttgttatttggtgacttttctgaattatagttcagacctttgaacaatgcacggcttagaggtaccccctcagtgcagtcaaaaatccatgtataacttttgactcctccaaaagtttactaatagcctactgttgataggaagcctcaccattaacataaacaatcaattaatgcacgtgtgttatgtgtattatatactgtattcttacaaccaagtaagctagaggaaagaaaatgttattaagaaaatcataagaagagaaaatatatttactattcattaagtggaagtggatcatcataaaggtcatcatcctcatcatcttcatactgaataggctgaggaggaggaagaagaggagctgttgattttgcagtctcaggggtggtaaagacaaaagaatatctatgtataagtgaatgcacacagtacaaacccgtgtttttaagggtccactgtaattctgtaaagtctgtattctttgtcatgtgtgaccagtgaaatctctacccacttagcttaatagtcagctaatgattggacagagatttccttaaatgcctggaactagtaagtctctcagtttttgcagggaggcctgattgtatatgttggagcttgcctggaatgctccatcaggtagcttataactccacctttgcctttacttcctgtttctgccaagtatcaggtttagccagaggtgagagtttagcacgttctcagatatttggttctcagcatgtgcataacctaaacacacacccagccctatgcatacatggaaccttctatattctaggaaatatgtcagtgttttttaggctttgtatggatatcacattccctgccttttttttttttttaagctttttgatttgcttattgtttgtcccagctgttatcacagcctgaggcagccctgatgttaaacaattgcagctgattatttttgacaaatgtctttgggcaaaagactgttctcactgggttagtgccaggtcaggttaaataagcaagctgtgtgagtggagccttccttggaaccactagtgaagtccaataatgatagtttttctgggaatggggctttgaagaagttacaactctattatgccccctcaagtggcttccaggctgctggttttcatgattgaaggctgttggttttcaaggctaccatggaactagaaagtgggaggtgagattaggataggccaaacacaccacatagctccatgttcttaccaagatttatttgttttttaatgaacaccacccagattgctgcaaacctttagttaatttccagagttctgaaaaagttgactgacaatttttgtcagtgttctcattgtttttatgaaggagaggattttcagtctttactccaccattcctgctgaggtcaataaaaatttatgcctgaaaaggggctgccttgtatctatcagaccatcaatatgtgaagttgaatcacttttcttgcttaatttttgtgctgcatgtcaaaggtgcatcaatcacttatggtgctgtcttcctcataaagcttttgaggaagaactcatgtcattagcaggttattgacagcaaatgatcactattaattgagtcaccatcacagaaagcatggagacttacagactaaaatgtatacttctttagatacttctggctttggataccacacaagaaataatatggcatagatagactgaatcttgcctatgatggttaattgcttctttctgttttttgttttgttttgttttgttttttgagaccaagtctcgctctgtcacccaggctgagtgcaatggcatgatctcagctcactgcaacctctgcctcccagattcaaatgtttctcctgcctcagcctcccgagtagctgggactacaggcacgtgccaccacacccggctaatttttgcatttttagtagagacggggtttcactttgttggccaggctggtctctaactcctgacctcgtgatctgcctgccttggcctcccaaagtgctgggattacaggcatgagcccaccatgcacggcctctctccctgttaaaaactgatacttttattaagaaccaaatcaaatattatgttgttatttctattctgatagataattgagttccacaattactgtctttcatgatgtcaaagctgctgttggtctagattcactaaagaagctttgttttcttgatagatgatgtccccttcactatgccgtgtcacaccatcagcatagtcttccaaaagctgtgcacatcaggtgattggacatttgttgatcggaaagatatttgcttttgatgctgcattgctaaattaaaaagataatcaaacttaaaattaatagatataaactctagaatttgcaacagatcactagaaaaatattgatatttcagggataatcaatttcaaaacttaaagagtcattttgaaatctgcagtacattgtgttactgtcatagaagtaacagattttagaatataacaattttattactaacatatttgttatagctttattattttattctagtatccttcaaatcaaatgggtcattattgtattgaagtgtttacagaagtagaagatttaaatctgaatcagttttatcattaatctggcaaattagttgaatcgtgatcattccattcacatgtaagtcatctgaaaagggagcaccattttgaagagtttaagctgaatgatgtagattttaaattttccacttgctctctaattccaggccttccaaaatatttttaaactcattttacttgatgtgaccttgaattaaaaaaaataacgtgaaaaaactgttgttccattttattatctgatatttggtgtgaaataatcatctcaacacttgctttgacagtggcatatcatttctataatcctaagtcagagaggcctgagacaccaagggcttctgtttctgtagtgagcctagagactcacttgaattgagtcctccattcaacacctgagaaagaaacattcttttggatagaatggccttcctcacttgcaagtgtttttcatgctgtaaataatacagtgtaaagtgaaatttacagaaaatcatatcacaagatctctctattgccaaaaatggattgttctgcatactcttcttgttccacactggtggccctgtagaaggactggagatcattttggtggccaagttcatgaggcctcagacacagcccactggcagtcactcttatcacccaggcttgagacactcttagctcttccttagcctttagttaagtttctcaaggcaccagctattcttcttttagacactcagttttatccgtggaagcctatcagtttctttttatgtttcaacttcccaagtccttcagattttttgaagaaagtttgaaacagaaagcaggataaacaacttattttcatttctcttttgctcttccaccagcctagcccacgttcctaagggaatgaacagcccatctctgttaattccctcagtttcaggcacatttcctgtttggaacgtgggtcatcagtgaattaatccatagcccttggaattatgaagcttatggacctcccttctcttaggaaagcatgcttgattttagaactcagagaccgtgaaaggagaactgagcattgttgattgtttgctgtcagggccagtctttgacatgggcctggatgttctgctgatttttgtggagcactggacagattttcacatttctatgggttttgatgttttcacatatcaactgggcatattagcagttaccctatacaaagaatattagataacatatcactagtgctttctgggatgctatataaattgaagactttaggccgaggcaggagaattgcttgaacccgggaggcagaggttgcagtgagccgagatcgcgtcattactctccagcctgggcaataagagcgaaactccgtctcaaaaaaaaaaaaaagactttaaataatggagtatcattatttagcttataatagagtaacattggtagaacaatgaattgatatatgtagaatgcttagaatagtgtctggcacataaaaggtgctcaagagttatcagctataattattatcattgttactatactgagattttggaattttaccttaaaaacaatgtatcacatatgtaaatataaaggtatcttttctatataaaggtatcttttgggtcacatattcctaatgtttattttctcatgattgatagggtaagccaaagtcaaaagtacctgtggggaaggagaaagctagccagtgagcggggagtgaagtaggacccatggggaaatgtgagactttccaaaggctgtggagggaaaggtggctctcagtgccagtcactgtgaacagcagtagaggcatgccagtgttcactggggtctctgcttcagctgctgccatcctgccaggtgatccaacataggatcataagcaacatgggtcatcttttgtttgtttgtttgagacagggccttgctctgtcacccaggctggggtgcagtggtgtgatctcggcccactgcaacctctgcctctcgggttcaagtgatcctcccacctcagcctcccaagtagctgggactacaggcatgcaccaccatgcccagctaatttttgtatttttaggaaagtcatggtctccctatgatgcccaggctagtctcgaactcctgggctcaagtgatctgctcacctcagcctcccaaagtgctgggattataggcgtgagccaccctgcctggcctgggtcatcatttctgactagcaatgactataaacaatttttaagaaattattgttgtagacgatatataactgtgaagtattatatagaaaacgcttacattagggaaaacgtgaagaggataaaacaaagaggccccaaaatatggtggcttatagaagtttacttctctctttcacagtccacagatgggtggtccaagattctctagaggatttgctgtcttcagtgtgtgccttccctctctaggtctaagatggctcttctttgtcctgccgtcatgttagcatcccaggctgcagaagcagaaaagacaatggaaagacatggcatgcatttcttctactggcctgacccaaaagtagcagatctcttctagtcatattaaatccaagcttttggctttgcccaaactttgttatttgaccatatgagcaattaatctccagcttggtggtcagaggtgtagttaaaatttgggaattttattactgaagaagagagaagggatattagggcaaccagcaatctttgccacaacttcacattggatagggaaaatgaaaagaacattgtgtttcttttgtcttgtgatagtgattaatatctagctattctttattctcaggctcactttaatatttgagaaatcagagttatgctctacaaataatatataacattgatatcgtaaggtttctatttttctggattttgttttctccttgaaaggctgttatcgagttgatggtgtggtttaccatcagttgcatcttagaaataaaatatttgggccaggtgcagtgactcgtgcttgtaatcccagcactttgggagtccgaggctgacagattgcttgagctcaggagttcgaaaccagactgggcaacatagcaagacccagtctctgcaaaaaaaaaaaaaattagctgggcatggttgtatgctcctgtagtaccccctactcaggaggctgaggtgaaagaatcacttgagcccaggaggcagaggttgcagtcaactgagatctcaacactgcactccagcctgggtgacagaggcagaccctatctcaaaaaaaaaaaaaaaaaaaaaaaggaaagaaacaaataagatatttggaccatgactccaaaacaagaagactgtttttagcaatgctttaatatagatatttatcttatgtccctgtatctacctcagaagttccatttgtttgtaattggagctgattgggaggaaaaataccaaattagagccagatcttttggccatccggctaactacgaacccactgactgaccagttaatctctgccgtctccaggtgatagatatccttgccttgtagatatcaatgctgcaattactcagattcagtttatgttccaaattgcctaatttcacatctagactgtgcttttcttgtgctttcattttcgaacaagtttgcttggtatttagtagtcccttttttttgaaactgtgtctgtgatatgccctgatacataattgatgttactaataattctatttgattttactacattaggtaactacatacatagtacatatgcttcatgtatatgcttattatatatttcattcgatgtctttgcatacataacatctattcaataacatcagggcatttcttctctaaggtgtgtgaatataaagtgatatttaagcaacacgtattattttcaaagtaaaaatagtctctttgacttagttatttcataaaatgagcactgattctacagatattcaattatacatttgaaaaaaatggctaagcatggacaaaatgaatgcttcccacggatgttaataattttaagatacaaagctttcaaagaatatttgactgaaacccaaaatatctaagagaatttaatttactttttgatttgttccctaaagggccaggattcttggcattgctgtactttatggcactcttactaggttattatcactcaaagcccattgttttcattaaggttcacctttgatgtaatatattctttgggttttgacaaatgtataatgacacgtacccaccgttatagtatcatactgaatagtttgactgctctaaaaccccacattattccacctatttacccctcccttcttctagccccagacaacccctgctctttttactgtctccatagtttcgccttttccagaatgtcatataattgcaatcatacccttttcagattagcttctttctcttagtaatatcatttaaggcttttctatgcctttttctggcctcagaactcatttcttttagtgctgaataatattccattgtctgaatgtatcacaacttatcactatagtagaattctcattttgaagacatttatgattaaatattattaaaatgtattctttgttaagtgaagtgatgtttacaaagggggtaaatactgtaaaacaagaaaaagttcctgaaattgaattctgtgactgaaattagaataaatgaatccatttgttccttcatttatgatgactggaccgtagctccttgactttcatctagatcttaagctttgccaaccactgcctcctccccaatttttaaaaaactttttattgtggtataacataaataccataaagcgcaatgatcttaagtgcacaatgagcctttacaaatgtgcacttggatgtgactatcacctgatcaagaaatagagcatttctagaatctcatgtgattgtctcatgttccttccagttcacacatccaagagacctctattctgaattggaaaatttgatcactgttaattttgcttgttctcgaatttcatgtaaatggattcatacagtatgtactcttttgaatttgatttattttgcccaacagaatgtccatgagcgtcacgatgttgttgcatatttcaataatctgtttttattttattgctgtgaagtgttgttttataaatatatcacagttcacccattctcctgttaaatattaggttaatttccagatttcaactattgtgagtaaagcttctgagaacattctgtacatatcttttggcagacataatacactcatttctcttgaatattcctgagtggaattgctgggtcagagtgggcatatgtttggctttaataaaattgcccatcatgtataaaagttgctgctattctattaaatagattttggataggaagtagtaaagacccttaaagaaatgacctagtgtaattaatatccctcttgaaaaggggaaatatttgggatttgttgcaggttgtttttttcccatgagtagtgaacataaagcttattcaagagaatgaggtaatttggaatataaagattttatttatgttagatatatgatagcagattaaataattgggccacatattctattagaatacactttggtacagtttagttaaattgataataaaaggcacaaattgtatataaggaggacattgttcttaacatctgaagaccttggttctaactctaattttagcactatgtaaccatgtgaacttaggcaaattatataacccctttaggtctttgtctttggaagtagaagtgatgagagaagagtttggtctatattatctcctaggttccttccagtttcctcattctatgatttttaaaaaataatttatataggctgggcatggtgcttcatgcctgtcctgtaatcccagcaatttgggaagccaaggtgggcggatcccttgagcacaggagtttgagaccagcctgagcaacccagcaaaatcccatctctacaaaaaatacaaagattagctggacgtggtgatgcacatgtgtagtcccagctattctgaagactgaggcaggaagatcacttgagcccaggaggcggaggctgcagtgagctggaattgctccactgcactccagcctgagcaacagagtgagactccgtctcaaaatattaatgataataataataatcattatttatgtaaagttaatgttttgttaatatctaattaatgaattaatctaatttattaaatttcactgacttaagagaaaataagcaattgtagactcaaagtcataggactgaatctaaaatttgatactactcaaattttgatatagggaatactaaactaaaattgtatgctttttaaaatgaaatattaaaaactttgctggcaacttctttggttttgtaacgtatcacagatgtgccttcccagctactatgtagtcagaatcctaaaggacattccacataaaatgttgcagaggttccgctttggagggttttgtaaagtcagcttgaaactgattcaaccaatgagtagctcttcagatcctacactgattcagagcttcacatgtggcgggtgtttttcttaagttattagtaagtgccacagtgcaggaaaaagggcaatcagctgtttctgttatgattaaaggtagacgtttcctttcacagtcttgccatttcaaaatttggttcttttattacatccagatgagactgaaggaggctatttgatacttctgcttactgcagaaatatataattatgactaataacgcaaaatactatgtgaaaaatataaacaggaaacagatgttaggtgagacatacagatgctgtaaagttgagctgtatttgagatgctataaacgagctatatttgagactaacagattttcatactctctttggactacaagctaataatttattactgagtgatgaaatacagtatattttctttgaagtggcctgtaggaatttttcatttgcaaattttaattttcagtgaaaaattaaaatgaaattaatcatcatcctgtaaatggtaacaagaatggtaaaatgagtataaaatggctagtgaatgtgggattgctttgttgttgagaatatagagtttttgtttgttggggcactagcatagtattagtacactatcctccactcttccactgatttgcctcattatgtgacctccttgcatcttatttatcttaaaaaggattttaattttaggctcctataatttagtcatattcataattagtctttcataattgcaaatgatgaaaaattacttttggttaactgatcattaaaaaattctcctgtataaaaagtaagagtgtaatcttcaagtttaaaatgcagaaatgtaagtataaacaatctagagttgaggtttccctagcggcatataccaggtcattgaaaaagtcaaaatgaaaaattgtgtgtctgtgtatattgaaactatggcttgtttcacttgagcacattgactcttggtaaaattagctgttattcaactcaattcaacaaaaagttatcaaacattatgctaaacaactaataatgtacaatgtggtaattgcctgatagagacacaaaacactctaaatgagaacaggaaataaataattaatactttgggtacattgagaaacaggaggaagtgataattgaagcatggatgggattttagtaggcagggttggcttagaggtgagcaattgcattctagagtgaggataacattttaataagggtaaaaagccaggagcatgttctgggaaaagcagtaggtctgcttttgataggaacatgtttcccgggggttcgagggtgagcaggggcattgtgacctgaagccactgacaggagataggaatggaaagagtctaagtctgggagcggagtgcggccgacgaagtccagactgcatttcttgctgagtggtattgacacttttgtttgctgttacctcaaaataattttttaaatgatttatattgatattaaaattttttcatagtatctttttttttttttttttgggacagcatctcactttgtcacccatgctggggtgcagtggcataatcccaactcactgcaacctctgcctcctgggttcaagcaattctcctgcctcagcctcctaagtagcagggattacaggcatgcaccaccacacctggctaatttttgtatttttagtagagatggggtttcatcatgttggccaggctgatctcaaactcctgacctcaggtgatccaccctcctgagcctccaaagtgctcggattacaggcgtgagccaccacgcctggccaattcaatatatttataagcttgaaagtcttctattgatcattgtatcatccttctgtgtatcaaaatatatgtataaaataaaatacaaacattattctgattagaagcctccaaagatagatagatatagatatagatatagatatagatatagatatagatatatagatatagattttttttgagacgcagtctcgttctgtcgcccaggctggagtgcagtggcgcgatctcggctcactgcaagctccgcctcccaggttcacgccattctcctgcctcagcctccagagtagctgagactacaggcgcccgccaccatgcctggcaaattttttgtatttttagtagagacagggtttcaccgtgttagccaggatggtttcaatctcctgacctcgtgatccgcccgcctcagcctcccaaagtgctgggattacaggcttgagccaccgtcctccaaatatttttaagagaaacatttcctttggattgttattaaattattactagtatacatttcaccaaaacagcataaatattaaaattgtttgaaatgcagtctttaacggcatggatgttgggggtgaataggcatgagaactccttatgttgcttaaaaaaggcaacttcacgtgttctgtgtttggtgacctgatgccattcagtaaaggggagagagagggaggtgtgagaggatacacaacatcaagccttcaccacagacaatccaggtttaagaaaaactacaaaagaagttgaagacctggaaatggacctaattaaaaatactctcaccgccgctttgttccctccaggtctacctaccctttgcccatttgaagactcagacttacgttatggtttgtaagaaaaaattgtgagacctggatagtgcaaagttacactcaagagatggacttagaaaataagagacttctgagggttgggtagcaccagaaatacatattatttgatggggtgtagtggatgagggcaagaaattcagaggttttgaaactgggtaactgagcaggaggaggctgtcatgctctgacaaggaaatattgcgttcatttttgaacttcttttatataatcagtgattatgagaaatcaagtttatttaggagaaaataaaatcaaacacccagatgggagtattccatttgtttttagttttaatgagtcgttttgaatgtgtaatcattgaacttgtaagggattgaatttccctttcttcatttcactcagccgaagacgttttaaaatgttaattttactcagagtagcttcatacttggtatatgttatttcatctggaatgcgttcttgcactttctgagactaagtcttagataccccttgcaaaataattcccagttttctctgatgaatcgtgcccattagtgaattctgtggagagatgatcctatgaggatagggcaatagcaatcatctaaacattatatagaaaatttttgatgaggccgggcacagtggctcacgcctgtaatcccagcactttgggaggccaagacgggtggatcacgaggtcaggagtttgagaccagcctggccaacatggtgaaaccccgtctctactaaaaatacgaagaattagctgggcgtggtggcaggtgcctataatcccagctacttaggaggctgaggcaggagaattgcttgaacctgggaggcagaggttgcagtgagccaaaaacgtgcccctgcactccagcctgggcaacactgcgagtctgtctcaaaaaaggaaaagaaaattgttgatggtccccatcactctccttccttcctagttcacttcagcatattacacattttgttagactcatctttgaaatatctttttccctagctgtcttctatatttgcagtctctaagtttgaaacattaaaaagtcagagtacttgatgtggaaatcactttttctcacctaagatagaaggaaattcttatttatttatttatttatttatttatttatttatgagacagagtgtgtctctcttgcctaggctggagtacagtggtgcaatcttggctcattgcaacctccacctcccgggctcaagcaatcccaccacctcagcctcctgagattacaggggtgcaccaccactcctggcttatcttagtattatttatggagacagaatttcaccatgttgcccaggctggtctcaaactcctgggttcaagcaatctgcctgcctcagcctccgaaagtgctgggattacagacatgagccactgtgcctgttctgaaggaaattcttagcatataaataaataaagtgtactggatttccttaatcattgttatttaggcttatgcttacctagttctttagccaggttaacataaggtattaataatgtaatttacaacacatttgctcattggaaagatctgatcattggaaacacaaagagagcactgcaaagcctgctcttaaaaaaaatcaactataaaaataaaagacaaaaaaccccaaaagaacaaaatccaaaaaaagaaaaaaaaaaccaactgtgatgttacaaaaattacaaaattgaacatttcaaaatgcttctgtatcaaatgacttcttctgttaacattgggcaaaaccttgcaaaaaagggtaagttagattttttttttatttgtagagaccacagactgccagaaaggggaatttaaaattacaatttccccctctaatataaataaatctatatttttaatgcataaaattgtgacttctatttcattttaaaaaaacaacattttttagaaagctcaagtcttaaaagtaaatttggcttcccaaatggaactttttcttcatctctctttacatgctaaaggagctgtctgatcctatagctttggagctcatgtgtttaaaaaagcagattaaaatctcaagatactctgacaaggtgtacttagacaagctggcttaccatgtagtaactagaaatgcttttatttacgttccaattaaagaactgacatgtgaaaacaattttaccaagtgaaaacaatttaagtagaacagggatggaatatgtctcttgttgccttataaaaaatatatgtttatcagtttgtacttaaaatccatattgatcagtagcaaaagactgcaaagatcccattaatttattatttaattttaagtaatgtaataagagctagttaacttagtttaaacgcatgagacttttttaaaaaacccacccatttctgacataaccaaactgaggaaaattttgcaaattatgaaaattaaaaattacctttgacatatataatattacatgtattttatatatcagaaactatacaatataggccgggtgcagtggctcacgcctgtggtcccagcactttgggaggccgaggtgggcagatgacctgaggtcaggagttggagaccagcctggccaacatggtgaaaccctgtctctactaaaagtacaaaaattagccaggcatagtggcgcacatctataatcccagctactcgggaggctgaggcaggagaatcgcttgaacccgaggggctgaggttgcagtgagctgcgatcatgccactgcactccagcctgggcaacagagcgagatgccgtcttaaaaataacccaaaaagctacataatatatatcagagactatgtataatatacataatacctatatattttatgccttgttttagaaagactactttctactcttctcccactcccagaaatgatttattgtttgttaacacctttatgcaaattagtttgtgctattcctcaagaattagtgtatgtatagagaggattacaggtagatcaatccataggaatgatgctcttgtgagagacatttgattgagcaatgtcgagggcactgggtttatattccattgccaccattgtgctgtggtcatggcatttaatttctctaaatctaagatcgcgtgaagtaaaactactacgtttttttctgaagtctaaatgagacaatgaatgtgactcagcacattgtctagcacatacagatgcaaactgctatcattactgttgctatttatgctactactactgaagcaggatatttccctgatccctttgcaggcaggaactagagtgcacaggcactagaactagccagccacttcagtgtcagcaggggcagagtctacttgcttggtcctgctgtgttccacagctcatgggtgggggagtgcaggtgagcgggtgcaggagctggggcaagtgcttttgggtgctagcaggcaaaaatctccatggaggccctgcagcagtttctagggaggtgcccgagacccctgaagccccagaaggaatgttacagtgccattttagctttgccattcgtggacggcttaagtgttaacagctaagtggagggtgcacacacactcgtggcacccaaattcttgtctggcttccaggaggaatgaggttgcatgatcgaattagagatggtaaatgcagaggatttttattactgatgaaggtggctcccagcgggaaggggagctgaaaaggggacggattgggaaggtaatctcctctccgaagctacgccttcaagctgtccctctgaagtcaagctgcttctctctgacgtccaactacaatctccagtgtccagctgcttctcctttgtctgctggctgagcctggggtttttatgggcacagtaacgggggggggtggggaaggctatgggtggttttggaaaggacaacatttgagcaggaaaacagggatgtaagttctcattttgggctgcagttccaggcttgaggatggagccctcaccagggacctgcccttttctacccagaatttccctgcctcccctccctatcactactactgtatcactaatagtgccgtaatttggaatgggctagggagccttattagttcctctgtaatcattccaattaaatgacttcttatggcccatttttcaaatacttttttttaggtcgacgacttgtaattatacatatttatagggtacagtttgacatttccattcatatgtatgttgcataatgatcaaacagggtatttagcttgaacatcactttacgtgttcatcattgctttgggtgtggacattcaaaagcctctcttctagctattttgtaattacgttccatggtttttttgtttgtttgtttttggttttgttgagacagagtttcactcttgttgcccaggctggagtgcagtgctgcgatctcggctcactgcaacctctgcctcccagattcaagcggttcccctgcctcagcctcccaagtagctgggattataggcacccgccaccactcccagctaattttttgtatttttagtagagatggggtttcactatgttggccaggctggtcttgaactcctgatctcaggtgatctgcccacctctgcctcccaaaatgctgtgattataggcgtgggccactgcaccccaccctgttccatgttcttaagacctaaagtcttaaaataactttaaagctaggcatggtggctcacacctgtaatcccagcattttgagaggctgaagcgggaggatcccttgaactcaggagttcacttgaacctaggaggtggactctgcagtgagctgtgatcatgccactgcattccaacctggatgatggagtgagaccctgcctcaaaaaaaaaaaacaacttttaagacttccctttctgtacaatgcatttaagaggtgggggagagaattgcctattcctcttttcttcttttaccttctttctcatttttatatgcttttcaaatgaagaaattttttctttttgtatctatttattttttccattctctcatcatagctccagggacaacattgttctaatggtaataacttgttcaggaatgagtctaagatgttttgctgattcttatctctgattctcctttgtttgttgttttcatattcagatttctctctcctgttatgctaatgtggaagtattatgatccccttgagtctaagtgcttgggtgatttggaccctgcttaaaagaaaggttttcttccttcgtttttgaggaaattgggctcagacctaatgatctactgtcaagaaatactgttagctttatatgttagtctttgaaaatcatttcatttttctcaaactcactagatagtatcacatataattttataatttagttgtttcaagatgatagcaagagtaatgaatccttcttttaataatggttgttttcagcaatgattagttttttattctatttttctcaatttttcaaaatttaaagaaacatgcattgcttttaatagagaaaaaatgtatatttttaaagaacaatggagatattttttcattactttatgtgcactacttattttatgcgttttttttctaagggaatgggacaggttcagccttataagatactacaagcccaaccctcaaatgtacaattctctctttagaaggactttaacaaaatgtgtagtaattggtatatttaataaaaaaaaaaaagtaaatagagaatcattaagtgatctccaagtatgcttatttttctaaatatacttttaaagatatataagtggtattattagacttagaaaagccagaagaactgatatggcaggtcactagattattttataaaatatgcagccttgtttgtattttaagacactaggtatattatgtgtgtcaaaatcagatcaagttagaattttgagagtttactatgcatgcaaaagaaaagtttatgaaccagaaagacctcaaactgaaaaatggcacgaagtctcaattttacagccattaagacagcacagttcatagactgtaaaataggaagtattttgacctttcccatgattggctgtcctatattcttctttaaggcaaacaaagatgtgtaagctgatttgtctatagttgattggtttaacttcactgactcaaaaggacaagaagtttatgtttgtgtttggggttattgttctgtggaaatcaagatgccttaagttttggttacctatgtacagtggccttgtgtatctaaactgtgtccaccatttttatttattaaacctatgttatctttgcagtttgtctggaaacttttttttttttttttttgagacagagactgtgtcacccaggctggagtgcagtggcacaatctcagctcactgcaacctctgcctcctggattcaagtgattgtcctcagcctcctgagcagctgggactataggtgtgcaccaccaaacccagctaatttttgtatttttagtaaagacggggttttaccatgttggccaggctggtcttgaattcctgacctcaagtgatccgcccacctcagcttcccaaagtgctggggggttataagcgtgagacaccgtgcctggctaggaaacgtttttatctttaaaaattgaactctacttggggtaaaaccttttgttgctcttgcaacagttaacttcttcttcccgtgttttaccttcataattgataggcacttccatcctaatatttattgaaaaatagttaagaaaaaggatgctgtgctatgacaagattgggttctaaatccagttattccacttactgctcttgactatagacacatcattttattttatttttttgggacagggtcttactctgttgcccaggttggagtgtagtggcacaatcacgactcactgcagccttgacttcctgggctcatgtgatccttctacctcggcctcccaagtagctggaactccaggcacacactaccatccccagcttttttttttttttttttcacctgtagacatggggtcccactagttgcccaggcttaacttgaattcctacattcaagctatcctcccaccctggcctcccaaagtattgagattacaagtgtgagtcactgcatccagccagacatatcattttaaacatctctaaactttggtgtttttatccgtaacatgagaatgcatcagtggattaatcaaagtccttcaaagaaacataatatgtgtgtgtgtgtgtgtgtgtgtgtgtgtgtgtgtgtagtgagggagaattcactcttgctctgccattttgtttaatttgagccctcaaaggattggatgctacccacccattgatgaggatggatcttcttttactctgtctgctgattgaaatgctaatctgttctggaaataccctcacagacacccagaaataatgttttatcagctatctgcgcattcagtagccctgtcaacacgtaacattcacaatcatagtaaggataaactaagttatgttgtatagtaaaatcgcctccaaaatctcagtggcttataccaacaaacatttatttcttgttcatgttacacacccatcatgtactggctgaagttctgttctagttttctccacttcagaacttagaccatggagttaggggggaaaagagactgagagaatcactggtttttttgtttctatttttatttatttatttattttgagactgagtatcgctctgtcgccaggctggagtgcagtggcacgatctcagctcactgaaatctccgcctcccgggttcaagcaattctcctgcctcagcctccccagtagctaggattacaggcacgcaccaccactcccagttaattttttttcttttttgtatttttagtagagacggggtttcaccacgttggccaggatggtcttgatctccttacctcatgatccatctgcctcggcctcccaaaatgctgggattacaggtacgagccaccgtgcctggctgagaaccactggttttaagtcttttatcctgaagtagcgcgtgtcatttctgcccacatttcattggccatcccaagtcatatggctactcctgcctataggcaggggttatactactcccacagagacagaagccagaatacttactggcaaacagtaatacggtttaccgcagaaacagtaaaaaaaaatacctatgtcatagcatcaggagtcaaatgagatgcactcaaactgttccgcagactgcctaacactgagtaagtgcttcattgacaaacaaggcaattagatgcttacacgtttatagaatgcagaggagattattgtctactttgcatccccaatcccagaaagatagtttgatgtttagtaagtatttgcttagctacatcatttacataccaaggaagtcttaactaaagcagttaaatcactaggccatttttctgtgtactgcttaaaccatggaactaaagttacctaaggtaagcctcagtttggataatcaggtcatagataaatgacttaaatattttaagataaatctttaacatctgcctttccattggattcctcaattatgtatatcatatttaagagaagccaataaaactctctgagctgacggtacagcctgagctgccctttccccattaaattgatcagctattgattcgttctgttggtgtgtagcagtcttttcttaaatggaacaaaggcaattgtgtgtggattttaaggctttttatagcgtatacctgttcatataatgtttgtttgaatcaccaaagattttgctgttagttttagtttttctctttgttattttatttcaaaactaatacagcaaaattgagtttttcatatgtgttccattctatgaattttaaaatatatatatatagatacatgtaaccaccaccaccatcatcattagacaaaaactctattttgatttcttgtccttaacagagcagaataataatttaaaaataaaataggctcggcgtggtggttcacatctgtaatcctagcactttgggaggctgagacaggcagatcacctgaggtcagaaattcgagaccagcctggccaacgtggtaaaaccctgtctctactaaaaatacacaaattagctgggcgtggtggcacgtgcctgtagtcccagctactcaggaggctgaggcaggagaatctcttgaacccaggaggtggaggttgcagtgagccaagatcgcaacactgcactccaacctgggcaagagagcaagactctgtctcaaaaataaaaaataatgaaaaaaataaaacactgataatattagttgaaaataaatgtgtttgtgtgtgtaattataactgttagcattttatcattggtttcaagatgtgtatttctatcttcataatgtaaagcctgatgattgtgacactaagatgaattggtaatggtaagggaacactgaagtccttttacatttctgtgaacgctaattacaacagatgttttgtctcaacctgttttagcacaaatactgaaaacgttaactcttagcagtttagaagagaatttcctgttacagttaagttatagatcaaatgtaaattagaatctgttcacaatatctaatctttgtcatttgggtcgtaagaattggaaagtttcctttcttgcgctccctcattcactttctgatgcgattaatgaaaatgtattagtaattgctagagtaaatacagatactggtaatttacttagtagctgttacagtgccattaatgaagtaatggatgaaatatgtttctggtcttattctatcttatatgacttggtaagtgtcgaaggtgaatccagaaataggatttcctagaacactggcattggtctttcgaacattgcctagaagtctttgtaggacttatgccaaaataaccatactgatttattgggacattcagtcatttatacattcaactacaatgtaagtatttggggccaggaattgagcaagggaatagggaaatgaacataaacaagatatacctgtgggatatgaggatgtatggtttaattgcaggatagggaagtaagtgctaatacaaatctatacattgtgctttggcattgagagtagagctatcaactgtctggaaaaagatataaaaaacataatatcgttacagcagggatgaaagcattatgctgagtgaaataagccagatacaaaagaacaaatattatatgatttcaattgcagtagttaaattcatggagacagtagaattgtggttatgagaggcttgaggagcagttatgggagagttgtttaatgggtacagagtttcagtctgggaagatcaaaaggttctggagatggacagtgggtggtggtttgtccaacattgactggacttaatgtcactgaactgtatacctaaaaatggttcaaaatcaaccagtcttgcctgggcacggtggctaatgcctgtaatcccagcactttggatggcagacgtgggtgggtcatttgaggtcacgagtttgagaccagcctggccaacacggtgaaaccccatctctactaaaatacaaaaattagccaggcatggtggcgggcgcctgtagtcccagctactcgagaggctgaggcaggagaattgcttgaacccaggaggcagaggttgcagcgaacggagattgtgccactgcactccagcctgggtgacagagtgatattccctctcaaaaaaaaaaaaaaaaaaaaaaaaatcaaccaggctcagtgtcatgcatctgtcgtcccagctacttgggaagctgaggtgcgtacatggctccagttcaggggtttgagtctagcctgggcaacatagcgagaccctgtctctttaaaaaaaaaaaaaagtttaaaatggtaaattgtatgtctgttttaccacaataaaacaataaaagtaggaattttaaaaatataatatcattatcattaatagtcacattctcttcattttaagagattcttaatttaaggaatttttatacttttcccccacctttttttttcttttcttttttttttttttttttttttgagatactctatcacccaggctggaatgcagtggcgcaatcttggctcactgcaacctccaactcttggactcaagcaattcttgtgcctcagcctcctaaatagctgggattacaggcacacgtgaccatagtcagcttttttatatatatatatatgtattttgtattatatgtatataagtattttgtattattagtagagatggggtttcaccattttggccaggctggtctcaaactcctgacctcaagtgatgtgcctcagcctcccaaagtgctgggattactagtgtgagccactttatccagcccacttttctcccattttttgtctctgttataatttttctaataagatcttatatgtaccagctaatctctagcaaggctatgccattagaatgtttgtgttagagccaggaaatgtgggtgaaacttgctttgccaccttagtcaagctaatataattcagaacatctgaaatagttttgcatgaaatgatatatttaataaattctaaattcccatgttttattatttaattgaaataaggctaggcatggtgggcatggttgctgatatctgtaataccagcgctttgggaggctgaggcaggaggatcatttgagtgcaggagttcaagatcagcaagcgtgggcaacatagtgagaccccgtctctaggaaaaatgtaaaaattagcctggcgtggtggcatgtgcttgtcatcccatctactcgagaggctgaggtgggaggatcacttgaggtgaggaggtcaaggctgcagtaagccgtgattgcacttttgcactccagcctgggcaacagaatgagactctgtctcaaagaaaaaaaaaaaaagaaataaatccttagatgttacaatatggttaacccttgaaaccaataagtgaaagaagccagtcagaaaacaagtcacatattatatgagtctatttatataaaatatccagaataggcaaatctgtagagttaggaagtagactagtggttgttttagagctaggagaagggttcatgaaatgagggaaaatgggagtggctgctaatgggtacagggtttgttttgggggaaggaaaatgttctaaaattagattgtggtaatggttttacaatcccgtgaatatactaaaaaatgttaattgtatattttgaatggataaattgtatatgaattatatttcaaactattttaaaaatatttaaagggaatggtatagtttgtctttttttggaggttttttttttctttagcatttaacttaaatgagctgaaaacaacagagcagtgtaaagtttagcattttgaacatgcatgtacttcataacaaagctatcatctgagagggctttctgtttgatcgctattggtgtggatgtaaacgcatctcaatgcaagtgtcaacatattcttcacatactgagtgattgcacaggggccatgctagtgtcattccaattttagtatatgtgctgctgaggcaagcacatactgagtgattttgttaagccaatagtacatatattcaaaactaggtagaatgtaatgatgaatttgatgactatagggcaataaaaatgaaatttagcagttcttttaaaaacgtatccatacatagaactgctttttaaaattaagtctgttttcattcaatttatttttttctttatattttaagttcagagaaaaataacaaacattgagatgattatcactttgtaagatgaggattccatggaatagtaccagatggaaacactgttttttaatctggttagccattctgcagttcctgcctgtaaaatggttaatatctatattttaagcagccttaatacatcagcccttccattataaatgacccaatattaaaacacatactttttccatgctcgctgctaccagagctcctcaactgctccccctcccatgtgagcagatacatgcccaccaaatctgcccttcagctcagactcacccagctcagagcaccgagctgctcatgactgcccttctttcatcagccacaatttgagctaaatgcttctttttcccttggtaaacctgagacccttcccttcacttgtaaattactttcataagaaaatgcattgtgggctgggagcagtagctcatgcctgtaatcccagcactttgggagtccaaggcagggggatcacctgaggtcaggagttcgagaccagcctggccgatatggtgaaacccagtgtctactaaaaatactaaaattagccaggtacggtggcaggcacctgtaatcccagctactcaggaggctgaggcaagagaatcacttgaacccaggaggtggaggctgcagtgagcccagattgtgcctctgcactccagcctgggtgacagagtgagatgaaaagaaaaaagaaaagaaaagagaaaatgcactgtggtttcaatctcaagcttcagcatacctttagaaatataatccatgatggggctacctttatttaaagtgtcttcattgttacaggcatacctcagagatactgcaggtttggttccagacctctgcaaaatagcaaatatcaccataaagcaagttacgtgaattttttagtttcctagtgtatgtaaaagttatgtttatactatattatagtctagtaagtatacaatagcgttatgtgtaaaaaatgtacataccttaattttaaaatactttattgctaaaaaatgagccttcagcgagttattatctttttgcttgtgatgggtcttgccacgatgttgatggctatggacttatcagagtggtgattgctaaaggttaagaaaggagctgtggcagtgcagcttctctcaaaattggagtcaaccctgtcaaactctgctttatcaactacatttgtatattatcataaatactttgttgtcatttcaacagtcttcacagtgtcttcaacaggaatacattccatctcgaaaccactttctttgctcatccataagaaacaactcatcatctgttcaagtttgatgatgagattgcagcaattccgtcatatcttcaggctccacttgtaattctagttgttttcctgtttccaccacatctgcacttactttctccattgaagtcttgaacccctcaaagttatccatgagggttgaaatcaatgtcttccaaactcctgtttatattgatattttgttctcctcccatgaatcatgaatgttcttaacagcatctggaatgacgagtcctttccagaaggcttttaatttactttacctagatccaccagaggaatcactatggcagttatagccttacaaaaatgtatttcttatataatgaacttgaaagttgaaattactccttggtccatgtactgcagaatggatgttgtgttagcaggcacgaaaacattaatctctttgtacatccccatcagatctcttagatgaccaggtgcattgtccatgagcagtaatattttgaaaggaatctttttttcctgagcagtaggtctcgatagtgggtttaaaatatccagtaaaccatgctgtcaacacatgtgctctcaccaggctttggtgttccatttatagagtacagacagagtcaatttatcataattcttgagggccctagaattttcagaatggtaaatgagaattggtttcaacttacagtcaccagttgcattatcccctaacaagagagtcagtctttatgtcctctgaagctttgaagcattgcttcaaagccttttgtatttacttctcttctctacctatgaaagtcctagatgccaccactttttaatagaaggctgttttgtctacattgaaaatctgcggtgtgccatagccatcttcatcagtgatcttagctaagtcttctggataatttgctacagcttctacttcagcacttgcttattcagtttgcactttcatgttatggaaacagcgttccttaaacctcatgaaccaacctcttctagcttcaaacgtcttctgcagtctcctcacttcaatcagcctttatagaattgaagagagttagggccttgctctggattaggtttgtgcttaagggaatgttgtggctggtttgatcatctatccagacgactgaaactttctccatatcagcaataaggctgtttgactttcttatcattcatgagttcactggagtggcacttttgatttccttcaagaacttttcctttgcattcataatttggctgactggtgcaagaggcctagcttttaacgtgtctcagcttttgacataccttccccactaaggttaatgccttctagcttttgatttacagtgagaaacgtgggacttttccatccacttgaatatttaaaggccttcgtcaggttattaattggcctaatttcaatattgttgtatctcagaggatagggaggcccaagatgggaagagccagttggaagagcagtcagaacacacacaacatttattaaatttgccatcttatatgggcgcggtttgtggcaccccaaaataattacaagagtaacatcaaagatcactgatgacagatcatcacatcagatacagtaataatttaaaaagtctaaaatattgcaagaattaccaaaatgtgacacagagatacgaagtgagcacatgctgttgaaaaaatttgccagtgcacatgcttgacacagggttgccacaaaccttcaatttgtaagaaacacaatatttgggaagcacaataaaatgatgtatgcctgtacttatgtatatacctatagatttacatataattattcatttgttccagaaattaaggcaggctgattaaatgcctgtttacctacttgaatatatgtttgtttacctggtcgagccaaactgaaatattactgaatgaaagtttgtcttcctattgaaattacaatttacacctcttttcgtgtatgttgatgtagttgtaacccatatctgtatttaaatgtttagtggtgtgcttagcacagtataagctattgtagaaatgcagagggaagagtaaaatataatttctggccttgtagcagccttgtagcattcagttctggagattcattattgtattgccaggaagagctaagtaaacactttggtaacaccaggaacaagttgctgagaagtcataaaggaagaagattctgaaagatgaagagaacacaagttgtcctaaactaagagtgctgagcaaggagaggaatggaagagaaagcaaaacaaaaaatacatactttgtctccttggggacattaatctgtgttaagtcatgattctctcagtggtagaaacatggactttaattaaggggcaagtgtatttttattttgtgttctagcagtataaagttgcaaggcctgtagtatgaagctaaagataattactagtgggaaggtttattttgagaaccacgggggtggcggggggagggggaaaccactacatttatcctacttgtttgctattaacattttaatttgtaaattggcatactgtagcagggcaaagtttcatctagctcagtatcctgtttatagtaagaggccaccctgagtgtttccaagagaaactgcaccaccctctctggcccggggtcatgtttgctggtaaacccctttcaaatttatgtcatgcaaatcagtaccagttatttctccttcacttgctagttcgggaactagcttatcagaaagctgttttatttattgataggttccctgtaatccatataaaattgtgatacagggaacttaaaatacttaccaaaagaaaaaaaataaaaaattagatgatttacatatggagtgcttactctattagcatatactggattatcttaatttattttcacaatagcccagtagccctatgaggtgaatattatccttctctccattttatagatgagaagaaggtacacagcctgagtgtgaagtttcatctcgcaaagtgtattacatgtcaagatgtcatttctcaccgcaatagatatgtctaaagctgtgagtgctgccactttagaaaacaaagatctttgtacagttatgtttcttaaatttgggggggattttgatgttcaagtgtgaagaacctgaaaggcagagtattctagcataaggccagcatatttactgtaggatgcgtaatgtgagtgtggctctgcctcgcccagctccaagtgtgcagtatggctacaaagaggctgctgaggccaggcgcggtggctcacgcctgtaatcccagcactttgagaggctgaggcaggcggatcacctgaggtcgggagttcaagaccagcctgaccaacatggtgaaaccccatctctactaaaaccacaaaaattagctgggcgtggtggcacatgcctgtaatcccagctacttggacgcttaggcaggagaatcacttgaacccgggaggtggaggtggcagtgagctgagatcgcgccagtgcactccagcctgggtgacagagcaaaattccatctcaaaaaaagaaaaaagaaaaaaaaaaaaagagcctactgaatacccagcccagaaatgtaacagtttcatgaaagtgtatccagctgcttttctactaaataagaaattcttcaactccaattccaatttagtagtctatatgtaacaaggttaataaggtatatacctattaattcctggtagagaaagtgtggataaaggatatctatgagtaattgtatttgataatcttagtgaaaggattattttaaacaaccgctgctaagaaggtgactgatttgagttcatctctgggcttcccctttggctaaaatgctaatgttcacagtcaatgaaaagaaaatggagaaacacagggcatggttgatccgtatgcatgactaactcttgaagagctgagaggtaactggacggaattagctggctctttgattccataagatccttcaaaatattttttgaaggatgaaatgaggtaacagatgtgaaagtgcaatactttgaaaactaagaatcactggacacatgcaacttattaatgagccactccctttatgacatttttattcactactggactctgaaaggccgtatgtgcctgctgtctctttcttttcacttttctttttctttttttctttgtttcttttcttttttctttttctctttctctccttcctttcctccctctctttcaaatcgatgacctgacagcatgcagcagtggagaagggccacattagtcatcttacctaatgcttacatgaatggtgacattacagaacttcacctctgtcactctttcttattcgccccctttgtatccttggaggaatttttaaacactctctgagtttttaatgtttttcacttaaatgtattctctttcgcttggcaagatacgttcttcttaatcttcatctcttctttctcttctttttatgcatcttaagtatgaaagttagtaggtgcccagtggtgaagtggctggcctcactgtcgggtcatgtgccttttgcgtaatagatactcaaaaaatatgtgactgaaattaaaaaaaaaaaaaaaaaaaaaaaagaaagaaacaggtgagttgtagagtttttttcctgattttttttgtacaaatatgtcatttgtcttggcaataatatttgtattaaaaaatgtgttaacctaaatttggaaactttctgtattccagtataggggattatgggatctcaagtgtttgccttaaatactgatgtttttcccacaaatgtaacaaggcagaatgtaaaactccttggaagtgaagtagaaatggtgtttgttttggaatcctgaaaaatctttttactctttaggcattatgtgactttatctctgttttgtcacctaagagaaacagcgagcatgaggaaataattgttgtgtggaatcctctgaaagtgatattgaattcccaaatctcatcatagaatattaccaactgatgttcactttaagagccttgatgattggtctgttttcagctagtatgtttatttgcttgcgcttgtggtgttgatgtgaggaaaaccattccacaatttgttaaaatgattagtgttttctccttccatttttttaaggaaatggcaaaaatccttaatcaccccagagtctacgcttttctgcacataccagtccagtctgcctccgacagcgtactcatggaaatgaaaagagaatactgtgtggctgacttcaaaagagtagtggattttctgaaagagaagtaagtctgttagtacttaagaaaataaccatttcttttttctttcaaaagcttgtggcaaaaatgcacttattgcagccttacaattaaaggtacaagagagaaggcgagactttcgaagctttcaaagcctttaagtctccttggcacctttgatgtggttttttctttctcctcagtttatatccaccttccatctgtacatgacacaccattaatttgtgtaagattgccagtctttttaaggtaatgtgaattgtgattatttttatacctgacctggtggatgaaaactgctttagctttgctctgtgtaaatctcctttaatgtggctttttgaagttatgagctggttttgacatggacagaggccaaattgtgtcactacaaaatagataattttctactaaacagcattttttaaagagtatctggaatgtctatgcttttacacacgaagccctgcagtttgcttaaagaattgtgatttacaagaaggtttgaggattctactttttaaagttcaaattgctattgaccaaaattaaggcatatttacacaatgtcagacatgaatgataattttgtttccacagaaaatactttcagcccttaattatgttcttcaaaaccctgctcctcatcatcaccaaacattgactgccttctgtgattatgctaggcaggaaatggaagtgttggcccaggtcacacagagccttctcaagtctacatcactgttctcccctctggggatatgtcatttgtcttggcgtatttgtggcctgggtcttcctacttttcatacattttttccatagccttttcctttgttgtttttcttaattaagatacaactttttatttccatcgtcttgtttataattatgtacctttgtactatgtcagagtactgcatggatacgattgctttatacaaattgtaagcaattattttttccacctttaattagtcatttatcctaactgcatatgatcattttaaaaatctttttcttttttttcctttttctattcttccatacctttccattacatatctttctaagtttttttttaacctctaggcattcttgattatcctaaccaccaagaataaagctacttagtgtacattcagacaaatacagctaattgtccaaatattcaaatcagtgcatagaagctgtatttgttaagtgctacagccttcaaagtggaaaatggaaaatagatctctaccctttttaatactttcaaatcttgaacagaactgtgttaggctaaagaatatagatttttatttgtttaagtatctgctgttggcctatagccctttcttgcctttcttctattattgcaggcaaatttgtctcatataaaagagttcttttgggcactctggcactggtaaatggaatattttcaaaatttcaagtcagttgcacttgtgaaatttcttccttctttgcctattacagcagtagccaataaaaacttgatacttgttacacaatattttcccaagtataaacatgcatcccgggtgcagaatagactagaacactttccagatagtttgttgcattagtgtgattaaacgaggttaaggaatcagcacctctcttttatctttatttggttgagggctgactcagttgttggaggaattactgtggctacttaaatgggcaacaatttcacaagttacgttgttctggaggtctgttaaatctgttccatcttggacagttccaacagcctctatgagctatatagaggtaaaaagatgatcatgtcaggtattaggaaatagtctcttggatttctttggatctgggtcctttcgttggattctgagttattgtgaggcatctatgtagtttttctagaagtattcaaccaactggaggatcctagaaccaactatgtttcccagggatctctagtatttctagcaatgaaaatattagacatacctggagaagatattggagatgcctggagatcacactccatcccatacccccccatatatagtttcagtttcaagtgccatgcgtcaattagattgtagagtatgagtctagtcagttagcatctctgagagatttttaaattaacgctgtattgtgtatatgcagcaagggcagaagcaaccctggtatataatttcacatttagattataagtaagatatattgcaaaactgtagtaggcagccaatatgatatacctgcttatgtatagcagatgactgagaaaacttcaggtaacctattttaaaaaaaaaaaaaaaaatcagattatcactgccaataaagtgatcctaggcccagtgcggtggctcacacctggaatcctagtacattgggaggctgaggtggatggatctcctgagctcaggagttcaagatcagtttgggcaacatggtgaaaccccgtctgtatcaaaaatacaaaaaattagctgatcgtgttggctcgcacctgtgatcccaactacttgggaggctgaggtgggagaaacaattgagcctgggaggcggaggttgcagtgagccaagattacgccactgcactccagcctgggtgacagagtgagacctatctcaaaaaataaaaaagtgatccttgcatagttttagacagttcatcagaaccataaaattgtgtattttgtctagtccatctgttgtgaagaataatatagacttactcccatgaggacagtataatcagctttgccatttagcgaaaaagagttttcctgtcctcttggggaagtccatctacctggtgagtaatttccaactattatggacatttagaagtagatgaaatattttagactaggcacagtggctcacacctctaatcccagcactttgggaggctgaggtgggtggatcacctgaggtcaggagtttaagaccagcctggccaacatggtgaaaccatctctactaaatatatatatatatatatatatatatatacacacacacacacacacatatatacacacatacctacacaaaaattagccaggcatggtggcacgtgcctgtaatcccagctactggggaggctgaggcaggagaatcacttgaactcgggaggcaaaagttgcagtaagctgagatcgtgccactgcactccagcctgggtgacagagtgagactccatctcaaaaataaaaaaagaaagaaaaaagaaataaatgaaatattttaaatagttcttatgtttgacctaccttccgctataaaaactagtatagctttatgccaaatagattagtgctcattttggaaacaccaaagtttcagggctttctttagagccactagcctggataactgatccagcacaaaattgtcttgtccagcctttattaaaattcaacacagtattttcactcttggaggggcctaacactatcatgttgccctgatttgtgcctaacgctcattcataaaatgatcctgacttaaagtggtatgtttggtgctttctttttctgtttgctttttaaatcctttctaaatggcggcccatttcatttacatctctcatttcccctgaagtctttgaagccttttttgtaatgtgcctttaacaaataagtctctcttttttctccagcagtgtgaggcttctcaaatatttgtgttatgagttatggacaaggcatttcctgatctgtttccttaaaaaatccattttttaagacaacctatagcatttaagattgaaatccaaactgtgggagtttacctgaagctgcaagctttcaaactgctaattttgtggtattggtagagccatgaaagtggaagtgaaatctttttaattaattttctttgcagttgaaaatggcccatgttttagctggtagcaatgtaagtttacatatgagccaactaagctggttcattattctcttcagttgtttgaaagttggcagccatcatcacaacagcagctggatacaagataacctagcagtgttggcacatgttgaggcatatgggaatttattaaatcatgcaacctttgcaaagaagagcgtctaaatgacttaatatactaatttaaaacagctggccatgagcaatcatatgacttaaattattctattcagatttattaatccaattgaacattaactgagtaatttgatgtttttatctaaatggataagatgattttttgaagtataaaatgggatttgtagggataggggaagaaactatatagaacaaagcaagcggtgcaattctggttttagaaataatctgtgtttggctgggtgcagtggctgacacctgtaatcccaatactttgggaggctgaggtaggaggatcacttgagcccaggagttccagaccagcctgtgagaccgtatctctacaaaaaaataaaaataaaaaaactagctgagcatgctgatgtacacctgtagtctcaactactagggaggctgaggcaggaggatcactggagcctggaagttggaagttacaatgagctatgatcatgctgctgcactccagcctgcgtgacagagcaagatcctgtctttcaaaaaaaatttgtctttgtattttaaaatatgtatcttatatattttactatcattcattgtcacataactgatgtttctgttatcttttaaacttattactgagatgttttttaaagtataaaacatgaatgattcttttttcttttttcatgtgtttttgagagagttacttcccaattcaatgatttttgtactgcgttatgttggggatgatataattagggttcccagggccttgaggcattagacaattactttaattgggcctctatcatttgagcagcagtgaatgtatagtcactccccaacataaaccatgcattaacatatattcaaaaaatgacaacatgcgcagttcttaagcatatgttttaatgctaagtaaaagaatctttaagtcctcaagttcacacattaaaatgtgaaagaaacatgtaagaatatcctacggatagatatttaggaaatgaaacagtttatatattaaaagacctaactctttagacagagtattttgttagaagtccagtagctttttagtttatgttaactagaccttaaatagttaacatctctatctttctcacttggtaaatacaatttgaatgaattaataaacggttttgtttttacctgcaagttgcatggatctaacgttaagttgcatcttactgtggcgtctccatgttgatttttaatcccatgatattgttcattttagaatttgccattatcatttcttaaggtactgtgcacttcagggttaatttcccttgttgcttatagaatattaaccattttagcactgtgatatttattattattcccgtaagttcactatacccagagattgcccagtgaaataccacagctaataagcaatgagcactcatgggtaaaggggaatcttttgcagggcgaggagagaacaaactagaggggaagtagcagacttgcagaggaagtttcattctgtgatctctccgctgtatactcattcaatggaaggggcacaagggcataaagccagtattacttggctttatggcaggatgatgactgtgagtgagtcattgagctaacttatatcatccagcccatcctatgacctacttttccagtctatctgcaaaaaggatgctaaattattaacatcctgagtaatttttctttcctatcattagtcctggtcattcatgtgtgcttattggaacacaatctgataaagctatgttacattaaattagtattttattctgccttattcatctagttttagtcctagtggcttggaaacataagtagaatatttatcagaagaaaagaaaataaatgcaaaagaaaaaaaaagaatgattcagcaaggattagataattatattttcttccagatgcattcccagatgtgtttctgttcactaagtaaccacctccaaaatactttaggcaaaatgcttccctgaaaaatgttttctggctttatgtcatcatttctagtatctttagctaagttgttattttgggtagcactaaggtcgtgttcactgtttttatcttttgccaaatttctttctgaggtagtgaagttcttttcccttctctccattgctacttttagaacttttctaatgaatacatatatatcattggatcagttatttagcagaaaaacatatttacttttttttccttctccagtgtgttgttatatttagaagattatatgctaaatagattatgacacaatgtgctaaataccgtaggattctgggactaccccaaattcgattcactggtttgaaggcaactgttactttatgttgacttgctttccatttccttgtagtctggtcaagaaaggaacctcatttttcctaaacttcattcactttatatccttcctttacaatatgattatgttattcctttcagaaatcatcgtctcttaatctcttgtgcatttttcctgcctcagtggtatatcataaacataaaggtccaatcacatatacatgaagtagtagaataataacgtttttctttttttgacagagtgctttcatattccacagagcttgcatattaactcattatgttaccaaaacttagcaaagtacatagggttagtatttttaatttgcattttataaaacaaatgtcagggttcggaatggttagaaagagttgttgaggccaggcatggtggctcatgcctgtaatcccagcactttcagaggctgaggcagacagattgcttgagtccaggagttcaagaacagcctggacaacatagcaaaaccccatctctacaaaaattagccaggtgtggtggcactcgcctgtagtcgcagctacttgggaggctgaggtgggaggatcctgggaggcactcgcctatagtcccaagtagtcgcagctacttgggaggctgaggttgagcctgggaggcagaggctaccatgagccgagatcacaccactgcattccagcctgggcaacagagcaagaccctgtctcaaaaaaaaaaaaaaaaaaaaaaaaaaagcccacaatgaattaatgcatactggaactatataccctcagtttctactgtggttctttttaccagttccaatagcatatattaattaaatgatttctatttttatcggttatgtgtccagactagtaataaatgcaatggtaagtataccgataatacttaacatgataatcataataaaacaattatctaatatttttgggtgtttactttcatgccaagcactactgttaaagcattgtatgtcttagattgtttaatcctcaaggcccaaagatgttaagtaatttgcccaaagtcatgcagttagtgatagaaccttgatagaatccaggccaggggattacccagccagtgctcttatccatagtgttgtactgctggtctaatctaaggcattttcctctagcactggagacaataaagtggattcagcaaatattgaggagaagaaatttacaatgtacacttagaagagaagatgaggaaggcatgcatgggtgtcaaaagtagctccttggtatcttaagtaaggcataataatagaaaatcatatagttaacccagatagggaaatgagaaggaggaggagtttaggtaggaaagatgagtttgatgttagacatgctgaatttgcagtgactgcctggaaaatctaggatagagccccccttaggctgtagaaaatgtgggtcaggagccaaaaagaaagatgagggtctagagataaatgcttgggagtaatcagcatttgagtagtagatgaagttataggtaatgagatcatccagaaggaaaaatggaagggtaagaacagaagtctagggaacaccaatatttcagtaataatgggaaaggaaaaaggattctgtggcaggttaaaaaggcagggtcaggcccgtggaggtggagacccaggaggaaataataccacggaagccaagagacaatacagttgtaggaaaaggaagggaagaagggccaagtgttattgagagttgcctcttataagcaagcactgggctgggggctctggagaatatgaaaaaacaaaaaatattgttagattgctttcttttccaaatttcatgagtattcaaaagctattgagttgtactaacgtctaaagttagaaatcttcatggtccttttttgactgcagcatccccagttccttgcacagtgcttggtttgtcctccttgacacccccacaactctgcaccgtatatatggcaggaagggactcaagagtaagaagcagggataatacgtgtctgttgaatgaatggcacttaactctggaactaacaagagtaaggcttagagcagtatttcttggtctgttttaattaaagttctcttttcgtagacaagaaaatcctcttctctttgcagaaaaagtgatacattccttttaatagcacataatactttgccttcttagagattctgtggacccccgctggctaatagctaagaataattattaggcaatatttattgagcctataatatgttgaaatcagtgtagtttacatggtactaagtggtttacatgaattaactcatttaattctcacaatggcacatattatatacaaaatcttatccccattttagggttaagaaatttaggtacatagaagttaaataacttgcctgaagtcacagtgctaataattgccagagttcagattcaagctctagcttgtggatctccaaattttatttattgctattataacttccaagtaggatagtttttggaaacaatagggatgataattttccaattgaaaattatactacactattgaatagaaatgttatattatacatgccatctcctggacatttaatacaacattctatagtcaatatcgcctcctttttaccttcactctccatccagtcactgggtgaggggatcaataaagaagctgtgtttgttaaagcagaatgactatgtgctacagcagtcccactactagctgtttatccaaaggaaaggaaatcagtatcaaagagatacctgttcccccatgtttattgcagataaactatgcccaatagccaagataaggaatcagcctaaatgtccatcatcagatgaatggttaaagatatagcacacaccagaatactattcaaccataaaaagagtgaaattttgtcgtggcagcaacatggatggaaccaaaggtcattatgttaactgaaataaaccaggcacagaaagacaaataccgcgtgttctcactcatatgcaggagctaaaaaattgatctcatggagatggaacatagaatgatgcttaccagaaagtggaaagggaggtaggtggtgatgaagagagattggttaaggggtacaaacatatagctagatagaaggaataagttctagtgtttggtagcacagtagagtgactataattaacaacaatttattgtatatttccaaatagctagaagaggagatttgaaatgttcccaacacaggaaatgatacattttgagtaacagatatcctaaatactctaatttgatcattacgcattgtgtgcatatatcaaaataccacatataccttccataaatatgcatagtattacgtatcaattttttacgtaaaatgtttagaaaatgaagctatgtttgaatgtgaccatgaggagaaaaactacaaataaaagtaatgagtgttttatctgtaataacatctttaattataaaactgcagagtttcttaatgaagtatgtgtacgtgttttaaaatgaaatgctaatgccagtggttgttaacatgttgtgaagctattatccattctaaactacatttcaaaaactttaagccctcatgtcttcctcctacttatctttctttcttaaagccaagtatattaaatctctagcttaaactcctgcccataagcaccctgtattcctaaccagagatccatttcatcacttgctgcaggcacaaggagaaagagtcaatgatgggtcactgttgcctccttgtactcctccttatcatcattctcacattcactgagccctcattatgtgaatgggccactctaggaccttatattcctactgaaaatcaggaagaaatcaagggagcatgtacagtatgtgtacttttgaatgttctagtcgactttgcagtaatatcgaaaaggtgccctaattaagtcctcagaaaaaatgagaaaaagaagactgggtaatataaccaataatttttttaaaaggctgaatctcagattattaagatctgaccagggctgggcgcgatggttcacgcctgtaaccccagcactttgggaggccgaggcgggcagatcatgaggtctggagatcgagaccatcctggctaacatggtgaaccctgtctctactaaaaatacaaaaaattagctgggcatggtggcgggcacctgtagttccagctacttgggaggctgaggcaggagaatggtgtgaacccgggaggtggagcttgcagttagccgagatcgcaccactgcactccagcctgggtgacagagtgagtctccatctcaaaaaaaaaaaaaaaagccaggcacggtggcttacacctgtaatcccagcactttgggaggccaaggcgggtggatcacaaggtcaggggattgagagcatcctggctaacatggtgaaaccccatctctactaaaaaaaatagacaaaaaaattagccgggcgcggtggcgggcacctgtagtcccagctactcgggaggctgatgcaggagaatggtgtgaacccgggaggcagagctggcagtgagctgagatcatgccactgcactccagcctgggtaatagagcgagactctgtctcaaaaaaaaaagaaaaagatctgaccaatttgaattctggaaataagatcaaaatgtccctgtgaattaacattaatttcaaaagagattaaattttgcatttattctactagtatttattggttatagaccgtgtgtctggcacttgttaggtatagaatattaagagattagtaaaacttggtaactgtcttttagggacggatattcttaagttgtggttaatattaggtagatgtttataagccagaatgtttggtaagaatggtaaaaccccagtgttaaatccagtatgcaaggaacataaatgtttactataggctttttatggatgagaaagaaatactgaatttacaggtcttccatgaaaatcaatcccctttcttcacacaattatactttataggtttcattttatccgtgatatcattaaatctaccagtatagggaaaggttttaactaggttacatacatacatgcacacgtttgcatgcatatatatttatgtatataaaagttgtagtttgattcatctgcaagtgacagaaaaaatatggcataaaaaaaaagtttatttctcagtcatgtaaatgaagtccagagccagatggtggaactctgtaaggctccagcatgtcagagatgtaggattgaactttcatctcatggtcaaagatggctgcttaatctccagccatcacatctgcattccaaacagtaggaaggcaaggggcaaacaagagtgtgtgtttcttcccttgtaatacttcctgaaagtcatacccgtcacttttgattatgtcaaattgtcagaacttagtcatatggccacacttacctgcaagagaggctaagaaaatttagtgtttagtttgagttttttgtccccctttaaagagtctcttggaaagaaggggagatgaaatagtggggagcaattagcagtctttgccacagtcaccatttgtccattcttcttgctacatacagaacttactctaagagagagagccccagtcccatctagttaccctgtcctcttataagtacatgatctctgggtgatgctctgtccttttcaggaagtccaggtgtggctttccatgggctgatggatataagctaaaaagcaacctaacattcccaatataaaatagaatggaaataagagaatatttaaagctcccatttgaaaaatgggagaataagaaacacatgagttttcaataggaattattaaaccttgcttggtggaaatcctggagcctttctgcgcaagcactgaaggacggtctttagtaccccatctgatggcccctggctttcctctgtgagggatacgccttagtcctttgtcctctgttgctcctgtcttctgtgcccatatttgaggtggcattagggtgaatgctcttctgagtgggttctaatacttccttctcgtaccagcatgagccccggcaattgctttaggggttgtacagtagcggctgtgcagaccatcctgcattttggcagtccaagtccctcacaaacttagtagccttttagtctgtttcttgtcagttccattaacaactataggcaaaggtcttaactggacgtagttttgaacctaaagaccctgtcttttatttactggcctctgtccttcttccctactctgaacttactgatgactcctttgaggtcatctgaagcactcttaatcccatctctgccaagaaactcagctcatgtatgatggggcaccaaccttctgaggtggctatgatactgtagccaatgcttgtaattgctatgcttggctttttcagacctgcaaacatcaaaatcacaggaccctcagtcaaatttaattctaattcacaaggagagtggttttcttagcaaagctgtttcctctctctctcttttctttctttctttcttttttctttctcttctcttttcaagtataagtccatcttatttctttttttaacttttttacttttaagtacatttatgtgggtacatagtaaatgtatatatttatgggtgcatgagatactttaggcatacactccataataatcgcagagtaaacgaggtatctgtcacctcaagtaatttacaatttcagcaaagctgctttcttactcagcttgcaaccagctagccctagtctgagttccttgttactaagagcagtaagaaggagccagctatattcaacattctgaattttttgtaatatctctatagctatagactaagttaacatttgtactgtcttccaagttctgcaggggacaatgtgaccagatattttgctaacataacattaattagttttccagcctgcagtatgagtccttgctgcccaaaatgtgacaaacgagtatcacacttttagattctgtcacatatagtatcccactttgattggattggtttgggctgtcaatgaccaaaaacataaaacagtgtctcagacaagatagatagatatcactttctcacattaaaaaagaaaagaaaagcttaagatgcttaagatgtagcaatcttgtgctggtggacagtccacagcatcaatgactcaggattctgtcctgttgctcagctgtcctctgtctcatggtccatgatgactgctgaaaattcaacctccacgtctgcattccagccaggaagaaggagaaagagttaaagaagtgtgtgccccaccctaccttgaaggttactgtctttgaaattgtacaggacacttcacttatatctcactgattagaacataactttccctagctgcacggaaaactagaaaataacacatttcttctggacatccatgtatctagctcaaaatccatttatatgggagatgaaaggaatggatataaaggggccactgaaaatctccaccacaataggtatgtctaaaaagttctcgggccgggtgtggtggctcacacctgtaatcccagcactttgggaggccaaggcaggtggatcacaaggtcaggagatcaagaccatcctggccaacatggtgaaccctgtctctactaaaaatgcaaacaaacaaaaaaattagctgggcgtggcagtgggtgcctgtagtcccggctactcaggaggctgaggcaagagaatggtgtgaacctgggaggcggagcttgcaatgagccaagatcacgccactgcactccagcctgggtgacagagcgagactccgtctcataaaaaaaaaaaaaaaagttctcatgttgtagggtaataacttcccctaaaaacaactgaattttttttatcatatctctaagtatctaattatgttctcttgagcatcaataccgaattttgcacctggctcaatatttggtttttgttctcatatggtgacaaagttttcatttttaaaaaatgcatatctcctattttaatctcacaaattaaacaatattttgaagattatcagctgtctgtgttgagtgactatcagaaaatttcatttgatgcaagacttaaagaaatttaactgctagaggtttttttctaatatcaaacaggaattggtgttatttcagttttttcacattctagatttccttattgtagtatgtatgcagcaattgcctcagcctcatggtgagtcccttttgcgattctataccatctagggcatatctttctcccactgcttctattaacaatcccaggtgtctagtacaggtgtccagtacattggagttagcctgctgccggaattactgaataatttcttgtcagaacaaaagagatggagaggagaaactcaaatttttctattttctttgttttcaacccagtgtttcctctaatttgtatgaggttacttacgtgatctgctttagtcaattttgatcaatgaaatcagtgtttttttgttagaagcctttaaagaagtaaacagatttctttttcctcaattattatttaaagcaaaatgcttttagtctgaccatgtaaataagaccaagcatcgacttttttatagaaaatactattataattcaactgtccaacagtgattctttttcctgtactttctcctaatttactgttattcaatcttttaattgtacattgggaaaatacattattctttttgagtttttttcttgaaaaaaattatttcgttgtccagtttgttttgactcttatcaacaattctgctaattgggtttctttctttttccccttttaaataatttgtactttcaagaatcgtgatagccgggtgcggtggctcacacctgtaatcccagcactttgggatgctgaggcaggtggatcacttgaggtcaggagttcgagaccagcctggccaacgtgacaaaaccacatctctactaaaaatacaaaaattagccaggcgtgatggtgcgcacctgtaatcccatggcgcgcgcctataatcccagctactcaggaggctgaggcatgagaatcacttggacccaggagctggaggctgcagtgagctgagattgtgccactgaacttcagcctgggtgacagagcgagactctgactcaaaaaaaaaaaaaaaagaaagaatcatgatacaattcagtttttggagagtgtttttctacttatgaaataatcaggttccatcttaacttttatggtgtaatcccccacattaatatgttcactgccttcaaataattctataattactaatatttattgaacacttagaatgtatgagtcatatatatgtgtatatatatgtgtatatatatatatatagacctcatttaattattacaacaattctgtgaaacagaatcctaatgaacccccttgatgtctaccttttatacgtgaggaaagtgaagcacagagagcttgaagttaggtagaagaattggaacccaggtttcctagttccagagctggtgctttttacctactgtacttcactcttcctcactgcccacccctctgaagagtgacctacctccccacaccacttgctgtctccaccttccctacctttcatcaactccttgatcctctgtaatctggtttctgcttactctgttttattgtatctgctcttgttaaatttctaattgtggactctggcaggcagtctttcatccatattttttcactttcttatgttggccaccccctcctccttaaatcaattcatttcagtcaatcaattctgtccccacgccttccattcatccatccatccatccatccatccatccatccatccatccatccatccatccatccatcttacttcagtgttcctcaggcacacatccaaacaaccacatcagaaactttttttggacttcctccttaccttctcccacccaatctactctggcaccaggtcccctcagtgtgtcttctaaatgactcatgtctaacttcttcatgcccaccatcactgcctctttaagtaagtataggtgggacattctcttgaattgtgttgtctcccaaatctctttcataactctagcctcactccttccaatccacccttcactttattgccagaaattttctttctaaaataaaaacgttgtatttctttgatcaaaattgtttcttagctccccattgcctacagtataaggaacagtaacaacaacagttataccattaccactcactgatttcttctacatgccaggaattatgcaaagtattttacatagacaatctccttatagattatctctccattatggcacataccacattgctctatttgattgcatgcatatgtcctctcctacagactcccccatataacataaggagtatttttgtgtgtatgttttcagtgcctggaacaaacccattaaatctttgttgaatgaagggtttcttttgttggtgttataagcaactaatttatgtttgtatgatgtggagacttcagaatcttgtagtagaagcaaatagaacccctcaggaaggtacagcaaaggctgtgctggcttgggcagaatactagttctgggtcaagggaagcaaacatcctgttacccagaacagccgcctcttctaagtctttacaaccacatcatcacctaattgtagcagtatttggggaatgggtgaagaagatgactatctctagggtttggttcagtacatacagcctgctactggaagtttcacacctatgtgcaccatatagtttaaggcaaaataaccgtattctgtagtaaatagactcaaaatacgtattgccttcctagctctggattgtctaattctttacggctgactccgtacactaaatggcagtgatttcattgttattattattataaaatggcttgttcttccaagctattatatatttcttaaatgattaacctttacacagccttggtatcccatgtttagcaataaaaattgttcttaattttctttcttgggtttaatttaatttcttatacattaaaatatataaaatttaatttaattcctccatttctgagatgttttaaagggtgttagctgaggttaccaacacttttaggtcatgttaccaataggaatttgacatttatatgaataaaaataatattgtgttacaaaaactaatatagaattgcaagggctatcaacctctatgcttgaggccataaattgattgccagcaggggtcaatcaggaggctctgcattctctgtacagtctccctggggtaaaccattgcagtatttggtgtaccagcagaaagggcagtgtgaatttacaccttcctcaaaacaaattgctgaaatattcacctcttaccagaggtgtggactcatagcacttcttatttaatgcctaacaatagggtccaaggttatttttccagaaataatatcaagccacggaaaataaatgtaataattttgtcaaatgtatgcagtcaggctttgtttggtccactctggtatacttatagagagggtcttatttctggtttttgtgcaggagctcctgtgaaaatgaactaattaggtgctaatttacctaaaacggagtgctaataccgaagttgatttttaaagtacaaatgtggatatgttgctattttcactgatgtctatttatttcatgtcaccttattggaaagtattcttattaaaatgaaattcctttaagtttggaataagcttctgcctgagtaatggaaattataatgagatataaaattgaagcattgcctaccctgttgcaaatattatgacattgggtactgttgataaaattaactattttagatcagaataaacctttattggcctaaaattgaataacacaagtttttatgttattatttgttttctgttattacgtttatgatttttttgttgtagtgtttttctgtgtgaaggtagcttgtgactctttttgttctccacttcctcacaggctatttaaatgaagttgtatcctataaagtaggagtttttttctcgtggtaaaagggaagatatacatggcccaccttgttttacctcctttgctttgtcgtctgtcatacttctcatttgttatttatttaattatttagagacagagtctcgctctgtcacccaggctggaatgtcatggtgagatacgtctccctgcaacctccacctgccacgttcaagcaattctcctgccccagcctcccaaatatctgggattataggcacccgccaccatgcctggctaatttttatatttttagtagagatgaggtttcaccacattggccaggctggtttcaaactcctgacctcaagtaatctgcccaccttggcctcccaaagtgctgggattataggcgtgagccaccagggctggcacctcctcatttgctgttaggtggtgctggtttttttgttttttaagctagctgatttagtctgtcctcaccttgagttactccttttctgtctttcttgctgtcttattttttaagagaaatcatttctacagttgcccatttgttacgacactgcaaatgtatcacttttttttctaattaagatcctgtatggcattctttctactgctgtgtcaggtgctgtgtatagaattagacttcctagaggaattttgtcttgcattaaaaaatagacttgaggctatataacacaaatattagtggtgtcgtctgtgattagatatatgaaatttacataatacctttgtcagaagcctgaggggttcatgcacttgtagcagcagcctgtggttctgctgttgtgaatgatgactgtcttgtatggtgtgcatcaccgtgatttccgaaatttttttcttaattaattggatatatatataggaatcatcatacagcaatagacaaaatagaaccattgaaattcatgcttcaaaatgtttcatatgctcacaagccactaggagatgctaaataacactatggctatttagtttacttttttcaactagcattgaggaaagaaccctagaagttgcttccagcttaatttttaccttttttttttatacagtggccactgtctcttttgtgtctttgttatccaataagtattttatgtccaaagtaaaaatgcttttctaacaccagtgttctaaatgatactgtttaaaagtcctagaagctgtggtgctaaccctattagaaacaaatttttctgtctcccctttttctttcactctttcctccaaaaaaagtaaaaattaagggataagatagtttttgccaatttaattaacatgattatgagcatgtggaattagactgcaacttagaagtcatagtctggcttccttcattttcatttgcttggagaagttatttttttctccctttcacatgtatttaatggcgggggcagtgtctggttttccgtggcaccacctggctgccataaaaggcttgttcactcacaatgttagacagaaatatatgttggttatattagaaatagtcccatatcttcaactacttttagctgtttttgacagaaaggaactctgttagagttcacaggttcacaggtactattacgtacttctgtcttttttattttatttatttatttatttattttgagatagagtttcactcttattgtccaggctggagtgcaatggcactatcttggctcaccacaacctctgcctcccaggttcaagcgattctcctgcctcagcctcctgagtagctgggattacgggcatgcaccaccacgcccagctgattttgtatttttagtagagacggggtttctccatgttggtcaggctggtctcagactccctacctcaggtgatctgcctgccttggcctcccaaagtgctggaattacaggcgtgagccaccgtgcctggccttttttccttttttttttttttttttaagagatagggtctcattatgtttcctaggcttatcttgaactcctgggctcaagcgatccttttgtctcagcctcccaagtagctggcattacagatgtgtgtgtgtgtgccacggtacctgacacaggtactattatgtaagtaagaatgaagagccagagaaagaatgctaaagcaagtatcttatgaacccagccacttagttacagagatactgaagtgaggtactgtcaggattttcttccaagcaagaactgtatgggagtaatcaaaatcacaatactgatgatagaaaatttaatgtagtccagtaattgagagcacaggcatagggccagttaaactgatatacagattagatagatagactaaatcctatctttgtggtatgtggaccaaattacttaacttctcttaccttgatttgcttttctgtaaaaatgaggataattacatcctttctttaaggttttttttgagaattgagataatatgtgttaagatgggcttaatacagtccctggtaggcactccttaaatgattgctgctacttttttatgtattcaaagcaatattaataacaaaacaaccacaatacagaacacaatcaataaatgatacctaaaaaataaagacaagaatttgttgcagattaagtgaaagacagcccatttaatctaaaatgcacacaaaaatatgaaggaaaaaaaacattgaaaatattttattttctttctacagcttttttaataaaatgcccctaagttgaacgtacagttcagtgggcagaactcacccaaaagattgagaaagcagagggtaaatatgtaatagttacatattaattgatatcaactaatgtctctaagaacgatgccatcctttggggttgtcaaagttgaaattaaagatacattttttcaaaaccagagttttcgtcaccatttgtacacctttctttatttacctcacctaaggtagcaccccacacactaattcaacccccatagtgccatccgtccggacatttcagttgcttctctaataaatgtctactttcctgggacaccttatggtccttgttgctggtggttagttttgtatgaagtcattgtctttgaagtgttgttggttgataatgcgtgggaacttatctttcttaaatataatttacctttggctggggtatttaatgtcttaaagcaaaagaagaaacaacagaataggtcaggaactctgaagggccaatgtttgagatcttgttttggaaggaatttcagcaacggtagctgggcagaaggctgacccaccaacatattttagcaaagctacaaggatttggaatgatagtggcccccagcatggcctcctactttgcaggtcccgaggtatgaaattaagttacatttaaaaatcagaattagttctctaatcttcagatagtgttaaaccttaactcattccactgtttggttataaataaataaacataacatttgtcccaagttgttctacaggttcacgcctagccatagagttaactttgagcattatttgcagtgcagggggtaaattatcttcaaaacgctcatggattggctgctgcccagagtcctgagagatgtaatcagtttcagttaattctaaacaatagattgtggcaggaactcagctaagtggcgggttgactgcacccaaactgttgatttaagttgtcaagagagcttgactcatgcttagacttgacaacagtttgggtcagctggcttagctgtaaaccattaccagtaaactctgctccttttgtgtgtgaggagggaagggggatggcccttctggtcacggtctccctccctgagctcactgcagactccacggcctggctgggaggctctttgtgacttttactgtgctcagacttcagtctcttcatccctgtcatgcgcatcagtgggtttctagccacaggcctgaggaactgccaatatagtatgtgctttgtgtactttctattcatttctaacttttgttggtgatgtttaacaggaagtgcgttactattcactgtaccgtaatccatatctgtacagcacttaatgctgttcacagagaactcatattgtccaatatattttaggctagggcagggcaggaattacattgcatcagcattaatcatccttgttaccttttgatgagatcattcaggttaaatactggttggaagagtgatctaaagttgaaggcatgaggataaatgtaggaaaaacattagcagtttgcttaatgtaagttttttttttaagtttgaagataaatgtttctcaattgataattttttttttttaccattagcctttgaacattagtagtaacaatttatttttatttaaagtttgtccacacatgcaaatggaaacatgttaccccttggatactagcttaaatttatttactccgaggtgatttaaagtccacatataggtatgcttgtttcagcaggtcagatttaaggataccttaatttagtgatgaggtactctgaaggtctgaacttgagaaggtgatccaaggtgactataaccttacacttcctgttagtacctggctcagagtctcaggagactttgagggcagtgttttgatatgaattgcctttgtgttctttctgtaaattagtttttggtatggaaagccagaaagctcaagtcctttaagtacataagtcaagcggctttttttttccatacccctgtcaaacattgtacacttatcgctttccttttataattttgaaagtctccaaatcattaaatgatatgcttctcagttgtggatggttccattttctaatgactattttgtcttctagagaatgtctgctaaaattcttcctgatttttattttactttccaatgtggttttcatttatcttagaacagtgtgcaaactttcactgagaatagaaacaataaacagaatggcacaatatatttttatttactatagatcatatccatttagctttttcatggccctttcatcattttctattgtgccattcactttagtgggtacgttagttactcacatggtgtgacctgggaaaggaacattacagttgtttttctttggtttacataatgtcatcaaatgaggggaaactgtccttggctgaagaaagtttcatgaattttaatgtgtaccatttcctttgttattaatttgtaaataaatatatgatagagagtaaaataatgaaagattttggcaattatattttagccaagaaaataatgagaaatacctattttcttgcatctcacattaacatctgttaggttacacttactattatgagatgagggttcactttagagatgagtcaatagtataaatattagaagcaattttctaggacaaagtatagaatggttttataggtgacatgtgcctgtgcaatgttgacctattaatagaatttatttatttatacccatgcacaggaatggaagcatttcacagacagacatgtaagaggttaagatttttaaaaatgcagctgaagaggccaggcatggtggctcacacctgtaatcccagcactttgggaggctgaggcgagcagattgcttgagcccaggaactcaagaccagcctgggcaatgtagtgaaaccccatctcttaaaaaaaaaagaaattggttgaagaaatcaagagaaagggcacaattaatgtaggaaaaatgagatgattacaatgataagattaccatcaaaaatacatgtcctccagcctcatacacttattagacttcatatttcatcacagatttttagaagccaatgcaaaaaagaaaatattatcagtaacatgctttacacagtctataagatagaggtgtcagagacggggaacacagctgttcctgctttgagactggaatggaaaatctgccagtggcctgtcttgtgatacttcatgtcctcatctctgggcacatgggaactgctttcctttcttcctcactgtaagtgagagtgccagatcacagttcaaaaaaagtccaagtacaaagtcttttcccagcatggcttaattcaacaacaaatttagaccagctagaggaattaactgatggaccccacatctttcagccagttatctgctgtttctcatggctatgtttttgataaaatattgggtagcagaaaacttgatattgtattatctgaacagtacttagactaaaaatgtattttgttgcccaataaggacagatccacaggctttaaaaatccacttgtctgatataactgtaattatttcttacgaagttgatgtgaaagaaatcattttaaattttgctctggttaagtgcagattgtacaatcagtcacctcttctccatcctttctcctccccaaaattctctttattttttggactataaaaatgggctaagataatctttcatcagtgtcattcatagtcaaacacactgtttttcttattaaacatacccctctctatatgctttgctgtatgtttcagttagtttttcttaaacactgacatgtctgctctagttttgttgttttggtttggtttggtttagtttatttgtattatatacttaatcaaattttaaagaaatgcaaaagtggatgaatattcctatttttcttcttttagaactttcaggctgtcccacctgacttctctttctgtttggaggcatgtagatttggggttgtttgtttgggggtaggaatgtaataagtagtgaaatgaaggggaacaaaaagaattttaactattattttctccaggccctggaaactgaagttcttagggcacttgagtatttaggtgctctaattattctctttgaaataaatagtagggtggttttataaacctctgctactatttctagctgtaaagaagtttatcaagagaaagaaagcttcattccaaacttctctgacagcttgctaattcatctgcttgcttcttgttggtttatattatcgacatggtacaaccttataggaaaaaaagaatacaatgcatgttaaattttaactacttaaattgttctctaaattcacaactgaacacctcttaatttgtattccatttctcccatcattgttttgaatgaacatttctatgattcagtctggtccatataatttatcattttttagaggttacataacattttattgacattcttttttttgcttactcatttctcgttgttaaacatttggattgttttcagtttctaactatcatgcaaggagtgtggttattagttctttttcctttatttgaggtggagatcatagaagcaagttaaaattaaataaatatatgtaatattgttgctgctaatatattaacattagataatacaaacctggtagagtctggttgtatttttctgttctgtatgttcactgtaagatattttgtatatctttatatattcaaaatattctgtaattttactcattttgtggaattcttctgaaacaggctgtgaaaacatttgatttggagtcaagaaataagtttcttgttgctgtcaattgggaaaacggattttatctctttagcttcactttgagtctcatcttttgaatgagaagactagattaaagaaactctgaggttcacctttgctctaaaatttcatcattttagtaacttgctacatagttttacaattttaaataattatacaggtttattattgcatttttgcttttatgatgttttcgtggctttatctgtaatttaatactgagtcacattcaggagggcaataatcagtgtttttattattatgaaaaaaggcagacttttatgatacattttccaggaattcattgtagagtgtaatggagactgcttgtgtatgaaaccagacacaactgcagtcttaactatgatgttatcagagaaaattgtttcccttccagacacttcaggttgtttggttgtctttatctgttattggacatgactttatgaattattttgtctatttaccataatgactaactgccaagggtgctcagaaacctctcaatgagcctcaaacttccttgtattctctcttcttcttcctccttgtcataaattctcatcacttgacctcttcttattctctaatcttctggcttctacctgccctggacctcatggtcctcccttctagggatgcctttcataatagctttggcattcctttacttctaaacacactcatctcccagccataaccctaccaccagcaccaacagccacccccgccctacctccagattgctaaaaatcctggctgaaggggttgtagtgtttaatctccacagagccctctttgctgttcatcagtctattttccttttcagtacattcttccatattcatattagccatatcaaatcttcttcgtctacttcaagtataatactccaactttacctaacttattctcaggaacaggattggacctcacaagtaccacctcagctctcctccttatcagccccaaaatgcagttatatactggccattgtcttcattcttcctgcctaagaagttgtttctcctgtcttcagtggattgaagtagattctaatggacagtgctatggtttaaatgttcccttcaaaattcatgttgaaatttaattgccattttgatgacatgaagagagagatttaagtgatcacctcttaaagccctcgtgaatggattaatgctgttatcaccagaatgggttagttatcatgggagctcagctcccttttcctgtctcaagtgctcacttgtccttctgccctccaccacaggatgatacagtatgaaagccctcacagatgtgaacgccatgttttggacttcccagtcaccagaactaagagccaaataaacttctgttgtttataaattccccagtctatggtaatctgttacagcagcaggaaacaggctaatataagtggggaggtaagaccaatgagagtaacagatctggagaactgagtgtagatcatgttctggaaaacagaatcatttgggataagagcctgtgcagagtcagccaaaagctttggcccagaaatctgaggtggagctcacttggcccgtggtgctaaggagaaccagagaggaagacataagggtggactaaacacaggaactgaggaggagtcagagaatccaagaacaaggcaggtgggcctaggtactagagaatctgaagaaacctggtgtattagggtcatctgggctgaatggagtcacagtgatgaatggaagcccagggagtctgtcaatactttgtctggaatgttgaaagaaattcctaattggctacttttttctaactctggctcacctcctgcattttcaacaatagtaatagttaacatttaagggttttctctgtgccaagcagtatcttagaaccatatagacattatctcatttgatcttgacaacattcagctagtgtatttattagtctgctcacgctaccataacaaaatgccatagtctgagtggcttaaacaatagaaatatattttctcaccattttagaggctgcaagtcccagatcaggtgccagcagattctgtttctggtcaggtctctgttcctggtttgcagatggctgccttcttcctgtgtcctccactgggcctttcctctgtgtgtgacatggggagagagagctctggtgtctcttcctttccctataaggacaccaattctatcagctcagggctccacccttaagacctcatttaaccttagttacctaaaggtgctatctccaaatacagtcacactggggtattagggcttcaacatgtaaatcttagggggacacaatccattcataacagctagttaggtattatccttaatttgtagattaaaaaatagagacttaaagtggctcaaaggcacataactagttaccaaatgctgctcgaccttataacctgaatgttcaattggtacttcaaattcagattgtctaagatggaaatcatattcccttctccaagcaaacatcacatctttgagacctttttgtttctcttcattgtacttatgctttcaaagtcaccaggcattaaaatttgaagatactgtgcttcgggctattttccttctttctccttacatcaaacatctaactagatgtcattaacctctcttttcttttctttctttcatttttggcagagtctcactctgtttcccaggctggaatgcagtggcacaattatggctcactgtaaccttgacatccccaacctcaggttatcccctcacctcagcctcctgagtagctgggactacagacaggtgccaccacatctggctaattttttattttattttattttttatagagacagggtttctccatgttgcctagcctggtctcaaactcctcctgggctcaagtgatctttccaccttggcctcccaaagtgctgggattacaggcatgagccaccatactggccagctccttctttttgtaatgttgatcaatcccagaatgaaggagagaaaagggaaacaagatgaaaataaaagtagagagagagacttgggagtcagagtaataaaggtggtcttggcaaatgggatctaattaaactaaagaacttctgcacagcaaaagaaactatcatcagagtgaataggcaacctgcagaatgggagaaaatttttgcaatctacttatctggcaaaggtgtaatatctgaaatctacaaggaatttaaacaaatttacaagaaaaaaacaaacccatcagaaagtgggcgaaggatatgagcagacacttctcaaaagaggacatttatacggccagcaaacacatgaaaaaaagctcaacatcactgatcgttagagaaatgcaaatcaaaaccacagtgacatagcatctcacatcagtcaaaaatggcagttattaaaaagtcaagaaacaatagatgctggcgatgctgtggaggaataggaatgcttttacactgttggtgggtatagaagttagttcaaccattgtggaagacaatgtgacgattccttaaggatctagaatcttggatctttgacccagcaatctcattactgggtatatacccaaaggaatataaatcattctactgtaagacaaatggccacatatacttattgcagcactatttacaatagcaaagacatggaaccaacccaaatgcccatcaatgatagactggacaaataaagaaatgtggtacatatacaccatggaatactgtgcagccataaaaaggaatgagatcatgttctttgcagcgacatagatgagattggaagccatcatcctcagcaaactaacacaggaacagaaaaccaaacaccacatgttctcgtaagtggaagttgaacaataagttgaacacatggacacagggagggaaacaacactcaccagggccactggtagtggaggtagtgagcggagggagagcattaggacaaatagctaatgcattcgggacttaaaacctagatgacgggttgataggtgcagcagaccaccatggcacacgtatacctatgtaacaaacctacacgttctgcacttgtatctcagaacttaaaatttaaaaaaaattaaaaagagagatgttcatggaaaagcactgtttgctcagagattttctccaaaacctctgttttagggtttgccttttatgagaagtagtgtatgatatgtgggtttatttccctaacttcaaggttttgtgatggtatcgtcatcaattttccatcaaatctcttctttcgatgctttcttggactcacctgcttctatgtcatgatgaattttatttgtatttctttattttgcagaagggaatgcatgcatatgaggaggaatgttcaaaaagtttaaagggatacattgaaaagtcagtctcttatgccagctgctctttctgggggattttaagaaggggcaggagttgattgattcactcttctggcccattctctcttcattgaagctgacaggggtgctggtgcatgtctctttccctcatttcaaactctgtatttgttttctaatgccatgtaacaaaagtgccaccaatgtagcagcttaaagtaacacaaatatattatctcatggtttctgtggacagaagtttggcactgcatgggtcaaacttctcagagtctcactgggctgaagtcaaggtattggtcggggctgtgctctcatcttgggctcagggtcctctcccaagctcactggttgttgagaaagatcatttccttgcagtgtttgattgaagttcctatattcctgctagctgctggctgggaccattctcagctcctagcagcccattcccatgtgacccccacagatcgtttacaacatgggtgtctgctttcttcgaagcccaccagagcatgtctctctgactttgccttctgcttgcaacggggaaaaacactctgcttttattaaagggttcacctgattaggtcaggcccatcaggaaaaatctccttatcttaatgtccactaatttgggaccttaagtacatctgtaagatcccttcacagcaacacctacattcgggtttggttgaataactgaggcaagatgtctgcctaccaggggctgggagttcggggaccatcttagaattctgcctaccacacactggtttatggtttatcttgagctctgagggccaggcctggcttggataaagtggaaaacaacatcttggaaggtagaagtcgggattgggagtgagtagaactcgatggagttgattgtttccatgatgtaactggcttgtaagtctgccccatgctttagaggtaccctttacttcgtgtgcttttagccccataacaaacccagtctttttcagtgcgttatttgcatgacttttggacttcatttggaaaatgcttcaataccccaaagtttcttgaaggtgtggagtcatctaaccctttattcccccattacctatcctttgtctttgtttgctgaggaccatcctggtttatgcctgttttcctggtgtatttattaatagtacctcactttcattcaacagtgtctgcatttggaggataagtgatatagacacagtatccatgccatttcgactcctgcacgtcctatctttctcagcccccttcccaccatcttaatgctatctatatactgacaaccaacccatggatctttggctcactccaaccagattcctgactcaccccctcctggcccattttgtgcctaagtagtaagtgtggctattttagtttctctatatgttgggattggggtgtctgcgagctttgtatttgtattgaatgttgaagagagctaaaggcaagaagactttttttgtagagatggggtttcaccatgttgcccaggctggtctcaaactcctgggcttgagagattacaaagtgctgggattacagacatgactcactgcacctggctatttcccctttatttctttactccagaaatgttcaaaacagcggaactctgtctatttttatttaaagttacttaattattctcccttccctaatctcccaaatagagctgattataatacctattcttaccagtttgttataaaaattaagtaactttttatataaagtaatgtgctacataacaatatttcagtcaatgacagactgtgtatatgttggtggtcccataagattataatactgtatttttaccataccttttctgtgtttagatgtgtgtagatacacagatacttaccattgcatttcagttgcctgcagtgttcagtatagtaacatgctgcacctgtttgtagcctaggaaccatagcctgtaccatatagcctaggcgtgtggtaggtttatgtatgtacactctgtgatgttcgcacaacagcaaaatcacctaatgacacctgtctcagaaacgtagccccatttaagtgatgcatgactgtatttcaaatagataaataattcctggcccatagtagtcaatttaaaaatgtttgtaaatatttgttgttgaagagtatcactttagagttatgatgtacttttgacatttggctagataggagagaaaggtgcagtccaagtgaggtgaggggatccccaacatctactgtagagaccaacaaagcacgttcgtttgccagttggtaaactggtttggttttagaagaaagtacagttgggaagttgtgaaagaacagcctggataattaggatgaattcagatttttgagggacttagaagttatgcctgtttgtttgtacttggggtagcaaataaataagctgttgcaatattttcccaataggataaggtgatgagaacaatgtaatagtgaccattgatgagatcagcactggcaatggaaataaagaggaagggcaagcataggagacttgctgagatatttcttttttaactagtgcttgactagtgataaaggatggaacagatgagttaatgttgactgaaagtttttttaacctgagtggccagaaaaccgttgatatcatagaagaaaagatacacaaaaccttagaagggagagagtagggttgggtggacatggaggataggctttaaggggacctggagaggaggatgggaaggttaagagaatctaaggagggaaacatatggaatagtttccaaatcagtataaaacccaagctacgggaaaagtgttgcaagagaaggccttggcatactgtcatgttcttggaatgccttccctgcccgcctagctggctacaatcactgctgtatctgtcccagtactcgcttcactatagacgatgtgctttgtgaaagtagtagccatagccctggaagctggcatggcacagggacacagtatatatttctcaaatgaacagttaagaaaaggatggttaacagtggccaatacagtaaataggttaagttgaattaggatagaaaataacattagtggatttgccagtgatgaaatcataatttcatcagcatgctggggcaggagccaggttacagagggtttaccaggaagctaatagtgaggaagcagcagcagcagcagcagcagcagctgtgttctgctcttccaaaagtctgcaaaggaaaatatctggaaccagctagggaaagaggatggtggagttaagcaagataagttgggttgatttgttccttaataaaggtgagcctgaattacaagggaagagtgtgacaatgctatagaaagaagcagggacaaaaacaaagcccgtcaggagttctagaagaatgggatctagctataaagaaaacagcaagattccagttcctcagaatctggaaggaagatacagaagatgaagacaaaactctgctgttgccagatggtctccatcttctcagttaaggagcagtgttatcgtctgtatccacttgttggatctgtaacttttatgagttccatctttacctttgtgccatctttgtcttatcactggagaatccagcaacctttaacgatttttaataaaaaaatttatgaaataaaaattaatgtttggaattacacctgttttgtttcacataagtggccaattaaagcagctcatagatcagctggactgataggtttttattttaccagaaatgagtacagttttctaaagcacacatgtagcttgataataagagtgatctgtacctaataaagctagccaaagcactaaggaaaacattttttctgttaaatcaggccaacacaaactgcctacaagtttaacacatcaaagacttgttcgtgtgaatatagggttagtttagtaccgctgtttgttcatccaagcaaaaaatggataatctagtctcagcaaattatttttgttgctgttacattttttaaaaatcttgctttgacttgataaatacaaagaaatcaaatatgaacaattcacatttgacattttccctttctaaataaaaggcacaaggtgtaaaaattcattttaggaatcttacttgtgaattgtaaactcaattacttttgaaatcttttaatctataaagtttacactgtggtagattgtctacatatctcatgtgaagagataatttttttcctggggtccatttaatgaaatagagcaaaacggagacaccatattaagaactcttgctatggaaatatttattaatttttgtgcatgttgatatttgtgcttgaggttcaatatagattttattttagcatattcttctctatcaacagcaatcttagccaatcacaggaatgtataatcaaatattgctttaagagtaaattcctcagtaaataagattctgaaaccaatgactggagactgggcctgtttaaaaccccctcaaattctctttataggattattcagaataaagcacaggaaatctctgagacaagacacatctagtctcctaccctgctggggatctcctacacactttttactgtttaaaatattatttagtacccatagattttgtttcaagtgtagctcactcatatttgagacaaaaattttccttgtacatgtattttaaactattcaggatcattagaaaacatctaagggtcagcaagcttgtgtgtgtatatgtgtgtttatcaagaaagaaacagatttctacagattttttattgaagaactgtaaaatgtattaatacagtacaattttaaaaatatagatctgttactaagaagaatgaaatgattttatttgggataacagttcacttattgaagttcaaagtttagtgtgccctgtcatcaaaatcagttgtctatattgatttgtcagtgctgatgggtaatgagattttgcatatttcatccttgaaaatgtattttcacacagattcttgctgccaaacactgataccaattcatgatatcagcataacatggttttaactgagcatttagcacttggaaggcatttgcagaattctattagattctacttcctctatttgtcttttatcagatcaatcacttgcaattgacggttagatggaagcgccactcaattgcacagttaaatggatttttaaatattaacatttcctttgcgcttgcatcaagatctgaaaaatgctgttggatatgtggtttgatctcagaaaatatatctgctccaaatttgttttggagtggagagcatgcttaatgctttaactttgacagcatggtaactgcataaagcagcttgacattacttgggatttaaacattagttgttgttaaaaatgattttattgcagtattcattttacataaaagcaaatttttttcatgtaacttcaggttgaacacattaagaaacattaagtccataacagaagctagtttaaaagtgtttgatagtagtggttgaaggcaggtcttcctactgaggaaaaatttcagtctcagccatgagcccaataaatcacagtaaaaccttaccactactaaaccatcaaagtatggtgtggcagagcaagtcaaggtgttaagcttctgtttctgacaaaaatttgtagaagcgatggaagttaagtctttgagaatgaaaccaactgttgatactactggctcaaggacgtatgagattcagatattttccaaagtgtctaccgatgaataacaccatcagcttacattttcacaagcttttgtaaattaatttacttaagtctttttgtgtttcacacgtttttagccaccatcagttgtaacatatagcagattccacttcaggttgtgatgaattagcattttctcaacctctttgaaaatattcttgcctatagttaatctgtgcaaactattcatgaaggctaattttcattcactttaattttggtattcacctcactaataaacaacaacttagcagcgttggtgacatctgtcaattcatcaaagccaaggaaaaatacaaaatcatttgctttgttttctggctgactgttggtgttggtcctgatgtcttcaactaagtaagtatagaacattgagaagggaaaggtagcgagaggagattagacaagaggattcggattatcatgggccttatttgctcatcattgataaagtttggagatgtatcttctagaacattgatttttttggactttttttgtttgtttgcttgttctcattcatgatgttttaatggggggaaaaatctaaaacggaaacccaatatgtgacagttaatctaacactgttttgatggaaaagtcaggaagtagaaggcctagaaccccacaagctccttccctttcccacagaagtttgaaaacaattgtttttagcacagagtgaaaaatagcagttttacagcaggggaatatgtgataagatgtgcttggagcagaatgcctttgcattacaggagaaaggggcaggatgcttgtttgatcaccagttatgtattaaacactgaactattttaaagcaccattttatttaatcttcatgggaacataatatgtattatcaccattttataaaatgaagaaagtacaattcaaatacatagttatgggttggtttatttcttaagttctatcagttacaggatctcaagtctctggaacagtgctgcccaatagagctttctgcagtgatggaaatattctatatctgtgctgtggaacatggtggtgcctagccatatgtggtgtcaaatacctgaaatgtggctagtgcaattgaggaactgaatctttaattttatttgctttcagttcattttaatttaactagccatgtgtagctaccccctactgtattggatagttcagctctagattacagtcattcaaactgattcattctccagtgattctgccttactttgccactaaagattatgcgatttacatttacttaattttgttaaatgtgtcacataaatatttaatttcacctattacagataaaagttgacaatcagatctcaataaatattatttatggaatttgggttttctttcttagaaagggagctaggtaactctttcattgactcattgatgtgtattaagtgcctactttgtgtcaggcacctgagctctggaccctgggaatattgtaacatgaaagacaagcatgattactgtccacaaggaatttaattggcctagtggagaagatttagaaataacaagcagttataatggaacattaaaaaatacaagggagtttggcagcttggaaagaccactgaagatactctaacttgaaggaagctttcccagaggaaaagttctttaagtagaggcctgaacagaggagagtttagctctgtcaaatagatttagaggagcagtaagaaaaatattctgtgtgtggaggccagtaggctagaaggcatggggatttaggaagggaattgaagctcaatggtgctgaactgcaatgtgtgggatatggagcccctgtgatagattctgtaggggtcagacttctgagcacacagcagggctgggggcagaagggaacagaataatcagcacacactataaacctagaagatatttagcattttaacagaaagcaaaaattttttacaaaggtattcagagatctcttttttgtaccaatctgaaattacttttaaaatggtcattccttttttcttaaactgctctaacttatcatagcaagcttgtccagcccacagcccaggacagctttgaatgcagcccaaaacaaatttgtaaactttcttaaaatattatgagtttttttgtgattttttttggggctcatcagctatcattagttaatgtattttatgtatggcccaagacaattcttcttccagtgtggcccagagaagccaaaatattggacaccccttctgtaaaggttaatttgaaagatgaccagtgtataaggcttttttcagttgtccatttatttaatttttacttttctcatctatgaatggagaaaatatcatccagtatatctaacgctgatttcagtaatagcattacctacctaggtgtgaatattcaagagccagtattatatatttattctcacattcagcttcttcattgagagctgagtcttcaaaagctgcctgcacatttattgtgtaagtcaggggtccccaacccccaggacacggactgataccagtccatggcctgttaggatccgggccactcagcaggaggggagcaagcattactgcccaagctccgccttctctcagatcagctgtgttattacattcttacaggagcacgaaccctattgtgaactgcgcatgtgagggatctaggttgcacgttccttatgagaatctaacacctgatgatctgaggcggaacaatttcatcctgaaaccatctccccaaacccccaagtccatggaaaaaatgtcttccaggagaccgattcctggtgctaaaaagtttggggactgctggtataagtagtataaacttaacacatgatgacattgatattaatattaggaatttcactcagcaattagttttcttgtttctgtactgttaacctaatggagaatgggcgagccatcattaccattacctttaacagctcaacagtaagctttattgatagtgagaaccaggataaaaattatcaccttgtggaatatggagaacatttacaggtcagtacctttgcacctgtatttttgttatgtttatttcctcactaaacattgaagaacttcagagttctaaaaggctttgattaattttaacttttggaagcatttctataaaatatggaatcagaacagtatcatgcctgtaagaatcactcaaatttttttttagagaaatgcaaagtatgattgaaacatgggggactgagccatatgaactaatgtcagtcactagacatgccatataattttttctattttgttgtctactattccattttttctgtccatgcatgacagttttaatgttgtatgtggaagagttgtgaaaaattagtgtagtttcagtggctgattttgtgcagtaaacattaagtcagttcccatgaacagccccctggtgcaacccttaataaatgcaaactttatttttagtactgacctttcgtaatgtgagccttgatccattgagatgctgttcacttttgatgcgtctccaaatccctttttttatgcattttaaatcaacacacgcttgctctgaatttatgcatgtggatagacggagatgtaatttaaacacatctgttcaaatatgcatttcagatcaacttggtgccgattctcataatacgatggagtttttgacgagtattatatccctaaagtacacaacagatggtatttattagagactgaatagaaatgaagtttaaggatgttgagctttttgtcttaagtcactcattttttagtcataaaaaataatgggctgaagtcttgtacccctatgataaagctttgtgtgagactattttctttgagatgaatgtctctcagtcaagttgagattaactatatatttttgttgaggagacaccatcaccaggaaaatgtagatcagaaaggggtaaataataggttattaccaattagatactagctacaattaatacttaagttgtgtaaattatggatttaaatagattgaatagcttcactaaaaattcgtatttaatttaggcacatatcaatgagtaatttcaaatttattaaaatattattatacttcagggtcattatttcagtgcctaaaacaatattttaaaagtaatcttcaaagcgaactttttctccccaaatacttatactaagaataaatgacataatatacctatgatatactggcctaaaattagtgtacagaaattaattgcattgaataatgcatagacatgcattgttctttccctaattcctcacttccctctctttttcaagcattgtgcccacatctgcctttttgcccacacctgaagatgagaaactgataagactgcagttgcccatagatagatgataagccctccgggagggaccagtaattgttgcagggttttcagagctgtaagaactagttcttaacacttatttttctctccagagcttataacattgggaaccagttccaaagagctggatcaaggataagaaacaaaatctatatatgcatacctttttcttgcatttggtaggaagctgtgttctcacgtctgcaatcagatgcaagtaaaccagactgagattacttgcaagctattattgacttctatatacaacaccacaaataaatctttttctcatagattagagagagtgcaaaaggaaacaggtgatttgtgaggtaacctgccgttatgttaggcagtaatagaaaacattttaaaatatttgaaataatataattgctttgcactgggaacacgtacatgaataaaagatgttagcaggtgtcctaactagtatggaatctcatgctgttgtatttattggaaatatgcacaccatcagcagatgtaaatttgtaaaaagtaatcgaaacagaagaaggattgaataaaaaaactcaggcttaaatcatgtaattcctttcaaccaaattttcaatgtaataaaatacagtttttgtatcaaattacctttctatcttagattttttttttcaatgttactctgaaaatcttttttttttttttggtattctggattattttctttaaaatgctttcttacacaacatataatacttgcctatcgtatttggtactggataatttgataaaggtttttgtatagcatttaaaatttttgatgaatagggacttaatgcttagtatatctttggactgtaatttatgtggttagtagcatacagtctggtaaaatcacgtaacatcaaataaaagtccaaagaaacatttccttcatgtttcatgtgtatcagtaaaattgcttttgataaaataagttacatggataacacaggtttagctatttacagagattctgttttcaaatctttgatgtgggacttaattttgagggacatattctaagggtagaggatatttggtatgcattttgaatctggtaaataaaaaatagtcatctagaatgcaatttgtttcctggtgaaaatgattttcttcatttctttttgtgctatttttatccctttaaatgttttaactaccagggaaaatttctagttgaggcactcaagtcttaatccattttgagtctgctgcagctccttcccaatgtctcttacaaattaaatacataaatcccatgtattggtcttctatctaatattttaactgtacacccccatttcccacccaccctactccaccaccataccaccattcacccctgtctctgcttctctactaacaaacactgttttagaacctcactgcacatgaagcaccagggaggtaaaagctggatgtaacgtggtccctgccctacctgcacttatagttcatcccttacacaactaacacctctctcgtggcactgggtactctggtagatgtcttggttaacagcctctccttccagtcacgtccaagcttaaaatcctagaatcatattcactccctttttactgtctccacttccttctaccaccacctgcctccactcaagtcagtcacctaatcagccaccatttccaatgattacacctcttcttacactccttcccctacctgccccactgtcactatcctatttgacgccagtactatcttgtattctgtcatgtctgtttcatcgatctcattcttaaggtatttccagaatcatcttactgatgtaccgcttcaaacgttttcctccccacaaaagcctttgatagctccttttccccaaacttctatatgctggtcctaacctccttgttagctatattacgatactcccattcataggccctgcatcctatggtgtttgtgatttgtttctttctacctgaacgcctctgctctggcttttctttctgctgagagtgtataaaaaacagacatagagatagtaatagtacctactttatgggagtgcttaggaggaccacgtgagttcatatatggaaagcacttgaacctcacacaaaatgcatcataaatgtttctcataactcttaatgttattatcactaccacaactaccagttctactgctactgctggtgtacacctaacttagcagtaagtgaggtttttgagggaaggtatagcatcttattgtctttagcacatagcacagttatagagcatagaatgtctgccttccatgatattggttaaattatctgtcagtttaattgatggtgttgattaattgaattttcctcaggaccgaagcccaaagtaagtcttctgcccacatcacatatatgtgtgtgtatgtgtgtgtgtgtttgtgtgtgtgtgtgtgtgtataaatgattcagtatgagggggatctacatgaacatttaaggttctttcagactccaaaaatctatgtgatgctgtttcttcatttccattttactctacttagagatattttgtatgcaacacttgtaaggatactcccaagactactcttctctccttttgcaaaaagcatgctaggcttacttaagaaaaaactcatatcttcatgctttcatcatttgtctctgcacttttatggctctgaaagttattcatcatccctattttagtggcattacatgcctttgcattttgctatctcagagtcatttccttgttactttctgtcgtattcggtttatttatgttaacatcttttaaaagtatcgtcatggaattaaaagcaattcttattcaaggctacctggagaatgtgactttgtctttaggagaaaatcactttgtacaggaagcgtattgtcacagtgtatacagcactgtgtcttggacctttagctgtgatgagatatagtcattagttgtgttttgccaccccagttttcttcatttgcttttctgatcagaaattgattttgttaaatctgtttgctaaaggaaatgtttgctgtaattggagctacatacatagattgaagtggaatataaattctattgatgtcacactttgtttcagttaatttaagcacattctacattaggagggcaatctgtgatcctgttataccatgttgtacccaaaaacctctgtagttgttcctttcatcttttctttttcctccctgtgttattctttgattttatcttctctaaggcccataattctctttactcctcgacatctcctcatcccacccttctctcttgtattgagcctggcacagttggtcacattactgtttacctccactggtggctagaaatcctgtttagccctctattacactctgattctgctttcttgcctcttacttgtaagtattcagttatcattgatgggattgaatcaaattgtctttaactcaagccttcattctaatagactttaccactctgatacctggctggctgatagcatcacacacatttatacacttgcttcttacattggtggtcacagacaaaactttctcctttaccaggttctctaagttcatagcccaaaaccctttcacagatgccaaaattgttattaataatgacattattgttaatttttataaatgctaactttatgttgacatagtataatcattagtatttatagttaataaattattcatgattcttctaaatattcagttgagctggtttgaaaggcagtagttttcaagtcctggtttctctgtgcaaacacttcacttttctaaacctctgtaagctagacatatcccccttccttctcagaaggttgttttgatgtctccgtgtcttaatccgtttgtgctgctgtaaccaaatacctgagactgggcaatttataaactatagaaatttatttctcacagttctagaggctgggaagtctatgatcaaggcaccagcaggttcagtgtcaggagaaggctcattcctcacagatggcactgcccggcttcttcaaatggcagaagggagggagggacaagatagagtgctcccttcagccttgcccttttataaggctctgccttcatgatgtcatcacttcccaaagaccacacctctattaatactatagcattgcggattcagtttcaacatagattttgaatgggacaccatcattcaaaccatagcacttggcgaaatagcacagaaaaaggactatagcatgtgaccttctttgggtttttatggtcattagctagatcggaatgatatagcaggcaggaatactttggtttgccaggaatactcctggcagtgactgttcaggacttggtatcaagcaccgctatagttatctaaataatcctcagattcttttgccaaaaatgatgtaatcagtgctactttctagaccttgcatagtttgggacatgagcatgaggtaaagtgttaaaaattaacaagatgtgtttgttttctccctgactctgagtcaggggctagttgtacctattaacatttctactcccgtgggcacctgtctccctttcccttatttagaggcaccactgaaaatgtgcgtgatgaaatctgaacttgcatgaatatctccttgttggctgctagcacagatgtgttatctggtgaggatttttcctagatttctttcccctggctaaaacagtaaatgcataagtaaagcactaggagtcagagatcctaatcccaggccttttctactgtaaactagctctgtgtccatggacaagtgaccttatcctcagtgcccttgttttttaatatgagagtagcaatctaatgatggaggggtgctgagaaaataacttcatgtgggtatttttatttagcagttgtgtgggtcatccgatggcgtctcaagtcactattcaatgacacctgatagtcattgtttctgagaaagggggccttttggaacaaatgcatctggcactatttaacattcactgccctccatcagtgggaggcagcttattatttcagatcacagacaggaaggattcagatcctgactctgctgcttattgttgtgtgacattgggcagcttacatgacctttctctgtgtccactgccatgtctgtaaactgaggaaaatattgcatatctcactgattactctgaggattaaatgagttgatatatgaaaagagtgccttccacattcttggttcagagaggctggtgttagaagatgccacactattaacctgatagttagctaattcacatgtgactaatgttatttccttccctccgtgactttggggatggttgcagtgtcttgatattctgtaatatagcggctttgttcttaagttttaaagtgtttcttggcatagggtcagctaccaccagcattcaagccatacccagcattccagcactgctgcctgggtatgtaagaagaagggggcagtgggtagtgggctcccttggagccgctgttgtggcaagaaaggactttggtcactcacagtcaggaagagtctaggagtgctttgcaggtcagtgaagcctgtcccaggcagtgctcatggctgtggggagctgtgaagcagccgcagctgacaggccagccaggcgtggcgtgagacacaacggagctgctccttttgaggcagagattttggccaaatgtgtatccaagaggcagtgtcataaaaagtgacagggccttcacataaaagctacaacgtctaacaaacagacacatttcatgtgagtttcacagggaaagggctcttggccacctgccacctccctgccacagcagcccccatagatgctgacagttgagaaccttgtcgagaacatatcatccagttaacaaatgagtttagaatgacgagacttacacccttcaaaaatagacgcaagcaactgtaacctagaattagaatgaaatctccacttcatctcctcctcgtaaaccttgcttcaaccttaaagactccatcttgtacccctttccccaaaattttaactgaaagttgcaaataaattcaagttgttcaaaataagcattgaccaaatgttctgattaattctaaaaatagaattgagcttgaaacaattcttagttaactgattttttgtgttttttttttttaagagatggagtctcaccatgttgcccaggttggccttgaactcctagatccttccgtctcagcctcatgagtagctaggactacaggtgtgtgttactgagccagggaaagagaaagtggaaattcaaagggctttgtagatgacagcttctctttggagaaaggctaggcagatgctgctgagaagccaggcgctggagccaacttgtactgctcacaatgatagtatccccttttcctaaagagaagccatcatttacaaagccttgtgaatctccacttattcctttcccaccagagctaacctctaggacgtaaaggaaaatattgaaattggtattagtcaaaacagggattaatcattgatctctgggtgaataaagcctattgctttattaaattcatgtattcgtcttactgtctgtttttccaagttctcccaagcatttcacctttaagtcagtgggcacttttactgagcctcaactgtctatgtggctgttgcctcattactacagagtgtaggaatgtgaatatgaccccatccttgtccaccaggtgcttatagtttattaggaggcataaggcaagaaaacagatgtaaaaaatgtcaggaagatcataacagggacatcatagaggtacaaaggagggactgtgaatgaattaagatgctgagagaaaatcaagaaaaatttcatcagagaggtggcccagggaatatcagtagtatggataggggattgtacagtaggattgctcagagaggaagtattctgatttcaatgagtagtttggataggggattgtacaatgggattgttcagagagaaagtattctgatttgaatcatatcaatcggaattgggtgataatggaaaggttgattagggctacattttggagagcattgtatgtacccactggccctcaactcaccctggagtgttcctgggagttcttatcaaaaattagagtcgtggacctggttggttagaatctcagcagatgataaataactttggctttgcagaccatgcagtttctgttgcaactgtcacaactacattcaactctgcttttgtagtgaaagcagccataaacagtatgaaatgaatgagtgtagctgtgttccaataaaactttatttacaaaatcagacaacagctggatttggcacatgggttgtagtttgccaacctctgacctgatcggggtaaactgaatgcagggaaaactgaatttaaaacaataaaacacaataagaaaatgttctcaactcataagaaataaagtaattataaatctgggttttgatttaaatgattttataatttctagtccataaatatagcttccggtttctttctcacttgcttgctctgtgtatgtgtgtgtatatatatatttttttccaatttgtatatatccctattcagtattatttatgatgatgctataccaattgcactttaggatgacataaaacttgaaatgtaatgtttctgagtgctattttttggtaacacttccattaaaagtaataatttgcctaatttcttaataatggactggatattagaggcaactgcattttgactgtataattttataaattattcttcccgagacctgatgtttagttaccttccagttatgttttcccattaaagaatgccatgatctgggtttcagtctctaagtggttttttttcaaggtttaattttaaaagatttaagaaacttgcctaactttgtagattttgccctgtcctgatattcatttaattggttctgctaatgtgaaagccctttcaaatatgaaaaaaataaagcaagagagaaaagttgattatttctgtaattggatttttttcttgaataaaatgatttcacccactttatctttctgacttaggggtgggggtggaggatgagctttcttttatattgtagtcagaagcagacagaaaaaggtatagtctgttccaaggtatcagaatggcagatgggtttgggttgtaattaattactgatgctgaatatactctggcccctactttcattctcaaacttaaatttccactgtgtgcaaaataattccatccaggaagaattctaattactttagtaattatcatcttatctctaaatggaattcagacatttgctgtagtttatgaatgttagaaatgtttcatttccttttcaccttgaataacagaaaaatacacattactgaattcagcttcattgaaccttataattcatgttaccatagaaacagaaaaactcatataagaattgtgttagcagtaccatagatagtaaataccttcactttaaccagcaatatcataaaatgattttaataacagatgtgtaaaaattctgtgaaatttaatatggtttcttttaaatactataacaatattatccagtatgcttacttttaatttttaaggcaatatctttggtcttatgtaaggctttgtgcttattccaaaatatttgctatggaatgcaagcatagtgttacaggataaaaaacttatttaacatggtatttatttgatttttagttagcagtgatgattcatttgatgtgtgcttgaagccaaatgatatattctggatttataccaggcttagaaatgtaatggatgacactaaattctttggtgtcatctcatccagttgtctctcatcctttttttttttttttagcctatttgacagccacttttccaagtgtcagaaacaatttttccatacacttgatcagtttttaccacaagtatttaatagttggagtttgttgcattttaaattctcagaatattcagaaatttgcagagcttgagcaaaccatttgccatttattcatatatttcttcctttacttatgtcatacatttgcctagtttactttaaaaaggtaaaattgtaccaaatttaaactgaataacccatctaggtttttatttttgcttattaaaagttttattactttcaaagagaaggaatcattaaaaaactaactgctactaaatttttttagggagataccttgaaaggccatctttgattataaatattatgtataattaatatgttagttgtattttagcatatagattttgcctaatattgattgtaggaattttttttcttggttgccttgcaaaccggggacctctggctggcaacgccctgcctgggccccactcagccacactagtgtgccccagcctgcctgtgttatagcttgtacctgtgtttggcagttcccgagctcttgtactgcgcccaagaaggaggatacactggacattgaagagtgaggaaggcggagagaagtttattgagcagtgaaacagctttcagtcaagagaggacatggggatggtcccctacccaaaggcagaaagttcctttcttgtggctgggtctcgggccttttatggactcagaatggggagtgcttgctgattggtttgtgactatgcaaaaaaggttaaagcaaagacaccactcaaaggtgggcatgacagtgtagaaaaccaattaggaaagggtaggtatatgtagaatagatgaagggtggggatcaatcagaggaaaacgtgccaaacaggaagacacattctcagtccagtccaaggatttaacttgtagcttggctttcaggctttaaactgtcttccagcttggaggtggggtttcactggggacctgcccctatctgcctgtcactatcaatatttgaaaacaatttcttcaaacaagagggtttaaacttctctgtaaaggccagaaatgttataagtctactgtgaaaaagatcacatttattcatttataggaatacatgtatttttattatattcagtttcctgacaaataggatcaaggtttttctgtgcctttttcttagtaatttctagtttattgctttattctcacagaaggtgacctgtgtaaatgtggtctcattaaagtagcagaatgtgaacactgtctggatcacttgagctcaggaattcaggacaagcttgagcaatgtcgtgagatctcattgcaacaaaaaataaacaaaattagccagatgtggtggtgcacacctgtaatctcggctactttgtagtcccagctacttgggaggctgaggcaggaggatcatttgcacccaagagatagaggctgcactaagccaagatcacactactgcactccaacctaggtgacagagtgagaccatgtctcaaaaaaatagtaataataagttgtgttttccgtgaacttatgatcagccagtgcttatggtacatcagtgctgtgagcacatcagtgacataggtaagagataaggactaccctgggtagtgatcagaagcttcagatcagatgcttcctttactatttattgattctgtgatcatgggcaatttactgtacctctttccctaatggcattttccccctttctcatgaaaactggattagaatctatcttatgagaaagttatattaaacaagatgaagttgttaacatattgcctggcacttttattagtattattatgtaatattagtattacataataaatgacagttgttatcatctctctgacaaggttacaataataaagccaatacatattaagcactatatgggaagcaccatcctgagcaattagtacatctattacctcattaatcttatctatgaatacttttactatatccattttatgaaagaagaagtggaagcatctaaggctgaatagtttgcccaagatcatgcagctagttagtggtagaacatcttagttatgcaaggaagttgtttctcccagacagtcatattaaaagaataagaatgaatgcccaggtcacactagactttctttgtcttagtcactcattatggcttttcagccctcatctaaatgttttagtgttttttctgtttttagagcagttaatttaagaaatttttaataaaactatgagaataaatttagagatgctgaaaaaaatctgaaatttatttgaagatgttgaattgtttcttactaaattttctctttcaatataaatagaatgattccctattgttatatgatgttttacttgggaaatagatccatgctttccttcttcaagtccttcatgatttcatgctctgaacgtaattcctttattcctggccttttattttgctgtttgtcccgatttgtctattttttcttattagaggtggagtctagccctgtcacccaggctgaagtgcagtgacacgatcacagctcactgcagcctcaaacttctgggctcaagtggttctcccacctcagtttcctgaatagctgagactatagacacacaccaccacacctggctaatttaaatttttttaattggttgttttttttttttttttgtaaagacagggtcttgctttgttgctcaggctggccatgaactcctggcttcaagtgatcctctttccttggcctccgaaagtgctgggactacaggcatgagctaccacacctggtcctttgtccacatttaattctttgactacacctgtcaaagttgaactgttaagacttcttggccgggtgcagttggctcacacctgtaatctcaggacttttggaggctgaggcaggagtatcacttgaggcttcaagtttgagaccagcctgggcaacaaagcaagactccgtctctacagaaaataaataagagaatataattgagtctcacatagtaagtgctcaataagacttcttagaagagtatgttatggaagattcatgctatctgtcttcagaaaggtatttttttttcattgttaagtctgtaggataatttagagaacacagaatattcattcaatgtaagtgttttgaagatttttagcaaattaatgcagttgtgcaactatcatcacaattcagttttagaatgctttcattctgtcaaaaatttttctaatgtccaattggagccaatccctgcttctactcacagttccagacaagactgatttgctttctgtctattctaagtcgtcttctagatatttcttataaatggaatcacaataagcaatccttcgtgtctttcatttccttaagaatgtttttcagattggttcatgttggtgcatatatcagtagttggctcttttttatttgtaagtaatttccacatatggatatgccacattttgttattcattcaacaattgatagacatttggactgttaccagtttggggcagttatgaagattgctactgtgaaaatccaagtacaggtcttcgtgtgagcttacattttcgtttcccttgggtagacacctagagtagaattgctgggtcacagtaagtgtatgtttaactatttaagaaactgtcagactgttttccaaaatgactgcaccatttaaaattcccaccttcaatgtataagtgcgtcagtttctctatatgcttactaatatctgttattttttttttcagtctttttggtacagccattctactggatgtgtggcattttacatggttttaactttcatttttctgactagtgacaatgttaagcaaattttaatgtacttattagctattcctatatcttcttcagtgaagtgtttgttaaatcttttgcccattgcatcattgtgttgtcttcctgttagtgagtcatagttctcaatatagtttggatacaagtctttttattggatatatgatttgcaaatattttattctactctatgacttctcttttcattttttaacggtatcttttgagtaagtttaatttcttagtttatcaaattttacttttacggattgtgctttcggtgttggcactatcgctaagaaatctttgcctaacctaaggtcacaaagatttcctcccatattttcttctagatgtttaataattctgtatctgacattcagactgtgatgcacattgaaatatttttgtgtataatgtaaggtggagggtttaataatgtgtggggttttttgcatatggtgtctgattgttacagtaccatttattgaaaacgctttgtttcctgccctcattgaattgccttggtaattttgttgaaaactaattacccatatatgatgaattggtatatatttggactctctatttttccattgatgtatccctacactgataaccatactgcgttgattattggagctttatagttagtctttaaaacaggttcatttattccaccagcttttttttcttcaaaattgttctgattatttcaagtcatttgtatttccgcatacattttaagcacagcttgtcattttcagcagaaatacttgctgttattttgataggagttgcattgactctataaatcaatttggagaggcttgccatcttaacaatgctaaattttctaatccatgaaaattatatattcttccatttatttagatcttctttaatttctctcatcaagttttaagatggtttctttaaattctctcagtttatggcatacaacttctacctttctttctcaaacgtattcccaagtagtttttatgctattgtgaatggaattggattcttgatttcattttcaggttgttcattactagtataaaaaatgtaattgatttttatatattgatcttgtatcctacagttttgctaaactcacttattctagtaggctcagtagattctttagattttctacatacaaggtcatgtcacctgcccaaaaaaaaaaaaaattctgtcttttaaacatatatgcctttaatttccattccttgcttttttggactgactagaacctccagtaatatgttgaattgaagaagtgagaacagaaatctttgctttattatcaatcctaatggaaaagcatttttaaaaatcatgaatgggtgtttgatttgtcaaaagttttctgaatctgttaagatcactatgtggtttttattttgtcctttattctttttatatggtacattacattaattgatactcacatgtcaaatcaacctcacatttcttggatttaaaaagtggtcatgatatataatcattttttttaattttgccaggttcagtttgccaatattttgttaagaatttttgtctccttgtttatgagagatattggtctatagtttaattctaatctcttcctctgattttctttaaaaaaaactttttttgtttgttttttctttttttacttttttttaagttctgaggtacatgtgcaggatgtgcaggtttattatgtaggtaaacgtgtgctgtggtgatttactgcacctatcaacccatcacctaggtattaagctcagcatgcattagctattttccctggtactcttccccacctcaacaggctccagtgtgtgttcccctccctgtgtctgtgtgttcacattgttcagctcgcacttataagtgagaacatgtggtgtttagttttctgttcctgcattagtttgctgagaataatggcttctgacaatatccatgtccctgcaaaggacttgatctctttcctttttatggctgtatagtattccatggtgtatatgtaccacattttctttatccagtctatcattgatgggcatttgggttgattccatgtctttgctatggtgaatagtgctgcaatgaacatacgtttgcatgtatctttataataggatcatttatattcttttgggtatataccaagaaatgggattgctgggtcaaatggtatttctggtcctaggtctttgaggaattgccacactgtcttccacaatgcttgaactaatttacatccccaccaacagtgtaaaagcattcgtatttctccacagcctcaccaacatctgttgtttcttgactttttactaattgccattctgactggtgtgagatggtatgtcattgtggttttgatttgcatttctctaatgatccgtgatgttgagctttttttcatgtttgttggccgaatggaatgtttttccatttgtttgtgtcctctcttatttctttgaacggtggtttgtagttctccttgaagaggtccttcactttccttgatagctgtgttcctagatattttgttctctttgaggcaattgtgaatgggtgttcattcatgatttggctctctgcttgtctattgttggtatataggaatgcttgtgatttttgcaccttgattttgtatcctgagactttgctgaaattgtttattgagttaagaggtttttgtgctgagacgatggggttttctagatatgtgatcatatcatctgcaaacagagacagtttgacttcctctcttcctatttaaatacactttattttcttctcttgcctgattttcctggccagaacttccaatactatgttgaacaggagtagcgagagagggcatctttgtcttgtgcccgttttcaaggggaatgcttccagcttttcccattcagtatgatattggctgtgggtttgtcataaatggctcttattattttcaggtctgttccatcaatacctagttaattgagagcttttaacatgaagggatgttgaattttatcaaaggccttttctgcatctattgagaaaatcgtgtggtttttgtctttatttctgtttatgtgatgaatcacatttattgatttgaatatgttgaaccagccttgcgtccagggataaaactgacttgatcatggtgggtaagttttttgatgtgctgctggattttgtttgccagtattttattgaggatttttgcattgatgttcatcagggatagtggcctgaaattttctttttttattgcatcgttgccagattttggtatcaggatgatgctggcctcataaaatgagttagggaggagtccctcctttccagttgtttggaatagtttcagaagaaatgtaccagttcctctttgtacctctggtataattcagctgtaaatccatctggtcctgggctttttttggtgggtaggctgtttactactgcctcaatttcagaactcattattggtctattcagggattcaagttcttccttgttcactcttgggagggtgtatgtgtccaggaatttatccatttcttctagattttctagttcatttgcatagaggtgtttatagtattctctgatggttggttgtatttttttgcagtcagtggtgatatctgctttatcattttttattgtgtctatttgattctcctctcttttctttattagtccagctagtagtctatctattttattttttcaaaaaaaaaaacagctcctggacttgttgattttttttaagggttttttgtgtctctttctccttcagttccactctgagcttggttatttcttgtcttctgctagctttggggtttgtttgctcttggttctctagtttttttagttgtgatgttaagatgttgatttgagatctttctagctttttgatctgggcatttagtgctataaattttcctcttaacactgttagctcatagattctggcatgctgtctctttattctcattagtttcaaagaactttttaatttctaccttaatttcattatttgcccaggagtcattcaggagcaggttgttcagtttccatgtagttgtgtggctttaagtgagtttcttaatcctgggttctaatttgattgtgctgtggtctaagagactgtttgttatgatttctgttcttttgcatttgctaaggaatgttttacttccaattatgtgataaattttagagtaagtgccatgtggcaccaagaagaatgtatattctcgtgtttttgtttggagagttctgtagatatccatcaggtccagctgatccagagctgagtttaaatcctgaatatctttcttaattttctgtctcaatgatctgtctaatattgaaagtggggttttaaagtgtcccgctattattgggtgggagtctaagtctctttgtaggtctctaagaacttgttttatgaatctgagtactcccctattgggtgcatatatatttaggacagtcagcttttcttgttgaattgatccctttaccattatgtaatacccttctttgtctttttttatctttgttggtttaaaatctgttttgtcataaactaggattgcagtccttgctttttgctgctttccatttgctttgtaaattttcttccatccctttattttgagcctatgtgtgtctttgcacatgagatgggtctcttgaatacagcacactgatgggtcttgactctttacccagcttgccattctgtgtcacttaattggggcatttagcccatttacatttaaggctaatattgttatgtttgaatctgatcctgtcatcatgactctaactagttattttgcagacttgtttatgtagttgcttcatagtgtcattggtttttgtacttcagtgtgtttttctaggggctggtagtggttttccctttccatatttagtgcttccttcaggagctgttgcaaggcaggcctggtggtgacaaataccctcacctggaggtgtcaccagtgggggctgcagaacagcaaagatggctgcctgctccttcatcttggacctcttttccagagtgacagcgacctaatgccagggggcatgctcctgtataaggtgtctggtgactcctgttgtgggggtctcacctagtcaggaagcacaggatcggagacctgcttaatgaagcactctggctgccccttggtggagcgggtttgctgcactgagaggaatccccatcatctggagtgcccagcctctaaatagccagcaggcaggaaagactaagtctgctgaaccatggagattgcagctgcccctcccctcagggtctctgtcccagggagatcagagatttctctgtaaaccactggctggagttggtgaaattcccacagggaggccccactcagtgaggaggaatggatcagggtcccacctaaagaagcagtctggccatgatctgccacagccactgtgctgcattgtggggagttcctcctggtccagactgcccagtcttcctagcaccagcaggggaaaacagaagactgatgctgcagttgcagtgatggcagccaccctcacctctaggaactcggtcatcttaggcagtctccagcttgctgctgctggctgcaacctgagcatctgctgaacatctgcacagctctgtgcttgagacccaagatcctggtggcatgggctcacagggggatctactgatccatgggttgcacagattcatggaaaaagcatggtttcctggatggggtagcacaatcactcaccgcctcccttggctgtgagtgagagctccccttgccccatgcagctcccaagtgagccattgctccgccctgcttttcctcactctcagtgggttgcgccaaccacctagtcattcccaattagagaacctggatacctcagctgaaggtgcaggattcactcacccttttcattcttcacggtgggagccactgatggcagctgcttctaattggccatcttggcccctcccctgattttaaaaatatttttaagtaccttttagggtacaagtggtttctggttacatggatgatctatatagggtgaagtctgagattttagtgtacccttcacccaagtagtgaacactgtacctgatgtgtggtttttttatccctcgctcctgtcccaccctcccccttctgagtcttcactgttcattattctattctgtctgcctttgtgtacccatagcttagctcctacttatttataagtgagaacatacagtatttgccttcctctggtttttgtaacagggtaatgctggactcttaaaagagtttctttctcatctatctttgaaatagtttccatagaattgattttatcattctttaaatgtttggtagaattcaccatgaaaccatatagtcttgggtggttttgttttgtgttgttttgtttgggtggcaagattttaaattacaagtttttgtaatagataaaagaatattcaggtttttggtttcttcttgagtccattttcataatttatatctttcaaagaatttgcccattttatctaagttgggagtttactggcataaggttcatagtattctttgtatccttttactgttggtagcatctgtagtgatgtcccatccttcatgcctaaagctggtcatctgtatcttcttttcttttctcagcctaactagtacattactaattgtattgacttttttcaaagatgtactttttacttttattgatttttctctattttctatttcattgatttcttattttacctttattattttctttatttgtcttttcatttgattttttctctttgttagcttcttgaagtggaagcttagatttttatatctaacacagaaattaaaatctataaatttttctctaagcactgctttagttgcatatcatatatttagatgtgttatgatttcattttcattcagttcaagatatttttctcccctacctacctcattttttccccaaaagtattgaatatttgtcctagaataaacctccacaggataagaattatttattttaatcatgtgttttgtttatgtctataattttggtaggtctagtcctttgctgatcatttttctctttgtcttttgagatgattagtatgtgtattagtcctactttattcacatgtagaatttgaagctcacaatttattgatctaaggaatgaagtagaattattattttccatatttttgccagtgaaacaccaaatggcaagtaaaaatcttgagatgaatgtttaaagtgtggggtgtgtatatgtttgtatttttattcaaggtgaaataattaacttttaaaatatttatggctttcttaaattacaggctagagccaacaaatagtttgcctgttccttacatgtccctgatatatctttacaagtaatcatagcactgcttctgacaaggtcagatgcataattcgaacctttcttactccattcccaagctatttaataagcccattttgccagtaaatataggagagaaaaaataatgggccaaaattttcctgttgtttaacctaaatgaatattttcattttcatcttcctttcagaattattttctaatactagtatgaaaacatacataaagttcctaaaattgaataacatattacttagtatttacatacattacacacagcttaaataagtttgtggaaatgattattttaaaaattttagtattttgaaaattcatgtcatctcaaaaatagcttttacccagaattagcatcttaaatatttggattaatattctgttttataccccttataatattctcctagccatttaaatcatattctagtaatttagaatttgttccacttcaaacttctttgattttctcatactaaagagaattatttactaggcaaatcaacagtgtaaatgagatttcagttggttcacctaaagagtcaaattattttcaagaatgtaagtaggatcatttgcgtatataaaattaatgtatagatccgcctcatctcacattaaagtgcagtctctacttaaaaaacattttataagcaatcagtttgtattcttatatactttgaaaccattcaactgcttttacttttcaatattgactagtataagttgctattcacagtggcctgcctcctcccttgctatcaggcaactttttgtttaccttgccaaatatatccatgcattgaaaatccctttccctaacatttactatgacttctttaaaggtttctcttttgtcactatgacccttaaggccaaagtaagcaggtgttgcataacagtgggttcaaccataatgtatcaagaaggatagagggaaaatcagtaaggtactttcctgtgggaataccccataatctagtgccaaatttattctaattcatagctgaggacaataacctttgtttttacagtatttcccatgcagtttctaagatttatttttaaaaattttctaggagagatggactattctctattatgatctgctgtgatccataacttttatttttagctgtagaccttttgataagaattattgaaaaggcaagtataaaactagctagctggaaagctattctacatgctttagtctacaaaaatggtctttttatttatagcttacatgtaaaatcatatgatatttgtgatttttcaaatgtaattttgataattacctttaaagaaaaaaatatgtttatatcacaataaaaagtttaaatttttcttcaaatgtactgttttattcttctgtgtggatattgtctctttttctatttatcatcatggagaaaagttccagtccttggaatttatcttactaactaaagttcagcccagtaactagctaggtgagaccaagaataaattaggaacaaaatattttaaaaaatagatttgtcatgcttctttcacactgggtgttaagtagtgtgtgaagaaaatatggaaagctgttgttttatgaaactatattaggaatataataatttgactgtcctcattggtatgtcccttgttccctcttatgcccccaaatatctcatatatcttaatttgataaactgttttcattctttcatgtagaactgttttttgtttgtttgtttgtttgttttttgagacgaagtcttgttctgtcacccagactggagtgcagtggcgcgatgtcggctcactgcaacctccacctcccgggttcaagcaattctcctgcctcagccacccgaagagctgggattacaggcacctgccaccacacccagctaatttttgtatttttagtagagacagggtttcaccatgttggccaggctggtctcgaactcctgacctcaggtgatccacccaccttggcctcccagagtgctgggattacaggcatgatccactacatctggccagaactgtttaaatgataggaaagttgatattctatgttttgacattggagccattttccctattgtttatggactcagagtaatactggatttttaaataagttaatgtaattctgttattgttatactattaaaatagaacaacgtctgtgccatatttatggaggcactaaatggccacaaggaaatgacttccaagatgccaacatttgggcctatcaaaaacaaaggcagcttgctaccttatcgctgaatgataaaaagattttaatgctttgctcttaaatgtaaaagaacagcaagaattgttctttagtggtggaaagtctcaaccgtgaatgagagtaatcaacagacaaattgcagtgaacagaagaaaaattacaaaaacctttaattgacatcctcagataaataagaaaagatattgtgtccctaaacaagatactgtgaaaaggaaaattgagaaagagctctgagaaatgtaaatagtaatattgaattaattttttttgcaataaaatagttggaaggtatgctgaagtaaaatttccagaaaataaaagggcagagatgaaagagagaaaaagctaagagatcaacccagtggtttcaacattcaaaagaaaggagtccctgagagaaaaattattaaagaaataatatcagaaaacttcctcaacctaaagcccatgagtctccagactgtaccttgtacaaagatttaaagacccaatccaaggcatattatcacattgagcataaagttaatatcttaaaagcttctaaaaagagaatggtgtgggcacatttaaagaagtgcgcatccaagttaatccagacatcccattagcaattttttcagcttaaaaaaagaggaacaatgcaaaatttgtatggataatactttttgacttggagtgctacacacaaccaaatgtcggtcagttgcgtggcctaagaccacgcatgcagagacaacaacaaaatttccctggtatctttctgatgaagcttctgaaagaaagcacacccctacagaatgagggagctaatcaagaattaagaagacttaggatccgggaaaaaaagattattgaaaaaaggataccaagaagcaacattcaaagatgataaccagttcactataaaagcaacacacacctgaaaggagtggcatttccagaaaaagaaaaggggactggtacattatacaatatgtcaaaggtttagaaaacagtattgatttttgatagccctaatggagtctggaaaacatcaacataggtatatagaacattaagctaatttttttaaaaagagaagcaattattaactctaggaaaaattacacattgtggaaaaacaaaactgaatagtatatcaattggctctacagtgaaagttatctttgcaattgtaccaatggaagtactgtgttaactaggagttgttcattgatttctttgggagggtaaggatagagtagttcaagagttaaagcctcatttaccataatagagaagttagtaacttattgcctaaaaattagtaaatctagaaatggcagaattagcatctatttttaaatatagaggaaagaacaaagaaccatttaaaagaatttaagatgggtttccctggaaatggcaggcagccaactgtttttcattttaaacttttggtatttaggactctttgaaactatttgcacgtgtgctttttataaaaataaattttaattaccataaaattgtatttaaaatgtcagggaaatagaataattatggcttatagtcaagtttttacatttttgtcttgttattttctagagttcctggaataactattgctacagatattatctgtggttttcctggagaaacagatcaggattttcaagaaacagtgaaacttgttgaagagtacaaattcccaagcctgtttattaaccaattttacccaagaccaggaactcctgctgcaaaaatggaacaagttccagcacaagtggtaagatctttttcttgtaaggtattgttttttgccagtagctatagaaatgcagctgtgttgcctaccttcacacaacttgctcatgttataacccttaaattacaaaatatggagagatttccaagttggggtcaggggccagggggccgtggatgagttaaatgaccttaggcaactaaaatataatcacctttttcttcttttgaacagtaaaattcagatgacttggggaaaaaaatttttaattagtatctagtatttacctgtgtgtagaagataaacttttggatgtttcaaaataaggcaatatttaaatatttgtgtataaatgaggcttcatttttaccccactttttaagagactcttttcatagtttgttattgattgggatccccctagttttgctgcttttctattggatagatttgatactatctttctacctttttttttttttcagttttttcacaacgagcctcaatttaattttatcctttcatgttcacagatacagtagaattagatgactcataatgaatgtgaataagtttggaatcaagtaaaggcaaaatgtttcccagaatgccccagaaattaagggtctcaaaacaaatatctactttctagattcattggctgaatacgggcaaatgtaaaataagcctgaagagcaagtagaaatttaagtgaaaattttctactttgtttctaataactattaggttggtgcaaaagtaattgcggtttttgcctttaattaccgcaattacttttgcactaacctaaattttaaaaaattatgccctgtcattaatttgcctcaaatgtttttatgaataaatatgcaaagaaataatccagagcttgttactgtttttctgttatagcgtaagtgaatatcaaacacaacatatatattctttcaatatttggttgaaaaatagatgtatattagttaaagtctgttttttccaaaatcaaaagtgaatatcataaaaccaaaatgaagagcattatttgttttccccaaattttcctcatcttaatttacaactttctgtctatacaagggtaagaaaatattttgcaggtggaccatttaattttctttctaatctaatcaatgaaaaaaaagcagattgtaacaccacaaatcgttaacttcccacaaacataaaaagatgccaaattaattcattttcttctatatcacaagtatatattattgagggataacttacatacagcaaaattcactctttttggtgtacagttctatgacttctagcaaatgcatatagtagtgcaacctactacatgacaatcaagatatagaacaattccattagccccctcaagattcctttttacccttttgttttgttctgttttgttttgttttgctttcagacagggtatcgctctgttgcccaggctggagtgcagtgctgcaatcttggctcactgtagccccaacctcctgggctcaagcagtccttccacctcagcatctcaagtagctgggactacaggtgggtgccaccatgcccagctcattttgttttttagttttcatagagacagggtcctactatgtggcccaggttggtctcgaactcctggactcaagcgatcctcccatgttggtctccgaaagtgccagtattacaggtgtgagccactgcacccagctgatccttcttacccttttttgtaatcatcttctccctccattcacacccagttcctgacaactactgatctgttttctgttctcatagttcaatctattctttttttaaactttacttcttctttgctaaaaaagcttttgtactgtacctacagaaaagtatatggctgtgcacttttgtaaagtgaatacttccttataactaccagtcagatcaagaaattgaacatcaccaagtaccacacaggtccctgtcatgtcctccatttactgtcctctccccctcctcaaaggaagccaccatgccttattctgacaccacaggatagttttacccattattattctggatataaatgtaagaattcatgtttgagtgcttggattttgggtttttggggatttgtttgtttttgcataacattatgttggcgaactaatctgtttttaaagtagctgtagttcatccattgttattgccaggcagtgttctacagcatgcgtatatatatcacagtttattcatcctattgattattagccgggcgtggtggtgggcgcctgtagtctcagctattcgggaggctgaggcagaagaatggcgtgaacctgggaggtggagcttgcagtgagctgagatggttccactgcagcactccagcctgggcgacagagcaagacttgggtattttcaaaatcccaatattagtattgcagcaaatacagctgacagggttcttcttgtttttttcttttgttccacttgtgtgtaaacttttccactggggggtctggctaggagtgtaatcgctgagtcataggaaatgaaattgatctgctttactagataactgccaaatagtttccccaaatagttgaataaatttgcaatcccaacaacaatatataaaaatggtagaagctccatattcttaccagctcttggtattgttacattcttaatgttagccattctggtgggaatgtaacttaattttaattgtagttttatattttcctgttaattaaccattttgagtgtcttttatatgtttattagctatttgggtgtctttcttcatgaattacctgttcaaatcttttgcccatctacctgttggtttaccagttggatttacaacccgcccttacccccaatttataggagttatttacgtattctggctacagctccttggcaggtcatggtaatttaaatatcttcttccattctgtaacctaccttttctcttcatggtgccttttgaagaacagacgttcttcattttaatgtagaatttatcaattttttttttatgttagtgctttttgtgtcctcttaagaaatgtttaccttctccacaccatcataaagatacccctcaatgtactgttctagaaattttatcattttgccttttacctttaaatctgcagtccaattggaatttattttaatttaaggtatgaggtgtgtttgggtttcaggggaagttcacgtttgttttgggtttttttgcctcggaagctatccatttgagtcaatgcagtttattgaaaatatcattcttgtctcactcgcctgcctggtcacctttattataaatcacatgtatgtacatgtgtgggtctgtcctgggcatctattctgttcctttggtctgtttgtcagtctttccacccatacacaggttaactaccatagctttatagtaagtcttgatattggcaatgtaagtatttcaatgtcgtatttttcttgaaattgccctaactattgttgttcctttgtttttgtaaatttgtcaagtttcaccaaaaatcctgctggaattttgattaagatcatattgattttataggtcatttgggggaaactgatgttgttataatatcaagtttctgtccttaaatgaagtatatgtctccatttattttgatcttctctaatttctatcgataatgttttataattctctgtatatgtcttacatatcattttattaaatatgttcctacatgtgtgtttccattgatactattgaaatgattttcatttttgttgctacttagaaataaagttgattaaaatatatttattttgcccaactaattcacttattaattctaatagtgtttctgtagggtatttttttagattttcttagtatacagttatgtcatctgatagtcatagttttaatttttccattccaattctcatgacttttatttccttttcttatcttactatactggcaagaatgttcagtacactgagtagaattgggcatctttctcttcttcccaagctcaaggggagagttttcagaattttaccattaaatgtaaaagttagctgtagctttggaattagtaaagttcctttctattcctatttttccctgtgtctgtgtgtgtgttttaatcatgaatagagttgaactttatcatatgcttttttgtctattgaaataatatgatttgttttttgttctaagtctctgttaatattataacctacattgaatggttttcaaatattaaattaaccttgcattcctgtaataagctttacttggttgtgatatattgctattgataaaatatttctgttgtcttggttatatttcatgaaggttttgcatttttgttcatggaagacattgatctgtagttttcttgtaatgtcttcttaattttgttatcagagtagcattggcctcatagaattagttgagaaatcttccttcctctacatttttctggaagagtttgtatagaagtaaagtatttctttttaaaatatttgacagaattgcccaataaaatcccccagattttctttcttttttttttttttttttttttttttttttaaaacagagccttgctctgtcacccaggctggagtgctgcagtggcgccatctcagctcactgcaagctccgcctcccgggttcacgccattcttctgcctcagcctcccaaatagctgggactacaggcgcccgccaccacgcccggctaatttttttgtatttttagtagagtcgaggtttcaccgtgttaaccaggatggtctcgatctcctgaccttgtgatccacccgcctcagcctcccaaagtgctgggattacaggcatgagccaggtcccccagattttctcatcctcctcacccccaggttacacaccctttctaatctctgggactgtgaatttgatatttgctgtacttgctgatcgtttggttccactctgtgtagttatttttcccttttcctgaaagatagcacatgtgtacagctgaataattttctcggcctgatcctgccataagaatgttaagaatcctatggcctctttttattttgtactgtctctgtcccttttagtctacactggcagtgtgaattttttgtttgtttatttggttttggtttgtttgggcttttttctttttgtttctctcttttttttttggctcagttttctcaggaattttgtgggtcttccctggatttcactggaacttactccattagataaatgttatatccacagatctttatgagatcatccctgctctaccttagcctcttgctgagagtacttttctttgtatttatcctgcttgaggattcttggtgttttttcgccctgtgtcctcatttttttcagaaggtttggaaaccttagccattctttcttcagatatatattctactctcttctctcttcccctgtgatttcagttacatgtgctagatattttcttttgttccccaatatctgatatattctttgctatactttgtgcactttgttctgtgtttctgtctggatatttcctctttatctgtttcctatttccttggtattcgtaactgtccctgggccaacatccacagaaattgtagtccctgaacagcagtgttggcagcagctgtgaggctgctggaaatgcagactctcaggccccaccctagacctgttcagtcaccgtctgcatctccaggtgatttgtgtatacattaaaatttgtgaagcactgatcttgcttactaatcctttcttcatttgtttttaatctgctgtcaaacccatctatgggatttctaattttagttaatgtgttttttaattctagaattatagtttgaattttcatagatttccatgttctaattaaattattcatattttcctttatagtttttaaacatttatatggtttggctttgtgtcctcacccaaatctcatcttgaattgtaatccccacgtgtcaggggagagacctggtgggaggtgattggatcatgggggcagattcccccatgctgttttcatgatagtgagtgagttctcacaagatctgatggttttataaggggctcttccctcttgactctcctctctcctgccaccttgtgaagggggtgcctgctgccccttccaccgtgattgtaaatttcctgaggcctccccagccatgcggaactgtgagccaattaaacctcttttctttataatttacccagtctcaggcatttctttatagcagtgtgaaaacagactaatacaaacatattacttagttatcttaaagtccattccaaaatctccagtatttggatctcatattggttcatttctgctttttagttttgttttttcttgattctggtcgtttgtctttttctccatgtacctagtatttttttctttttttgaatggtggccattgtttattttttaaaaacctgtagattctaggctatcatgtatcttcctccagggaggattttattttgcttctgccaggtgctaaggtaagaactgattattttaatctgactgagatggatttttgagactgtttttcactctttctgatgactgctttatttctgcctgcccttacttttgaatgcagccagttgtgtgctagtgtttaacaagtgactctcgggagaaagagttctgatctgtagcatttgccagtttccatagtgtgaatacttccactgttgccaatttcagattaccaatgttacatcactgaagatggcactgggaagcgatacacacagccagcttttgtgaactggtacacgccacattaacgtaccacctagtgtagttcttctagtacccagctgaaattctatggtgattttaccaggactttttctttatggcagatcttcaactctaatttttgtatctcacgctcatgagaatgcatcaggctctgcgtatttacttcgcctcttagattttgtttggctgttcagcctcccaggcactacttaacattgataaatgtctagaaggaaaaagtgactccaaatattgagctgtcctccacgggcttgtcttctttctgggagcttgatctctcacttccttggtagctttttcatgtttaaatagtacagattgtacattttattcacctttttaattgttcttggcaagaacattggtctgatactagctagttagccagaagcagaactcattgcataaaatcagcttttaaatgcctttttttcggagcttgcagtgagccaagattgtgccattgcactctagcctgggcgactgagcgagactccgtctcaaaaaaaaaaaaaaaaaaaaaaaaaagcctgtttttgtcttgtcttttatcttctaaacgtagcctgttaccatcttcctcacgttttagacttcagtcacccaggcctggaatagagtatctttttttttttttttgtctttattttttaaagcacttttaggttcacagcaacattaagcagaaaataacacatagagttgctatatgtttcctgcccctacacatgcacagcttttcccagtacatttgttacaatcaacgaacctacattacatatcattttcacccaaagtccatagtttacattaggattgatcctaggtggtatacattatatgggttttgacaaatgtgaaatgacaagcatccaccactatagtatcatcagaataattccatttctccaaaatcctgtgttctctgcttgttcatccctctcttccccaaacccctggcaaccactgatctactgcctctaattttgccttttccagaatgtcacatatttggaaacatggagtgtgtagacttttcagattggctttttttgcttagtaatatacatttaagattcctttgaatcttttcacggcctgatagctcattttattttagcactgaataatatttcattgtgtggacgtaacacaatttatccatttacctactgaaggacatgttggttgcttccaagttttggcaattgtgaataaatctgctataaacatccacgtgcaggtttttttgtggacctaagtgttcagctcatttggataaataccaaagaggagcgtgattgctgaattgtatggtaagagtatgtttatagaagtatgtttataaaaaattgccacactgtcttccaaagccactctgccattttgcattcttaccagcaatgaatgagagttccttttgttccatatccttgccaacatccttgccaacatttggtattgtcagcattttggattttggccattgtaacaggtgtgtaatggtatctcactgtagttttaatttgtaattcactaatgacatatggtgttgagtgtcttttcatatacttatttgccatatgtatgttttctttggtgaggtgtctgttcaggtctgttgcccatttttaatcatgcagtttgtttccttattgttgagttataagagttctttgtgtattttgggtaacaattcattattagatgtgtgctttacaaatatatttttccagtctatggcctgttttctcattcgtttgaaacagactaatttttgtttatttattttgtttattattttgtttatttagcacttggaaatttttcaactttccactgcactgcaatctgaaacagtaaacttaggttcagagtgtcctaggccaacttgtgaagctgtttccttgtattattctcagttatactgttctgttctcaagagccaatattctgggattctgcactgttgttcttctcatgcagctctttattaaacctctttgtattaatgtcccaaagcttctataacaaagtaccacaaactagggggcttcaaacaacagaaatgtattatctgacgattctagaggctacaagtacaaagaaaagcctcttctccctcagaatcatgtaccagaatccttcctggcctgtcccagcttctggtgatttcctgatggtctttggtgtttcttggcctgcagctgcatagctctagtctctgactttattgtcacaaggtgtccgtgtatgtctctgtctttacatggctgttttcttaaaaggactaagtcatattggattaggggcccaccctgctcttcatctttactagttatgtctgaaacaagcctatttccacataaggtaacattctgaagtactggggattaggacttcagtatgactttttgtgggggatacaattcaatccacgagactcttctacatccctgtaattatgctctaggtaaaaaccattgcctggaagagtttcttctttataaaatgcagaaactttggtaaaaagaagcaaaaatggtgaaacttgagagatctgcagtcaaacagaagatatatgatgtgcactgagtcttcttggttctcttaaatttactaaaaattaataattgtctactctaccagtcttaggtagtttatgaaactgcttatgaaactagaattcactaaaatataatactattgcaaaatgggtagcagttttttggttttttctttcttaaaaatttattatttttttaaaatttcaataactttaggagtacacatggtttgtggttatatggatggattgtatagtggtgaagtctgaggttttagtgcacccatcatgtgagtagtgtacattgtacccaaaatgtagtggtgttttttttttaatccttcacctactcctacctccccacttctgagtctccaaagcctatttccttgccaaaagaataatcagtgaacatatgtacaattattgtgtgccaattgtaaattttttaaaaatcaataatgaaagtagatgctaacccattattagaagaagagtacaatacaataccagttgctttcaaataatatctttttgttttggctttagaatgcctcttagtgaagatatactattttctgagatacgttttatttctgctaacaacaagtcccaaaaaatgttcttcccctgtagatgacataaggataagtatactctccccgtcatatttacttttacataaatattagcattaatataaataaatttcagtgttttaatctattatggcagagctctaataaatgaactaaattgtttgtattcttaattatttaaatcccaaatggataagacaccctttagttgaattttgtatttgtatagggggagagatgaattcttcgccttgattgcctactgaaaaaaaagagtataatcctcttaactttataatgaaaataaattagacaatatattttcatgaacaggataaactaaaatttattttttttagcttttacaagactataatatataagcgatttaataatgaaatcacctaagccaaatgagagcgactagatttttagatgaaaggtcagatttgcaagttcatattttctgttccattaagtcttccttcattagtcttcattcatttgaagtaattccagtagtatttttaaattgtggctgagattcttggtctgcctaggaaaggtcacctaagtttaaaaagtcttttgatcctcggcggtcaattccagactttgctttttagaaaatattgatgatgaataatgaaattattgtgaaatctttatattaggagtcttatgacttgaaaaaaacaattagatggcaagagtggctgttagaatgtttatatagctttaagatgttaaattgtgatacatctacctacttgcttgtcttacatgttggaaccagagagtaaaggcaatatctttgattatatgtcctcataaaagaatcatagttcacttacctgcagtttctagaacttttacccttaagaaagaatgtaagggagtgtttctaagagggctggagggacattcttgtgggggttagagacagctttgccaaaacggtctctggcagattttccttgtgaggaattacattgttgctgtgggtgttcataccaaggcagggtgaccacttggaacagatattgaataaagaatattcttaaatcatatatagaagcttgctcaatgacatacagtgactctcccaaatctagctgccagtgggtcaaggaatattttatttttcacacacacacagacacgtgagtgcgcacatgtacatatgtccgagaaacatagcatataaaagagctttgtcactttctttaaatgcctttaaacctttttgtttctgagtgtaatccttacgtttaacaactcagtgttttaaagaatatcaggttgccttaatggaaggaatactgaatcttttagcttactcgataacagaattacattatttactcagtgtcagattttttaattaaatttgttttcttggaggaaagagaaaaaatattttcaagaatttttatactctggattgttaagtaccttttattctaaattgattcccaaacatacccatagggaagacccttttctcaagaactttttcattttaacttctcttttttagaaagactatcttggcattcttattcttatgcaacttaattgtacttgatcccttccagttgatcttttgaagtcctttcttctggacacatcatttttgtttttacttccattttcgatggagtttttagcctgcccataattttgttgtatctggatttcagcagatcatttaacagagctttttataatgactctatactagagagaagtatgagctagattataatagaaagatagttgagagcctcctactttgtgtgggtttttatacagaggatatttatttaacataaacttaatgatcccaaagacttcttgaaatgcctaataatctttgatttttctattagacaattttaaggccacttttcaacctatatatatagaaagatttaggtgctttctttttctagatggttggtgtaaatatgttatctacatttcccattctttcaccttctattttattatgaatctaatgactttttgtttgtacaattggttgatcaaatcttcttgaattcaaataggaatactattaaattcattgttataggggctcaaatggcagcaatgagacctaatatggtaggcagagtaacgggtcctcaaagatatccatgtcctaatcccgaaacttgtgaatatgttaccttgcatggtgtattagttcattcttgcactgctataaagaactacctgagactgggtagtttataaagaaaaaaagcttaattgtgctcatggttctgcaggctttacaggcttctgcttttggggtggcttcaggaaacttataatcactgcagaaggcaaaggggaagcaggtacatattcacatggccagcaggaaaggggcagggggaagtgctatacacttttacaacaaccagatcttgtgagaactcgctcgctatcatgagaacagcaagggggaagtctgcccccatgacccagtcacctctcaccaggtcccttcttcaacacagtaattacaattcgacatgagatttgggtggggacacagagccaagccaaaccatatcacatggtgaaaagaactttgcagatgcaattaagttcaagctcttgagatggggaggttttcatggattacctgagtggggtcaatgtaatcacaaggatcctcataaaggggagcaagagggtcccagttagaggagatgtgagggcagaaacaaaggtcagagtgataagctctgaaggtcaaggaagggaccacgggcataaaatgcaggtggcctttagaagctggaaaaggcaagagcagattctcccctagagcctcctgaaggaacacagccctgccaaaacccttgattttaggagactcatttcagatttctcacctccagaactataatataataaatttgtgttttgtggtaatttgttactgcaactatatgaaacttgtacactatggaatattttgatctgagaacattgtctggcttttcgagacagctaaattaattgatctttcagggctttatgttacccagggtttgctgtatcactaggtgacacatgcttattcctagatctgtgaacagttagctagatactaccctacagtcacaataatctttgggcctaatcataataatgatataacaaaagtaagagttaacatttagccatgattatatgtcagatgttgttctgagccctttaatgtatttcattctcacagctctctgccgttagaactgttattattgtcattctgcacatcaggaaactgaggccatgagtgattaactagcccaagatcatacagaggagctcctgcctgcctctccactcctcgatcttgccattccttccaactcactctttgctcccacatctgactgcttgtagttcccagcatacttttatattcatctcccctgcctcagattccttcctcgtcctctcacacagcggggtgcagggtgaggaggagagcttggatcatttgcacttagcatttaagcctctcttcagccttccctgatcatccctggcttggatgatcaccctgttctcctccccacctctttcatgttcccataaattttggtgcttatttataccctgtcacttatgatgtataactggttttgagaaatgtgggggctaatctttctatcatgtgcacctagcacaatacctggcatagagcaggaactcagtatgtgttggattgacagatgctgtaaaattgaattctgagagttgagatgccatcagctgtgagaagtggggggtgcctgtgtgagaggaagaatggctgttacaggggcggcgtgggacagaacctgggcacaaataaaacagggaacattaatgagaataaaattcattcccattggggcggtgagatatatttttgtttgtttgtttgtttttgatgaagtggagaacaatatgcaggaataggttagtgtcaataaatgagtcaggtactataggcaaggcttagattaagatggccatataagccatgttaaatagctttaaactgtcctgtgggcagtagggagctactgagtagtagtgatcttatgtctgttttggaaagctctgtctaggtggcaggggaacagaggaatcagaaagcccattgagaagctactgcaagagatagagttggaaactagtaagtggatttaaagaatctctgtgacttattcctgagactttagatacgtcttcttcttttggactaaatcattccaagtcccagacttagttgcatgtcagcaaattattctgtgttctatggaaaacattaactcatgccacaggcattcactaattgggttttccttgactgtagacttaacagatcaaatattggtaggcaagaacattttacaaggacccttgaacgttgctgaaaatttaaggcaatataaattgattttgccttttgctacagctggtgctgatgacattatcttccctaatggtcatgagattacttcctggaccaggcccaacctcttctactctgaagtagaaacaccaacccctccagccctctttccttgtctgctccctatcttttcccctacttgattttatcttttcccaagctgtttctacttgccagttacaggattggcttttttcttgtggcctctttatctttctttttgtttttgttgttctaagcaccataagataagcttatcaactttgtctctgtgtgtgtgtgtgtgtgtgtgtgtgtgtgtgtttgaaccatgtagaaaactctgggcttgggaacatttgaagaagctggagccctgattggatcattcttttttttttttttctttgaatccttcttaaattgagcacttcccttatatccactgtcacactaacaaaagtaaagaaaaagggggtgctaacatttggaacttggaaacgtgaaaataacaaaaattgttgttaagcctcagctgtgtagagggaagtttgccaatgatacccttgggttgtctaccatcttgaatctgaaatagagaatctaacaaacatgactaatctggagtaaatggaagcagaccttgtcaagatctcatgaaagaaaagactgtttctaagacggaaatgctctccagcagtgtaaacagtgtgcatgggtgtgggctgatgcagtacctctcctcccagggacctgcacaaggagaccagggagataccacagccgagagtgtcaccagtaagaactctattagtttttactgccacaggtaatatcttttttaagagcgtgctcctgattcctctcagtcagaatcatcctttcaggatcccaaccttttccctctgtactatcactgttccccctaattttctaccctctgaacctgacctcttgcctacctgccacagagcactggcccaactttttgtttagccccaatgtgacaatgatgaactaaattccattaccatgtaaatcaactttgtgtagtcagaccaacaggaccagatgtgtacggcacaagtgtagactaacttcgggatggagccgtgtttttgtgggattggtttttacttaagatggtaaagataagaagaaaacccacagattgttggtactaaaagctctttcatgtgactctcctgttaattataagccatttctagaaaaaatcagggatgactgtacttgggaacatataattggtattgggaatcttagcatttcaagttttctaaaataacccaactttaggataatgaggaatcatatatgctttgaagagccttgacttcactgatagcaattttaatttgtgctttgtagtgatagaaaatcattttaaaaaaatgcctgtcaaagaaataaactcaacctgtttcttatgattaattttttgccttccttttggcattcatttttatcctgcttcttttacgaatttgtaattaccaaaagaggaagaagatatgtggttataagttttctctcacatgctgaaaggtggcaggtattagagttgagaaagactgagtgaatttatattaaataaggagaatataaattttatcctttgaaaagtcatctttattatatttcagtctaactttttctccagtggtgattacataccttgttttatacaagtttcagaaaaactgcaaggatctatataataattcttttatgccttttatatgaacttgatttattaaaattgtaatattcaatttgaattcatttttattacattagtaacaactttagaagtgagtagactcttggagtaacttctaaagataaagaaccttataatgatatatctttttttttttttttttgagatggagtctcactctgtcacccaggctagagtgcagtggcgcgatctcatctcactgcaacctccgcctcctaggttcaagcaattctcctgcctcagcctcccaagtagctgggactacaggtgcccgccaccacacctggctaatttttgtatttttttttttagtaaagatggggttttcccatgttggacaggctggtctcaaactcctgacctcatgtaatccacccacctcagcctcccaaagtgctaggattacaggcatgagccactgtgcccagccaatataccttatttgttagccttatttttgttctgtgataagtatggttcattaataactccatatatttataacgttccaaaggacttatacatgtagttccaagtataagagctatgtataatgttaactgtgtattcaggtcaatggaatagatttggtaatctaacatgaaactcttttaaaactcttgccccttgcaatccatttatttcataattaaggacaatataatcaaatatgagcaaataagcattcaaatggacaaaaatgtactgtactagttatgttccatctgggatcttgtaatctaagatgaatgacctggtgctttattttgcttctcataatgacatgccttcagagaagtgtggataagataagaagttagaagggcaggggaagaaaccttccattgtttggatgttaatatgtgccagaaacaaacaaacatagtctatgcttttcatgtactttgtctcctgttattctttcaacaatctttttaggtgtcttttatgacttttactttgcacatgagttagttaactcagctcagagaagttaagttcatttgtctcaggttatgtaactattaagtaaaaagcttgagactgagacttcattctttcttattggtccttgctcttataaacagtaaaataagtactcatccgataaattcaaagtaattttagaacattttgaccaaacaagtgtcagtttttaaagttgtttttctattatgacagtaagtttataggccttagaaaatttttaaacttcttaaaaatgattttgtcttttatagaaaagttgtaagaataatacaaagacctccagtacaagttgagtatcctttatctaagatgattgagaccagaagttttccagatttctgatttttctcagatcttggaataattgcatatatataatgtgatatcttggggatgcgaactaagtctgaacgtgaaattcatttatgtttcttttgtttttttttttttttttgagacagggtctcgttctgttgcccaggctggagtgcagcggcacagtcacggctccctgcaacctcgacctcctgggctcatacagttctcccacctcagcctcccaagtagctgggactacaggcatgcaccaccacacctggttaattttttgtagagacaggatcttgtcatgttgcccggagtggtcgcaaactcctgagctcaagtgatccacttgcttcggcctcccaaaatgctaggattacaggtgtgagccaccatgcccggtctcatttatgtttcatatataccttatacacatagcctagcattaattttatacaatgtttttaataattttgtgcaagaaacaaaggtttgaatgcattttaactgcaactcctcacatgaggtcagatgtggaattttgtggagtcatgttggtgctcaaaagtttcagattttggagcattttggatttctgaattagggatgctcaacctgtataacccttagtgagatgatcagtttttaacattttgctacatttgctttctctttctctgaagagaaagacagatgtagatgtagtcatagatattttgctgctaaacaatttcagaatgggttacagacatcatgtccctttacccccttaatatttagtgtatatttcctaagaatgagtttcttacatgatcacagtactgttatctaaatcaggaaatttaacattgacacagtgctttaatctacagtttatattctaattttgtcaagagccccgacaatatgtatagcaattgctttcccaatagaggagtcagtctaggatcatggcttgcatttagttgttctatttctgtagtctccttgaatctatacagttcctaagccttttttatctttcatgatattgacatttttaagaatactggccagttatttaatggaatgtccctcaatttgagtttgagttttcctcatgattagattcaggttatatgctttgccctcttaagctaaataaaaatgatgtcatatccttctcagaagatctgagaaggtatatgatgtgcttttgccctttatcggcgatgctaaatttgatcacttggttcaggtgttagctggtttgtctagtttcttcactacgtagttatctgtttttggataagaacttgtaatcccaagtattgaataggattgtagaagaaagaaacgggaggccttgaaaactcaaaactctcagtggtttagttcacatttgcaattttatgatgacttgaactgtcatcttatgtagtccacaagatttttcatttctaatagattaagtttaatctattctaaatctttgggttatttctaatagttttaagtccttagactatatttttaaaataaaatattttgaattggatatacagtgacggaggagcaactaaagttggaaaggcagaaatttatttcattgaagtgcctgtttatttacttggcagataatacatgtaaatctttcatcctcagaaactgtgcagatcaaaacctatgtgggttaagagaagctaggtaaattcagttgatgaatttttagtttttagggggaattcgtaggtcataagtgaactatttttcctgaagtactataatactgacttaccaaatctgcctgggtatgacttagtgtcaaaggcatactcttggagtaaaaaatattttccatgtaccttacattcctttactgccattcctctcaatgtttattatcagtgaaatcacaaagtattccctctaactattttctgggttctttgaacttgttattttaggataaacaaatataaagaggtggaagaaaatttccccatgtaaattccagttggttttggaatcaagcacaaaaatatatgactgatatccctggggccgttacaaagttatatgatgcagtagttgatggattccttcccaactaacttgacattaaggcttggcagagagccccgggagccccacaatcccctgggagcagccttcttcattcttctctctaggttaacccagaactagtcaaatactattaaaatgaaaatcagtgtgttctctaagggttgaaaaggttattcatactgataatttgtcaggtacctgaaatcctatcctattaacaaacctaaagactactgtgaacgagtttaatttgattttatcttacattagcagccagagttatccaggggaagattggaagaaggctgtctggtggtgcatctcactagtgtgtagaaactacagcaatctttttgcctgtaatcacccaaaacatggctttcgggagtcatgtaagtctcttgatcattttgaccatcagaactgcatttcttttagaaatcatagtcaaaactgtagttaaaataaaaattgttaatttgcctggtattgagtaagcttctactacatgcaaggaactgtgctgggtaggacactacatctcaagatgactcctgggtgctccttactcaagaggcatgtaatccagaaaggaagaggaagtatggtgctgacagtaccacaggaccgtgtgtctccactgctgtaagagctatacaaagggctgttaaaacttgggggcttgtgagtgggatggtcgaggtcactgttaacaaaaaagtaacttttaagctgagcttttcactacatgaaagatattgggagtgaggtatgagatgtttttagaaagtgatcgcagtacagttgtaaaatccagggtttctagtgaacaatgagaaagactttttaccaggtgctttgggctccatcaagagaattcaactgtataatcctcctggatctacagccgcattggcccttgggaattttcctagataataaactgagccatcagaagtatgacatctgtactcagtaggcaaggagtgacgcaatctaagcagtgctgtagaaagatgaaattagtaaaaatatgctaattgcatcagagtggagaaaggctgcaggcaggaattaagacggtaatgaaacagtgttgttatgaagtctaagagtctgtgccttgatgagactatgagggtagtcagaaaggcaagagaagttgaaggaagaatctctatgacttgtacactggataatactggtagcttacatagaccttgtgtagtgcttgccgccttgcactgttttggtgttttatatatgttgtttcatttaatcttcatgccaaccctgtgggtaatgattgtttttatccccactttacataagaggaaactgaggcacaaagagtataacttgctcaaagtgacacaattaatggtggacttaggattcaaaaccaagaattctgcttccatactctgcttcttaaatattgtatctataataaattatagtggcaagggagaaagaaaattagtgcctaaaataaagttctgagaaacttaattaaaatatagactcctcaatttctattttaaatctataggattttagagccaaaattttactcatttaaagacaaaattcttttaactggcgctacaacttaaagacaaattccatgttcatagaggtttgaggagatagaatgacttaccaaatgcctgatccatgccagcgcctaggtgggtgaactagtgggagccataggcgaacaccgaagtcctggctgttaaaaggggcatctgtagatgtttagggtcagagtctggcactgagtcttctctctgcttgctcctagtagcccctttaccttcctaacagttcccagagaccttttcttttttaaactctatccacctgccatgtttccccccgactgcccaagaccagctttaagtatgatttagggcccaagctccttgttgctttgcccaaactgctttttcactttgactttttttgctattctctgtagaagacaggagaaaaacagaatgaaaactttgaggaaatttacaaaggttaaaaaatatcatagtccctcatttttaattcttaactgtctcactagatctaaatgtcattgtcctaaaatatttttctgggaacatttatgtatcaagcattggttaaaatggcaccccaaacctctgtagcccaataactctcttgtttattaattagtatgatgttccttaacttcaccatatgtatccacccttccattaatttagtgaactcttttccttctgcacccaggcctaagacaacaatgcataaactgcctgaaattgtgagcaagctttgtgccccatactctatccaaagaccgagcaagggatgccagatgtcattggaaatagagtaagatggaaaaaactttaaaatcacagctgctctacgggaggactctatatgggttgtaactgattctttgagaaacatccttgctccttgtaactgccttctaaggagcgggcgcctagttaacttcaagtctttgttttttttggagatagcatctagttctgtctcccaggctggagtgcagtggcacaaacacagctccctgcagcctcaaacttgggctcaaatgatcctccagcctcagcttcctgaagtgctgggattacagacataagccactgctcctggccaacttcaggtctttttatttgccaagtggggtgtacaagctaggacaccactgctgatgtgattatcttctactccgttcctatagtcctcagctgatcctccaaaaacatcagatatttaaagaatattggctttcatggacaccaaataagtagtttctaaaaggctcctgggagagcattttatctaaccctaactcttggtcaatggttcttaacattttttgagaataattttatatatgtgtgtttatataaatgtatatttaattatatttaatatacagatatgcatgcatgcgtgcacacacacacacacatttcctagaaaaaaaacaaatttgtccaaaaatctccgaccggatgattctccgaagttacaccatcaacctgtccctctgaagtcaagccgcttctctctaacatccaactgtggtcctgtctactggctgaatatggggtttttatatgtacaggatgggacgggacagggccatgggttgtttaggaaaaggcagtattcgggcaggaaaacagggatataagttctcattttgggccacagtttcaggctttttagcttgagggtagggttatgccagggacccacatttttctgcctagaatttctctgtcccttgtccctatcaatgggaacaacatagttgaacatctggctagtgactatacttcatataaacctatcagagaaaaacgggttcaaaaacaaagatagtacttccaggatctgggtcaacagagatctgggaaagaagggcaagagaccactgcacaattagttcaattaacctgaaactggagaagacttcatttccccatagaaatagttcataaatagtacatataattgaaaaccaaccataatctacagatatgtagttaaataattggttttcggttgtcattttgggttttctggaagtggaggttctaacaaaatgtaattatttataatgggaaaagatgcagtcttacttcaaccaacttaataaagaacaaagttatggagcatagctagttcaaaagttaggaaatgtccttattatttcctgttgctttcattaattaatacttggcttcacagcactatttttgttttggaattgatagtatttttctacaagtctttaaaattaatatgataggctgggcatggtgactcacacctgtaatcccagcactttgggaggctgaggagggtggatcatttgaggtcaggagttcaagaccagtctggccaatacagtgaaaccccgtctctactaaaaatacaaaaattagccaggtgttatggcaggcgcctgtaatcccagctactcaagagcctgaggtgggagaagcacttgaaactgggaggcagaggttgcattgagccgagatcatgccactgcacccctgcctgggcaacagagcaagactccatctcaaaaaataaataaaataaaattagtatgatatagacaatgttaaatgattctttcccattatctatggataccgggtcatgcactatgcaactttacagtatattatgcttatggaaattaaaatcgtagcatttacttcccttgatttttaaaggaataaagcaaaaaggattaattgacattcttttcaacgtcagttgatggtgagatgaatgttttttaattaccatgccttaaaaaatttacagataggacgggtgtggtggctgatgcccacaatcccagcacttcgggaggctgaggtgggaggattgcttgagcccagaagtttgagaccagcctgggcaacatagtgagacccctgtctctacaaaaaataaaaaaattagccaggtgtggtggtgcacacctgtagtcccagctactcaggaggctgaggcaggaggatcactggagcctaggaggcagaggctgcagtaagctgtgatccttccactacattccagcctgggtaacagagcaagaccctgtctctagaaaaaaaaacaaaagtgcaaatagcaaattaaaataggcatacataataagtatgtgactgtgtagatcctttggattggccagcaaagctctctctgaggaggtgacatctaagttaaatgtgagtaaggagtagccttgtgaagatactaggaaagaggagttgaggctgaggaaatagctacacaaacaccttcaaaaggaaataagcgtggagaaacaaaaaggaacaccttacagcttgaagcgtcatgggtgagaagacttgtaggaaatgaaggaggccaggtggtcaagagtcagatcatggcaagctttataagccaggttaaggtctgtagagcaaagtaagccataaatattaattcctatatagtgagatttgaggacattggattcttgtttgcctctgaaatattgggaatgcatagctacaaccaattaaaataggaagttacgtatgagctgagatcatggtgagaagagaatagcttactcttgttttttattgctatatagcatgcagtgttagggttatcctcattctttgaatttatggagagacatcatctagtcattaatgaagaaagtttttacaagggtgatgtctttgtagctataagtaaatagacacctgttacctttcagctcatgataagataatgaatacaagtgatattattgaacaccacagtcatgttaattggaaaactaattaagaaccttgtatgttgataataggaactaacatttattgagtgattactatatgcagacactgtaccaagcattttattgacatttcatctaatcttcatggcattcctacaatagatggtgtgcatatcaaggctgtaagtgaagcctgtatttaagagccaactgggccaaaagggtaagcacaacttcaacacatttgattgctttccatacctagcatacacagtttcttctgtctttgaacacagttttcataaaatataaaatccattgtgcttagaaaaacaaaacctgagttgtaacattctactttcataattccctttgctgatagagactgatttatggattatggagttatatatttttctacagcctctggaagaaaggaatgacactcatatatatatgaaagtatacataaaacagaatttctagccttatctcaaactttttcactttttatttgttcagggaatactgttagattattatttaccttgttctatatatcaattatttcaaaagagaaattcatgaatgtcatatgtgtatgtgtgaactaagaatatatttgtaagtatactaacaattttttcttttttcttttttttttttttttgagacagagtctcactctgtcacccaggttggaatgcagtggtgcaaaataatggctcactgcagcctcaacctcctgggtcacacgatcctcctgcctcagcctcctaagtagttgggactccaggcaagcaccacaatgcctagctaattttttgtagagacagggtcttacactattgccccagctggtcttaaactcctgggctcaagcagtcttcctgcctctgcctcccgatgtgctgtgactgcaggcatgagtgtactaacaattcttcaaagagtaagtctggtttcagatttagaaggaaagattaagacagatctagtttcattgtctctcaaatcctgccaaaatacatcatagagatttttagtacaggagttattaacccacaaatataaagaggacaggctaggagaggaaaccccacaacaagattgtgacagctggggagcagctagaaattggcaactcacctcaccaacctgaagaaacctaaatgccaacctagcagtggggaaaaaccaaaacccaagttatgaacaaacttgatatataccagagaatcctcaaatggtcaaggaattggctggcacttttgaaagggagaatgaagtaggaaatgagggcactaacataagaaggattgtttaaaactacttaagaagcagcagctggattgccccattccctccccagctcaggcgtacagctcaggcatctcctcactcacaccaacagaagactggaggctcattctttgaggggaaaatgaaaagtctctggactgaagaacctgtggtacagttgagggcaaggggaattcagtgcctatatggatatcaaatgccctctttgttcatttagcagctagaatgctggcagtcacacacgcctttccttgtttgggaaacctgatcagttcaatacttagagatgttgacatcagaggttccataattaaacaattcaaccagatcatcctatattgaggctcatacttgacaaatgcagcaacaggctcagaactttctttttttttttttttttttttttttttttttttttttttttttttttgagacggaggctcgctgtgtcgcccaggctggagtgcagtggcgtgatctcggctcactgcaagctccgcctcccgggttcacgccattctcctgcctcagcctcccgagtagctgggactacaggcgcccgccactacgcctggctcattttttgtatttttagtagagacggggtttcaccatgttagccaggatggtctcgatctcctgacctcgtgatccgcccgcctcggcctcccaaagtcctgggattacaggcgtgagccactgcgcctggccaggctcagaactttcaatcagctttttttttttctgggtcgggggggcggggtttagattaactgattcttttttttttttttttaagttccgggatacatgtgcagaacgtgcaggtttgttacataggtatacatgtgccatggtggtttgctgcacctgtcaacccttcatctaggttttaagccccacaggcattaggtatttgtcctaatgctctccctccttttgccccccactcccctcgacaggccctggtgtgtgttggtcctctccctgtgtccatgtattctcattgttcagctcccacttacgagtgagaacatgtggtgtttggttttctgttcctgttttaatttgctgaggatgatcaatcagctttttaagcctcttactcttaaacataagtagcaagcaaggattaccaaattcctgaggaaagccctaactaacacaaaggacaggaccaaagcaaacagaataggaatggagtgagagagaaaataaaaaataagaaagaaacaggactgggcaggaagacgaaaacttaaaaaaaaaaaaaagaagttactgatattctcagataaatgagagaagatattttattcatgaaataagattgagacatcaaaaaagtgattgggagagcaaaaaataattcttagacattaaaaacatggtagcaaaggtaaaaattcaatagaattggaaggttaaagtagagaaaatctctagaaagtagaaccaaaaaaaaaaataagatgaaaaatagaaggaaaaatatagaaaaatcaaagaacaaatctgggaagggtccaacattcaaataataggaattccaaaacagggtaaacaaagaaaggaagaaattggcaatgaataattcaaggacatttttaatgactgaaggtcatgaattaacagactgaaagcaatccccatggacgcagcattatggatgaaatgtagacccatgccaagacaagagagaaaagccaggtcacattcaaaggaccaggactcaaatttcaaactgacttcaaacttaccaacagcacccagagaagaaatgagtgattccttccctattttgaagaaaaatgcttttcatcctaggattttgtacccaccaaagtattcatcagatttcaggatactcctttctcaggaagcctttccagaattttgggcatcatgaaaacaagagagtaagctaagaaagaagatacgaagatgtgggataaaggaaacagcagactcagcacagatgagaggtgagcgaaatctccaggatgatggtaaatgggacagccatgtatcagagctggagaatagacagattgaaccagaatgtgccagaaaggtccagaggaaacttcttcaagaggatgaaaggatagaatgcttattgtgaatgcacttcttgcgaggtgatttagataagtggaagagaacttggattgaattggtcataaagacatagataaccaactgagctgctgctgctgcttttttttttttttttttttttttttttttttttttttttggagacagggcctctctgtcttccaggctggagtgcagtggcacgatcatggtcatggctcactgcaaccttgaactcccaggctcaagcaatcctcccacctcccaccttagcctcctgagtagctgggtgtgacggtaggtgcaccaccacacctggcttttttttttttttttttgtagagacagggtcttactatcttgtccaggctggtctcaaacttctggcctcaagctatcctcccaccttggcctaccaaagtgctgggactacaggcataagtcactgcacttgtccatcaagcatattttttaaattactaactccagagaaaacaaaatatacagacaagaaaatataattaggtattacttgggtaaaatctgaatagcatgtgtatgatcatgggaagtggaggtaagaaatatatacataaatagagtgggcaggggagggaatgcaagctcatcttccctagagggaagtcaggagatagtatctagtagtaagaaattaccaatagcaaaaatgacatgttacttggcaatatggaggtaaataccaaaagaataaactaaaaagagttgaaggtagttacttctaaggaagcagaaatgggaaagggaagctgggaagctatgtggagctggttggttcttagatcatatacatggataactgattttgaaaaaactgaaaaaataagcagatgctttagggggtttaagattaacagagttgctaaaaacaaacaacatacacaaaaatagacaaactctccaagatagaatcttatttaggtgtacatgaaaataaagagctaaaaagatgctagagctgaaaaagaaaaagaagcaaaaagaacatgtagcttcctctacaataaatagaaagaacttctaaattgccgaggaatttaaaacataaaagtaaagatgtttatggtcttggttgttagtgatagaagaagccaatagatccagacactaggtaaagagatggggtttaatttactaataaaatacacagagcagatacgcaaatcttttaaatgaatgaatgcttattaaaatatagttattacagtttgaaaatataaagcactatctgtgtcaaaagaatgtttggactttgacattgattaaacttactttaagcataactcttttaaaattatcacaatcaggtagttcattgagctcttctaagatactcctgtcgttttacattctaaacatgttgtgtgttaaaccaactggctttttttaaaaacaccttaggatcctcttccaatgaaaaaaacagaaagcatacagtatacgcaataagtggatggttaggacctcttgcttcttcagtatgtctctctgaagagttaaggaaagcagagaaaggtggagataaggttggcagggatgggagagcagtatcccgaggctgagtggagaggcctaggctaagcccctgaaagtatgcttcttgtgatgggtgcagggcctctctaagaatggaaaggatgaatgaagaatagtaggactttagcctgcaggaaggtctataagtggtggacctgaggcatcactttctgcctgtttgctcattacttaaaatggtcaggcctgtcatttgatacagaaacctacactgtctgggcatccttttcccacttgtgtgaacatgggttgatttctgaaagagtgattatataacacaaattatatataactagagttgctttaggtgttagaatgggtgcaaggggaaactcagctactttatttttctcttgctttgctcttctgtaatttcctagcctcttggtccccctttccccccaacccccctcctacccctacacacatacatacctgtacccctcctgccgaaggcttgacagtgttgcttggcaaagagccaacttcagaaattttcatccactggctatctctgtgtagtatcccttgctctacaacataaaaaagaaaatcaactgatttctgaagtgacataaagacgagagaatggagaagattgagctgtatattaaattgctttctggttatcaaataaagactcctttgtcataaaggccaaagataaaaaagaaaatgtgtatgtttaatatatggaacaaaaataagtctatttttgacatagtacttgaggagaagatgggtcaaaaagcccagccacccctgaaatgaattttagactcttattattggtatgatggggcagagagagatatcagtgatggttgcattgctgatagaaatgattttttacagtaggtgctaaattagatgtagaaaggagagttatcaaacctacattgtcatgtctgaccttccaggtcccagtcgaggaatcatcataaaaacgagttgtgggcttatctagagatgcagcaataactggcacagaacaattttcgagcttctcttcaaatggggtgacaccaggggttattcggggtagggagggagatgcattggctttgatcagtttttagaactgtatagcagcttatctgtgggtcagagaaatttcgttttctccattcttttttcatcactttttcccttgggtgcgatgtggattagcgtctggaagctggtatgaggctctgagcattaatagagtttgcgcagatccagactctgttttcgcaatactgggctcaagctcagcctcgctgaatgttagattcagtaaaggcacattaccatctctccataaataaaaggaagagaaatacttaatgacaatgtagaaatacatagaactccaggatactaattagcaaaactcacactgcatttattttatccagttgcacagtgttactctctcatagttatgtctctaacataacttccttttttaactttttgtttaattatattgcctgtctttaagaaaataatttataggtatcaggcattattattaagcaaatggtaaaaaataaataaataaataaaaccacttgctgtcacccttcctaattttaaaaaatttataacatagcagaacttttaaaacaaaaataaaaacagtgtagtacatagacagcagcgagtttgttgccccacactatctgctaggttttgaggatgggacagactttgagagttttagcactgtaactgctaatttttctaaaatagcagtgtgagaatagttatcttgtcatatgttaaaggaacattttaaattttagaaataactgaaacttcttcatgcattggtaatatttatatcaagaatgtatctagaaatactaaaattattggaaagtaaaattcagcaagacttggattaagccctatttgctttgctttatcaaacagtttagattcagggtattcaaaggggcagggaggacattgatggggacacagtatttattcttgtagtctcaggtatttgggtataaaacctagtgtcttcagccaggtgtggtggttcacacctgtagtgctagcactttgggaggctgaggctgttggattacctgaggtcaggagttcaagaccagcctgaccaacagggtgaaaccccgtctctactaaaaatacaaaaataagctgggtgtggtggcaggcacctgtagccccagctactttggaggctgacaggagaattgcttgaacctgggaggcagaggttgcagtgagctgagagtgtgccactgcacttcagcctggtcgacagagcaagactccgtctcaaaaaacaaaaaaaagaaacaaatacaaaaaaaaaaaaacctagtgcctaatatatgtatatatggacagcaaatcagttgtctggctacattctggactgcaattaattgtttatttacttttcttaaggtaagggttaaccgtgctatatagctgttgattttttcctttcctaatatttttctctcaacaaaagatactaaatgctgtcattcccccgttctctatggaacttgtcattggagaaaggagcaatctttatgagagtgcaaacatactaaaaagaaattcatgcctcgaatataaattgactcaaagcaaaatccctgggaaacatgtttcaaattctggaatttttacaatgattgtcttgaagtactatttatagttacaaaagtaataattccatccagcacaaaaatttgcatttgagttagtaatctggtaagcactgttaataccaaatgtcaatattcagaatttttggaattaattcaacaaacatttatgcacttactgtgtgcctggttgcttggttaagtaattatttcttcccactagtttgaaagctctattgagttcagtggcctcatccagctttctttctgtctcactagtatggtgcctgcacaatgggcacacagtaaatgtgtcgaatgaatatgtcattcaattaatcacctaagttttagagctcggcgaatggattttagatataaaggatgagaatggaaacagaaactggttgggaggctctgatgaggaatagaaacagcaattgaatatctacttacagaggaatgaccaagtagtgctgaggtggcctaagtccccaggtgctcagggatcaagtgatttaactatataaggtgagcgtgggagactgtagggggaatgaaggacaaagcaatgtggaagctcaggttactgacaagaaatagattgaagtgttgtgtcatgaatttagagcctggagggaaaaggtgacctgaatggatagtttgaagaactagaagtttcaatgaaggtaaaactgaaatgttatgaggttaaacgggtacacagcttttttttttttttttttttttttggccgtcacccatgtgcaaggcatttgaataaagtgttactgaaggaagggatgctatccagatgaccaagacatggtttctttcttcaaggtggagttgactcaccatgaaagtggtaaagagatctctggaagcacatagttgagtgggttctttctgtttgggaggatcctgcatggaagaggtgatctttgaatagggctctttggaaggaatttaatacatggagatggtggcggaggcattccaggcagagagagtagcattagcaagatgtagagtcagaaaaatgcaggctctctaaggaacaagacactgcctttggtgttagctggaaaagtgggacaagctttaatgcagtacttgaaatttgattccctgagcagtagggagtcctaaatagaagagtgccattagttgaccatgcattatgaagcttactctggcctcagtaaagggggattaagcaaaggttctaaactgtggcttcacattctcatcacctggagaaatttttaaaaccccaactcctgggctgcaccctgtatcaattagaatatctggcactggaacccacacctcagtattatttaaatccccaggtgattccaatttgcagccaggattgcaaaccaacggtttagagcaagggttagtaaactctaaaaaggggccacatagtaaatattttcagctttataggccatacattttctattgcagccattcaactttgccatcatagcagaaaagcaaccgtggacaatgttaataaaggaatgagcacggctgtgttccaataaaactttatatatataaatttgaattttatataatttttacatgccacaaatattcttgtgctttttatttttctttttccagccatttttaaatgtacaaacaaatcacagactacacaaaaggcagccagcagtatttggcccacaggtcatattttgccaaccattgatttcgagggtgaagattggacacaggtagtccaggaaagaaaacaataataatccagataagaggtaaagttaactattgtggtcagttagaagggcagagtgaaggttagtgatattgagttgatatttatagcaactcgtgttcttatgggctacttttgagcacccagaagttgtcatacaaaggacgtttgaatgaaccattgtgcggtatgtggtgtacttagtgccctttgactttgtctttttattttgcagggatttgacctatgtcgtaagactgtttctggcctaactgctagtaaaggctaatcattttggcaacacttattactgcaaattagttaagtctcttgccttccttatgtgctagccttgcctttgttaccaaataatgacctttccttgcaaagaaatgttctctttagaaaataaagtgagcttgataggagaaggtatggcaacctacattttatcacacatcactgaattaacacagaattttctatttgcattttcttcagcatttgttgcctaaagacctgccaggataaatggtgcctgctcctctaccacccccactctctgtcccctgtgaaaatgagaggctgatggttgcaacttccttcctctaaggttattttagaaaccgtaaggctgaaaaaaaaaaagtatttcccactgatatctactgtgatttaaaatcagctgtacatttccacatttgcttggttattttatttgaatatcattacagttgggtgaacaaattcacttacctattttctaacttccactcttagagaagtctgctgttttggtgtcctctaagaaatgcttactctttgcctccagcacttgggtatgtgagaaactgaagaccctgataactttccttgaatctgctgtaaatggatggagagaaagaagttcaagacaacagtcaaaagcatttatggtcatcttagttattttgcagacctaactagagagtagggggtgaaaaaatatatggaatagagccacagccttctttttctttgttttccctgccaccctcacaataatttctcacaaaagaataaggaagtattatatgtgccttatgaaggaaaagcatttgagattttgaagagtttgcctgtttccctgtatattttggggtattttttttatcactaactgtatttcacatcattgatgttataattgatttctaaaacttgaggttcatggtttaaattccagggactttttttcccttcttctcattgatcttaaatgagtattatcatcttagggacactatcaaaatatgtataatataaagtgagattgtgattgagcgctgatattgtcaagtgcttttaattaagcttctgatgctttacacattgataacacagtaaagagtccagtgtattaagttagctttccatttatttttcagaagcacttaccaggtaggggactaaatatacagcagcaggttgtactgcagccacagccttactgtgccccagaggaattcttgcatagagagtccattcttttatggaaaggaagaggtcaagaaataaggcaaagctgcaggcataatacagagattaaaatgactgatagaattgagaacacagaatggcagtagctgaaagacagtagggaaccgatccagaatcatagaggctaacagttggaagagacctttgggatcgtcttgactagtgtttctcatctttggccacacgttggaaatacccgagagcttttaaataatacacttttgtccaggccccagaagaccaattaagtcagagtcactggggattaggattgaagctttggtatattttaaagattcgctaatagttctaacctgcaacaaggattgagaagcagtggccaaatctagcgtcttcattttatataggaggtacaaagcagatacatggcccaagaccaaacagctattgtttgctaggattttaacctcaatcttcttatcttcttgcctccctcactctacattctccctgtgtgatcccatccctgtcctgctttaaattacaccaatatgctcatgagtcccaagtcctttacatgtaacttccttcttaatttctctccaaatgtctcacatcttcctcaaattccctatattcagaactgaattatccttttttcccccagtctccaaaaccagtctcagtctctagactgagtgaagggtacttctgtcagtgaagggtacttctcctgtttggttatctgtgccagcagcctgggagtcctcttcagctcttccctctctgtactcctatctaatcagttaccaagagctgtctatcctacctcccagctgttaatcagatctgtcccaccttctccccttgcccctagcttaatttaaggtgttattttttttctgagtgattttgcaacagcttctcatactgtcttcagcttcttgcctttgtcccacttgagctttatctttaacaccattaggaagctctttctgaagcacaaatttgatcattcgtcactgtattttttccattatgtgttctaatcatttagcctttcttcagcccaactaggactcccttttctctctgtctccatgtacctatattcagtctacttccttatagtctataaaagcataatctatctgtggagtcagttcttttaccgtgcttttatcaaacactgaactctcccatcagaaataacattttccttcttcaaccaaatgctgtcacattgctgactgaatttaatgggcctagcgttgcctacaccctcattttggaacccacccccgcaggaagttcccaaggtaaacatcagacctgccttagcgtcgtccacatccttggtagttaacaccttcacttactcagtgtttactggcttcttcatttcctatccctgacttcagtgtcccttattgcatcttagtaagcccttgttctctgcgtgactctcccagttcctaactagttcttcaccaacgaccccttgactctcagtcatttgttgttttcatcttgcacctcttggctctttcggcccttttgccttaggatgtagttttctaacttctactgagtgtctgtttctgtcgtgtaaaccagtcctggagccctagcgtgtattacctggaattgcactccagtctcttttggaattttttttgggcataactcttggtcgccattagaccaccattgcatttttgcctcaggcactcctgcgtgactctattctgaacctgattgtccagttcgtgagttgccttggctccttatcttttcctcctacctttctgcttcctgccagttgacaggctaactacttaggctctctaccagaaagggagcaggaaaaatgcagcatgctgaaatgcaaacccgctcttttggcttcttaccacgaagtatgatgaaggcttgcagaacatttaaattgtattgtagtataccttaaacatatcaaaccctttgaaaacttgtaggctttatcatttttaagaatccgtatgtagaaatgaagtccatagtcttattatagcttttccttataataacaccattttatttgggaaaactttaatcaacaacttagagaatgggtacagaaaggattgaattggcttggggaaccaaaagaaattaagttcgtggatgctgctaaaatttgattggttgtataacctcacattcagaatacaagctgttattacatgcggggcctctttcagaactgagctctgttgcatatctttgacaaaaattggaatgattacattgtctggaaacctgaactgttaaaaatactctcttggggtctttagttttgtttggttttgtctgaaaaggagtttaaacttgagtataagaaaaaaaaaaaaggtcatcagtgttttctgtccttggagagtggaatataaaagcaatttatgaagtgcctgtaagatgaagattacagaggttcagattctcgggaatctagaagttttaccaaacatgcatactgcctcattttttaaacccacggcagcccgcaaaaaatgcaggacgcagcatgtaattacttttaaatatcctctcatctctgtggcctgtactttgggattaatgatgaaggtaacttgaaggtaccttgtacaatttggggaaaaatatttgccatactcactgtactctggccacccttgttacaagtccatcacacaacttgtttaacatgtttactttttaaatgcttggagagctaacaggtggttgcatgactgagatgtttgttttaacaggctaaaaactgggaggtaatttagacatacactatgatgcaataggaaaatacctaattattccatttttggctcagcttttcgtttcagttaaaactgttgatagcaaggctcgacaggttttgtagagtagttctcttaacattgcctacataggagaaactggctcactagtaataatggccgtgttttagttacttgtataagaaacttacttggctttagtgctagaacttagtaaaggatttcttctcagagcttctgtcatcagcagttacagtgtgaatacagacggctctgaaagccccatatctatttcagcatgctctagaaagccacttggaatattttttgcctgtacatagaagcactgaggaaatatcctgaaaacaagacagctaattgttattatgcttggtacgttcatcccaatgtttcagtatataggttatgattggctcttggaactgtccattgagcaaatagaaggagccaggaattttgcaggatagttagttgttcatgtggtttggagttaagggactactgccggaagtagacatagtcagggatagagtttctagatcggggtggttacctttctctataaagggccagatagtaaatactttaggatttgtggctgtatttcagtaaaactttatttaaaaaaaaaaaacaacaggcagtgggtcagattggctatggggccatagtttgccaacccctgttctggattccagaagatactccactggattgtgtgactgatctcagagggaagaatagcagtggttttcagttaactgggcagatacctataaccttcaatatgccaagacttcacagtatttgtatataataaatttgttgtcagaaaaggcattgtttctttactggttctttggggctaatatgaatagtgttacttagttatactccatttctttcccaaaatcgagataattaggataaaaagcacatataagtgttagctatcaaagtaaaatcaaaacctacattaagtcacacaaaacaacttctgaatattccttttccacctgccaatgcaagctggtcgctcagccatttctgataagcctcagttcttggggcatctcctaagtttaatactgatatgctacctattttattttatctagcataatttcctttctaaaaatattttccccagtgttttatatcaagactcctaacaaaggaagtgttagcatccgtcatttttcttctgattgaagtataagccaagaactgtttcaccgaataagtgggtatatgggaagaaaagaaaaaattataagctaatgaaattttgatgggcaaatgacctgttcaaagcagattccaaggctcacagagctaacatttcattagccacaggaactgtttccaatcatcttactgatacatctttgctctccaggggaagggagtgttaaattactttagaatttgatggtcagaagcactgctcagaggcggagagaggaggcaggaattttggctgatctgtaggagaggacttttcagtgggtgtcagaaggtagcaacaaggccaagtgatttgaaccactgccactggaattgtgacttcaaagacagctctgaaatagggaaactgatctacaaggaaacgatgagtgtgtacaaatgattttatttacaaggtccttattaatatcaggtccaactgcttaactaaggagatgcagaagattatgtagagctaggcgggggtatgcggcattggggaggtatgatagctgtgtccttgaggacactggaggaggtagaagatacttccctagaacacgggataccagtcaaggattcatcacaagtgaagacagaagcagtctcctggcagttggaataacatcagaatagaaacagaagcaagacaggggcagtgttagggacaaacagaccacctgtgtcacagaattttaagatgtggtcgtgggctaacctatgatggacaagaaataaattatattattgccaactgggaaaatgttcaatatctgttctaaaaacattgattacctctgtaaatttagaaacattctaacctttaaatagaagagagaaattcttaagaattaccaacttaagctgagatcccttctctcattcactcttgctgaggggacaaattgatgcaatatttgtgaggaggaggcagtttgactttacctgttaaggtaataaatgtgtgtactgtctgatcctgaaactggacttccataatttattatttttaaatacagtcaggctggcaaagatgtttgtgcaaagaatatgattatattaaaaaattgaaatgaattacagaaaagtttgcatttgtaaagttttcagatgtcaaaaactttgaaaaactccctttagggaattgctgatctgtatgtacaaccaaggaagttttgcgaggacaaactgtgtagtggaaaaagtaaatttccgaacaatatatagtcttccttccataactgcaagttctacatctgcagattcaacaaacagggcatcaaaaatatttagaaaaataaaaaataacagccaggcttggtgtctcacgcctgtaatcccagctaggaggctgaggcaaaaggatcacttgggcccaggagcccaaggctgcagtgagcgatgattgtgccactgtactgcagcctgggccacagggtgagatcctgtccctaagtaataataacaagagtacaatttaaaataatacacataaaaatacagtgtaacaactatttacatagtatttatattgtattagatattctaagcaatctggagatgacttaaagcatacgggaggatgtgtataggttatatgcgaattctgcactatttgacataaggaacttgagcatcagcggattttggtatctacggggagtactaagggacagctgtacatagaatgacctcttttctttgaaagtagtaatcaatgtttgtgtttgtgtgtgtgcgtagaagatttggacccatacacaaattgcttatggtggttatggggcagggatcacagtggatgaggagaaagccactttttttttttttttttttgagatggagtctcgctttttcgcccaggctggagctgcagtgcagtggcactatctcggctcactgcaagctccgcctcccgggttcacgccattctcctgcctcagcctcccaagtagctgggactacaggcacccgccaccgtgcccggctaattttttgtgtttttagtagagacggggttttaccgtgttagccaggatggtctcgatctcctgaccttgtgatccgcccacttcggcctcccagagtgctgggattacaggcgtgagccaccgtgcccggccaaaaaagccacttttatattaactagttggctgtaataagagaacctcatacttcttggttgtcacagatacactaaggagcaggggatggagaggggactcatgtaatgcctgggttcagctcaagaacacgtcattagaaatgaaaagagcgttctctttcttttttctttctttcttttgttttgttttgtttattgaaatggagtctccctctgttgcccaggctggagtgcagtggtacaatcttggctcactgcaacctctgcctcccaggttcaagtaattctcctgcctcagcttcctgagtagctcagattacaggtgtccaccaccacacccagctaatttttttttgtatttttagtagagactgggtttctccattttggccaagctggtctcgaactcctggcctcaagtgatatacctgcctcggcctcccaaaatgctgggattacaagcatgagccaccatgctcggccaaaagagccttctcttcataactaatctatgaggcttatgtgtcatcattacagatattaagagttatatgcctgtataactcatacattcatttattcattaacttagccagtatttattgagtgcctgctgtgtgtaaaacaccatgcagggtacctaggctatatagcagtgacacagtaaaggtatcctcatagctgcaagctccagcagacagacccaagctgtaaccaggaagcctgaaggaggtgtatcgtttaaatgaatgcatgtctgtgcccaattctgagtaacagcagttggtattacaatgaaatcggaagtgccctgtgtattaaattttctttcgttttcagtgttttcttcattttagtctgttatgtattttcaaatacagtttttgatgatgattagtgttttagttatgaaatcttctaggaagaggtcacctggttgctctgtgataatgacccacataaccataaagtgactttggtttttagttgcacccctgtgtcttctcagcctccacaaaggaagaatctcttaaaaaaaaaaaaaaaaaactttatgtatgtagagatatatacacacatgtatattttttatctgctgtcaactcaattgtttgtatgttggttttttgttttttttgttttttttcacagaaaaagcaaaggacaaaagatctttctcgggtgtttcattcttacagtccatatgatcacaaggtaagagaagcatgttaatagcatattaagtattaaagtctttccgaatgtatagtacaattttcaccaacatatggtgattctgaaatacacttaccaattacatttatatttcaatttaaattttttagctctttatcccttttaaagaaaacagaaatgttatatttctgaactataataattatattttattcacattgaaatctagttacatattggcactgaaatctcaaagacagtgaaaagacacattttggggtgtattttggttggttggtttttgttttttctttccaaacactgtactggaggaacttgggttttggattggtaaagataattgaaatgctgactgcaaaacttgattcttcattcctcctgatagaaagttatttttctaaatgaaaatcctaataaaaattagtacatagcatcatgtctgaaatatctactgcctggagctttgctacacagaaaatgaccaaataacgtgacgacccacatgtacccatcccacagcttcatagattcatagtccgtctgtgtcatttataccctaccttctccatccctcatgtttgaaaaattcctagacatcttttcacttgtaagtattttacaatatatttgtaaaagataagcactcttttaaaaagaaaaaatatgtagccatttttaagaaaatgcttaactccacatcttcatggggaaatagattacaaggtttcagagacttgtgcaaaacttctaaaccatgtaggattccagtaaatctgttaattcgaggtgatttcagaagcaaacaaaaaatttgcacagttgaaatgctaatataaacttaaatctttatctatgaatttatagggagacatgtggtagggattttttaactagccaaagtaagtagtgtgaaaactactttcctcagttgaaaatacagagatgtctggattcaggagggaaaaattgtgccagttcatagaagttgaaagaatttgaaacactagcttctagtgtttctatagtgaccaattgacttaagcaccaaaaactcgtaaaagagatgtttatgcttcatgtgaccatggtgatatgtaatactaaaacttatatcattccaagttacatttttcaagctaaatcagtcacattgcagaatgcagcaatttgtttgaaagagattgagagagccaatagggtctgacaatgcagacagaaggagcaggctgataagtaatacaacagcaaaaggaatgagattggccagatttctgaaggtagtgttgcatttttttttagatgaagccacttaatgaacataagtgcagcagtggctaaagttaacatttaacaacaacaacaaaaaaggcgatggcaaatcagaggttttgcctggcttgtctaaatttcgcccacttgtaacatttttaaattcgcagttaagggaaattccattcttcttttattagaactcttaatggaacctagccatttgcagcttctaccggcttcctcctcatatcctttgtggcattgtatcaaagtcacctcagattattttggcttcccttcattcctctacaacttagtcatcaggcagtgaggaattgaatctaaatgcttgatggagttccttttgatctttaagattggtaataaattattgtaaatagctagactgcttgatgagtgccttttgaagctcctaagttttggtctgttgccattctgttttattctggatgtacagtagtgaaggaaaatggaaaagttttattccaggcagctcccggcctccttagtagcctttacctacttttctaagttccatccaggcaaatctatccatgttacttttaatattgtctctcactgattggaatgtccacaaagactagaaccatagggataaagtaacatgcactattttcccaatctgagaatgttgctatttttccccgcatgaattaatagagggttgtgtttaaagttattttgtcatttgaattacccacttatattcaagcaaattggttttctaggcagataggttttagtgtaaagtgttttacaaggtgtggttaaagttggtttagacatctcatgctcagtgagatttctggcgtgatccttatgaaaatatatacatatattgtcagtgaaagcttttatgaaatacaacatcagttgtttggggtttgctttaatgcaggctggtgtattggcttatgccggtaatcccagcactctgggagtctgaagctggaggatcacttgagcgcaggagtttgagaccagcctgagcaacattgtgaaactctgtctctatttaaaaaaaataaaaattaaaaattagccaggcatggtattgcacacctgtagtcctagctaccggggacaggtttaggcaggaggatcacttgagccccggatttcaagttactgtgagctatgactgcaccattttacttcagcctgggcaacagagcaagaccccgtctctaaaagaacatttttttttaaaataatttcaaagagcagagtggatagggtacaataaaataagattgcccatgtgttggtgattatcaaaactaaatgatgtttggggggtgttcattattttattctgcatttttctatatgattgaaatgtttcataatagaaagatacaaaaagtaaaataaactatggtctgctcctgggagtgaatgttgtgacggtttgcctctctagctatattcattttaatgttcattttccccttgacgtaagtttatgccaaaaaaagaatagtcagcattttagtggattcatcatgctgagtaaactcagaaatgcaactcctattctaaacttggcaaaatttccttcgggtttcatcccaaattatagtgggtcacttaaatgacagctttgcctactagaaactgttaaaacagttgtaattacaaagggtagttagtgcaaccattttgttctcagtgagtcagttgtatttgctcttctttccttcccccaaccaagattgctcctgcctgaccccagacacaggaaagtcaccaggttaaacaaacgtgttgtttgagtgagcccaggtgcatttcttaatcataccccaaagccattgtttaggttgtaaatggtcagttggttttctcttaaatgctgttgcaaaaagcaaataaagctaggagcaaaatgtgtacccagaataaggcttagaaaatactttatttcttgcactaagaaatgttgcttgagactagaagaatttcatttttgtttgttgcctctggttgcatgtccatttcttaaattgttttcaggaattcttataataaataaagactcatacaaaagggcttgacaaaagttaactcccatttatctgtccttctaaaagagaacattagtaaaggtaatccaaagtagcagataatctggttatattttatgcattatgttgtttcctttgtcattttaataaacaggtaatgaacataacttgtattatagtttctgaaacaccatactaagtaccaaggagggttacagggccagagagcttccaggtcacaaaaagtccaacctggagttgatttttttttttcttttgataaatcacgggtaagttagagtaggctataattagaacacttttattaaaaccatgcaaattagcatgtgctgtttgtccttggcctgaagaagacatttctctgcacataaaaatgttttcctgtttctttctctgttttttgttagattttatcagaattatgtgtttagggggaaatctaggtttattagccaaacacacatgtttataatctgctattgtgaaaagttattctaaaaaattgaaatgcttggaaggaaaaagttctatttacatctacagtggtttttaacatctgcaaacacagttaatctgcatgaattagtgcacactccaccactaaaagtgagtctttaacaggtagtcactatttttctgtattttgtgaagtgggcttcttgctttcttttagtggcttgttatattagtaatttttctgcatatacatgtcagtggacacacttgagaagaaacattgtcatctagctcctgtgttggtgaactgggcttttctttttcttttgataactatcattatttaattacttttctacatatatatgcatgtatcaactgaactagaagcaaattcatatatgtcattaaacatgtatgtatttatgcacttgataagttagcctatgagtagaaagaaaactaacattagtgctttactcaaccagagcatcttttgtgcagcaatcccacctttttaaaacagctcagaacctctaaaaaagcctatttgggcccagattgttaaaattattgtgtaattctcctcacccacctcattacttcttcggtccctcatccacaaacagttcaatctttttttaaaacaaatcagttcaaactgatgcctggtttcccaaaacacagtcaacactaatagcaggtaaaagagggtagttattgcttcaaaaagtcagagctctagtaagaagtgacagcatcctaaatgaaagcaaggacgggccataaaaactataagtcattaacagaggaactccgaaagtgcagctgcccaagaccacttaatttggacccaaatacccagatatccctatatatttcagtagccttagggtaaaataattgggatcagtttacattcggaaacagatattttgttttaaaatagaatttttagaaactttggtattttagaaataacttttacttaccttgaaaagtctcaggaactgctgcttcttaataaggtagggtaaatgaagtattactacagagagtggttgaataaaagaaataataggctaaacatggtggctcatgcctataatctcagcactttgggaggccgaggcagtaggaccacttgaggccaggagtttgagaccagcctgggcacatagcaagaacccatctctacaaaaaaacggggtttttttgtttttgtttttgtttttgagatggagtttcactcttgtcatccaggctgcagagcagtggcttgatctcagctcaccgcaacctctgccttccgggttcaagcaattctcctgcctcagcctacccggctaactttttgtatttttagtagagatggggtttcaccatgttggccaggccggtctcgaactcctgacctcaggtgatccacccgcctcagcctcccaaagtgctggaattacaggcatgagccaccgtgcctggccaaaaaatgttttaaaaagaaaattagccaggtgtggtgctgtgtgcctgtagtcccaggtacttgagaggctgatgcaggaggatctcttgagcccaggcagtccaggctgcagtgagccataattgcaccactgctctccagcctgggcaacagagcaagagcccatatataaaagaaaaagaaaaaaaaaagctccggccgggcgcagtggctcacgcctgtaatcccagcactttgagaggccgaggcgggcagatcacgaggtccagagagcgagaccatcctggctaacgcagtgaaaccccgtctctactaaaaacagaaaaaattagccgggcgtggtggccggcgcctgtagtccccgctactcgggaggctgaggcaggagaatggcgtgaacctgggaggcggagcttgcagtgagccgagatctcgccactgcactctggcctgggcaacagagcaagactctgtctcaaaaaaaaaaaaaaaaaaaagcagcaaaagagtggttgaataagtgttgatagttgggtaagggaccaaaaaaaatgtgtttgagataaaagatgaggaaagtagaatcattatcaccccaaattatttacttaattagatgctataaaatattagtctttgagatttttattatatttttgtcttaaagaaagactcctctaagctggatgtggtggctcatccctgtaatcccagtaatttgggagactgtggtgggagaatcatttgagcctaggagtttgagaccagcctggacaacgtaaggagactcctgtctctacaaaagatttaaaaattagccaggtgtggtggcatgtgcctgtgtttccagctactcgggaggctgaaacaagaggatcagatggcttaagtccaggagttcgaggctgcagtgagttgtgatcgcaccactgcactctagcctcaatgacagagcaagacattgtctcaaaaaaagaaaaaagaaaagaaaagataaaagacggcactaggcataacttgagtgggataattttaagtagtgtatcaggacaatgaatttttaattgtagtattaaatatacaaaaaatattgatatatatttcaataatcacacttcctatgactaccttaagaactgttgttaattcatatctgctagtgtacagggaattcatatctactagtgtacagtaaaatattatataataaaaatgtaaaatattttctacagctttgggcagaggcatacagcaaaaatctatatcaaaagccttgggttataccaccattccttctttcctcaaagactaggcatctctgtgacatcaagtttcttaaatatggaaaagggacagtttcatttcagatgtcacttactgatttacatttctcttttaatcagatttgtctagtgatttaagattacaaaagtcacttcacccagctctttatgtttgaagaataatggccatttgactcaatcctgagagccacggtattgtcaagccttcattatctcctgtgctttgaataacataatgtagcaacagagtgctttgagttgtttttctagagagagagagatgtgggtttggattcttgcctgctggccctgttgagctttgagctatctgctgtctggaaatagcaaattcagtttttaatggatccggcactctatgatagccaggttttcatggcacatgcagataaagaaacaagttattgatttggcatgtttatgccatgcttaaaacagttctctgcagcagattgtccaaagccatttgtgcacttaactctatttctcatctttggcaaaaataaaaaagtgtttaaaaagtaattttagggatgttgttaaatatcaggaacaattgaataaatgtctagttgatgagattccctattgttttattgatacatgtccttatacgaaaaccatgctcagggtatgcccttgaaacacagggaagtcagtacctcaataagtgttaaatccatttcctcatcctcattctaaagccaaaggaatgacccagccttgaaataaggacatactgaagagctctttcggtgcaaaatctgtgcttttgtttattaaagtatcttccctctcaaagtgaccatagagttgttaccaaagatgcagacatagctgagctgtttcctgcttcagcagagggtaaccctagccattccttgcatcctcatcaatgccaacctaatccaaaggcatttttctcatttttaaccctcgtcagcttgtgatttgagtagcagattatgtttaacaattatacctatacattttggcctaattttgatatcatacctgtatattttttcctttgcctttttaagatggcattattctaaaaattaagcatgattttttacatatcagtttaacttattttcttactgtaactgcagagatgggtagaatcgaggtatttacaaatggcagaaattcggtgcgcttaagatgatatatccagagacccatagatgccagaatttttctcagccagttaccctgaggattgacaaagagattgaaatctgagtagacttttattatgatgattaatattgtaataaagcaaccatttaaagcataccatgtaaccagcactattctcaaagctttacatatgcacataactcatttatctttataccaacattctaaggtgagtatgctagtaaattacagagcagtatacgtggagatgggaaaatggcagcagggcaggagagaagagataggatgccatcctgttcagctgatggcatttgtgactgccttttatggacaggtggggtcacagtgcagagattggaaagtttcctaggtcatcatttaagaataccctacttagcagcatattctcgcccctgcacctccccatccaagaactcccaggaatatcagtaatagggaaaaggcaaagttcatgatgaaatcctttgctaacattcagtataaaagtattaataaattaatcaacaggtctacatagatatggcagttactgtattttcaaattatttaccacgcctaaaagtatctgtgtttcaactgtcattggttatatacttcctctatgaaattcactagtatgaggaagaaactagcaaagggacaaagaggaatgtcactgtgccaagagccagagtacttcccctccatcccggggctggtcacctcctgttctgtcaccagttgccctgggtatgtccctggttatcagtctttgcacccagttaagatgtatccccattctctttctctcttgacgatgtcagagtcttgatacataccctgccccaacagctctgttttttttcctgtatctccccaccagtgtgtgcttaccaacctttcttatccccatccagaggacaaacttggctagcacaccatctacttggtatataagtcctgttacatgccagagttagcaaataaaaataagggacacccccttaaattcaaatttcagataaattgtttttttttttttttagaatgtgccatgcaatatgtgggacatatttatactaaaaatccattcattgcagagcacagttggttctcgcctgtaatcccagcattttgagaggtcagggtgggcggatctgttgaacccaggagtttgagaccaccttgggcaacatggcaaaatcctatctctaccaaaaaaaaactacaaaaatcagctgggtgtggtggtgggcgcctgtagctacttgggagcctaaggtgggaggattgcttaaccccaggagctggtggttgtagtgagctgtgattgcaccactgcactccagcctgggcaacagagagagacccctgtctcaaaaaaatttattcattatttatctgaaatttgtatttagctgtgtgccctgtttttaactggaaaccctagttgcgtgagcattatacattccacttgggcaaattgaggctcgaaagacaaacaacagcacccacaatggaatgaaatacaaaatgattgtaaaacttccccttggtttactacaaaggacctgaggaagcttcttcctattcctaatcctatccttgtatataatgcacctggtctccccatcaaaggctaacacgtgtgtcagctacagtttttcaaacttttattcgttcatttaagaagaaaaagttttaatttgcctttggttctctcaaatatgctgacaaagttttaacctggggaacttgtttggaaaattgttcagcaggcacaaagaaaattaaatttaaaagtgtccatattatattttccaggaagaagaattttccaatctctccctaccccccagaaggttcactttgtttctccgtgatacattttatcataaaatataattaatgacttctttgtagctgaagttgtttatattgagacatactgagaaacattaatgctgctgatgctttaaacaaggaatataggcatccactagagaagtgaggaggccgttactgctttttcctcctttttctgcgctgctcacatttgaagactgtcaagggtcctgtgattggtagtttgggctgatgctgtttgcagactgggctccccaggtctgcctttgtcttcctcagcaatatttttaacagcagctaaaaggccactctcagatgattaccaacctccaacacagattcagggttgcacaaaaccatttccagatttctgtttacaaagaatagtgagatgaaagtatttccatgggccaataatttattttctctggggttttcgtgtaagatttagaagacatgattacagttagcatttattgcacttttaaacgtatacgttaacactcttgaaattgagaaactagagaattttagcatctggaaagaaagtaagtcaaccagcttctcctaatgattgttaatattttccattattcaacactctgcctttgggtacctttgagaattccagaggcattttaaatgcacatgtctcaaataaaaataaaggaattttaaagactcaactttgtttgaatttagctatcgttatgtggtagacacatgggtaagaaaggagactattccacttttaattacgttgaagtataacaataatccagctacaatgcttaaaacagaaatctcgaattcagtttaggctttgcgggtggcagtggagggtgtctttttaaagctgctttttttatctttattatttactttttaattcttatggacactttcatttctaacttaaaagtttcactggatatagctgatgtttttaggatttgcctcactccctctccccttcgtcccgaccatcttcccctcctctgctcctttcctcccctcccttcctctttcttcctgttgagaacttcatttccctggtttactttctgttagaaagtatgaatcaatgaaatttgctaatacttgccttagagggttgtcataaggattcaatggaaagcatctagaatagcatctagcacacagtaagtgctcaataaatgactatgattcttatagtaaaatcatactttctaggatgtcagctctgccactagtactcaccacatggtatatgttcaataaataactggttattttaatgtgaagttacaatttttagaatttaagtagggattttgtctattttgttcaatgtttcctcaacacccaaagcagttcttgacatgtgggaggtgctctgtaaatatctgttgattggagaaattaataggttttcgcttctaaaacctcagcagggtgtgtgtagaaatcttaattcttcctaacagttgcagtggtcatgggttttgttgctttcagtttctccttccatgtttgttgatgatcttcttataccattctttatacttatattttcttagtatcccacctacttttgcatttccccacacaatttcttaggggttcttgctttttttcctctgttgtgagcttgggctcttcaacatggtgcatttgggtacctgtttcccttctattggagacagtaaggtgaaaactcagtactaggttcaatccaaggttcatccattctcccttgtaagagtcttacactatagagctggaaaggcccttagagctcatggagtcccaccgccctcctccatccctcctctgttgttcagggaagagaggcttttttgtcctgttgatttaatactcatccttcaagacccagtttaatttcaccttctttgcctcttttctgatagacacagaggattgctctcacctcttgctaccactctgacttgtatatacctttattatttgacattgtgtgctcatataattcacttccatttaacaaacatttgaggtttttcctaggaggcaggcagaataactagagtaagatgcttacaatccattggggcaggggccccgtctccccgaagaccttgaattatggactagaattgaatgtgttatatatatgaagtgtattttaccattctttgaatctggatactataactgtacaaggcacttacccatcatcccacagcaaattcagggctaaaatccagtcttttaattcccagttttgtgctctgtctttgcaaaaattaatacagttggaatgttccagtagtaataaccacagctgtgggagaatgtcctaagtaagtttatgcttggttttaattataaattaagtaatacatgcacttaataccctattcaaggaaattctccctttgtaaccttatcctagagacccctgttttcttctccagaggcaaccactgttgctggttttgtatatatgcttctggagttattttatgcatacacaaatacataccttcatgtaaatgtcagtatgtgtttttatatagatatgtgctttttaaaaatttaaatattatcatactagaaagtcttctgtttcttttttcactttacagtatatcttggagataatttcaaacagtacctaaagagctgcctcattcttttttaaaaaaatagctgtatatattatataccagttattcaccatatttatttaactagactcttactggtggatctttgagtggcatctgatgtttttggtcttacaaacagtgctgtgcagtgtataatctcacaaacatgtcatcttatcaatgtataactgtcacctgtaggataaattcctagaagtgaatatctagatattagatgtgtacatattaaatcatgatagatattggccgagacccactcagcaagatgttccagtgtacatgcccatcaacaatgtaagacagcgcttgtttccccacacccctgctatacaccatgtcaactaacttttaaaatctttccctattagggaaacaaagataacttcttatagttttaatttatatttctcttatgaatggtgtcactcagttattagaaatagccacaaaaacagagtgatttggtctttgattttaaacttttaaaatccacgttttagaatttctgactcttccacttgcaagctagatgatgtcggcaagatacttaagttttctttgccttggttttctcctctgtaaaatgagaatactgcgttccatagactctaagccattattaagtcttattaattgtaagactcaccattaattcacataacgctaaggaaaaaatgcccattacaatggtgtcttaaattgagaaatgctaaaatataaaataatgtgcatcttagaatcgatgaaatttgctaatacttgccttagaagtttgtcatagggattaaatgggaagcatctagaatagcatctagcacacagtaagtgctcaataaatgactattcttgcagtaaagttatagtttctagaatgtcagctgtaccactagtactcaccacatggtatatgttcaataaatatctggttattttaatgtgaaattgtagttattagaatgtaagtagggattttgtctattttgttcaatgttgtttttttccccaacaccaaagcagttcttgacatgtgggaggtgctctgtaaatatctgttgattgaaggaattaatatgtttcctcttctaaaacttcagcaaagtgtgtatagagatcttaattcttcctaacagctgcagtggtcgtgggttttggggttacgtggtctttacctgtgccgtcctgtcccccatacacacaaaacctctagaccttatcacaaaccacctgatttcattttaaaaataactaagccctatggagctcagtttaaacatttaaaaacctttattaataaaaccaaaaactttgaattgaaagagttcttcagaatattgttgatattttatccaaacaagagtcaaaatgtttttacgtaatctgtacaggatcctaataagaatttggcaagatttatgtaagtcctacattttagaatttgcattttaaaatatattacactgtctgtacaaatcacgtggtcttggactattgttattcagtatgtatttccactacagaaagtataaagaaataaagccttctttttgaagtaccacattttgttttgttttttaatggaacatgagctcataggagttttttcgtttttctcagctataagagtatgggctttaagaaagtctttattacttcacagagtctatatcctttatgcttttctctttgaatttcagacttttctcacattagactacttggctttatagactttgctttggttagtttggttacagatatctgaatatttccatattgcataggcctctctgttttcaacctttgagaatgtaggatgtaatactgatttgttactgtattttatttatttatttatttatttatttatttagagacaagatcgcacactgttgtccaggctagagtacagtgccacaatgatatagctcactgcagcctcgaactcctgggttcaagcaatccccccacatcagccttctgagtagctaggatacaggcacacactaccatccccagttaggtttttttttttttttttttttggtagggggagggtctcactatgttgcccaggctggtctcaaactactggcttttagcgatcctcccaccttggcccttcaaaataaaaaggattacaggcatgagccacctctcccagctggatttaattgctttaaaaagaggagataggaaatacattatgtgtttttatgtacatttgtatgtgtatatatatgtgtatgtatagatgtacatgctgtgtaaaatatgaactctggctgatatcaagactagctgagatgacttaattctccacagatagcccaggttttctggctaatattattttccccaccttataagtgtctttaaaactctgaacagtggctgggcacggcattgggatacctgtaatcccaacactttgagaggctgaggcaggtgggtcacttgaggccaggagttggagacccgcctggccaacatggtgaaaccccatctctacaaaaaatagaaaaattagccaggtgtggtggtgtgtgcctgtagtcccagctactcaggaggctgaggtggaaggatcacttgagcctgggggagcggaggttacagtaagccaagaacgcagcactgcactccagcctgggcaacagagcgaaactccatctcaaaacaaaacaaaacaaaaaaacaggaaaactctgaaggtctttgagtgtactacaaattaagtgtggatattggtgccttaagtttagttgatagggcttgagtcagagtcttgttaaaaactcaacctgtcttttacagtacaacctggtcctgctccggggccctgtgttcaggaactgaagcattcttgttcttgcataagcatctccacatgggtgaagttcactcccacatgttgtaaaagtccacttttatcacagacctatttttgatgtgtttatatgactttacagtcactaacccttcacttacttgaagaagataaggtccaaacctgaaagtttgctctgaaaatttgaggcaaacctattatctccttctgaaatactatcacagtctgcactagggcttagaacaacagatttaaattgctacccagctatcaccaaattagtgccccccaaaggtcagcagctgcaaacacttccgtcttaggaatacctttctaggactgattagtgattcagctttctctttttgtacttgttgctttaaacattcactagttctcacttcagttgtaacatgcacatgttctcattttaaacaaagccaaatggtttttaaatccatggatgaaaaatcattttcaaatcgagtattcatgataaattttgaatatgtaatagatatgtacttaaaacttcactcaaggattgcaaaatacttatctaaacataggtgtttgtgtgtattttgtaattttcaggacatagtttgataatggaatagtgcttgttagcatgtatctctatcagggtttcttctggcttctctggcttcctccttcacatttctcttcatttgtgtctctctgatgttgctgctgcccattcacagtagagtcctgttccttggtaggccatggctgctcagatgcatcccagacatacatgcaacagactcgggggcatttccttttgaatggtaccccagccccactatatccaggactgaattcatcactgtatttattacctcgatgaatattacatctctccagctactgaaccaaaaccagaatgtcatcctagactcctcccactccctttacccactacttttgattgttctcattttcccagatctatacctgtaatttatctgggtttgacctcgttctctttgtggcaatggcaatggccacaaagagaacgaggtcaaatctagataaattataggttcacttggtggcagttttctcctgaatttcctcatctctccccaactgattttcctatttccattctcactggcttctcccaaaacccaatccattctctcactgctttgatggggatacttataaaatgccatccagactgttgatcccctgtgtaaaattcttatgtagccctcagtcacttacaggatacagccccaacatgatccataaggcccttcctggctagtagctccttaccttttacctcatattccatgctttccccagtatgctacactctctgtggtctcagtgtctactcataagttgttttttgtttctagaagccaccgtcacttcattcatctgtttcatctttcccaatatgatattgtttggctgtgtccccatccaaaatctcatcttgaattataatccacataacccccacgtgtcaagggagaagccaggtggaggtgattgaatcatgggggcaatttcccctgtgctattctcatgacagtgagtgagttctcatgagatctgatggttttataagtgtttggtagttcctcctgcattcattctccttcctagcgtcatgtgaagaaggtgccttgcttcccctttgtcttctgccatgatcataagttccctgaggcctccccagccataaggaactgtgagtcaattgaacttctttccttagtcgggcacagtggctcacacctataatcccagcactttgggaggccaaggcgggtggatcacctgaggtcgggagttcgagaccagcctgaccaacatggagaaaccccgtctctactaaaaatacaaaattagccgggcatggtggtgcttgcctgtaatcccagctactcgggaggctgaggcaggagaatcgcttgaacccggcgggggtggggcggaggttgctgtgagccaagattgcgccattgcactccagcctgggcaacaagagtgaaactccatctcaaaaaaacaaacaaacaaacaaaaaacctctttataaattacccagtctcgggcagttctttatagcagtgtgagaacggactaatacaccatcagaaatcagagctgctgcttccttctaggagctctcctgtcttcctctactctcagctcctctggggagttaggtgtccctttcatgcgctcccacaatctctgtgcttccccgacctcattgtgtgtctcccctagataactgaagtttttgagggcagggcttgtgttaactaaagtctatatgcagctctggaggactagtacagtggctgacacataacagatgttcaatcaaagttcatttaaagaaagagggtgatgttttccaaggtcagagtttctcttacacaggtgctctagtatatgtttctttcacacatcttttgtattccatgtacccacaggaaattaaaatcatgtgtggacagcagtgtttccacagtatttccatatttcatatttaaaatcgatctttctattcccaattatgttacatttaagtgaaattaaggggaatgatttaatagcagtctgttctttcctctgtagttatataaagagagtaaagctccttataatggagcgatgccccctccattccagagattctcaaacttgatggcacattagaatcagctggggtgctttaagatatactgtgcttgggtcctacacatatacacaatgtgtgtgttgtgttgcttccaagtgttctagagaataagttatgctcattggctttattatcgttacccattcccatctcagctgagcactcaaccttgatgcttttatgcatctgcagtcagctcattttcccgcttctggctcttctgtaaacttcaccacttgcctgagtcctcttcccttttcctttgcttgtactgcagctcccacccctcatgaatcagtttctatttgtattgctcaaattgcagacgtgagcttgccattttgaatttctagttttacctatgttatgcttaatctgataacctgacatttccctaaggatattaagtagcttattagatattttatttaggactatgttatgaataacccaactcatgctggtttaaacaaagagatcatttatatttataatttattggcttccttaattgaactgtcaaggtagtttttgcattaagcaaagtttgattcaggactcaagtggtatcaccagcagccttttcttggcagtctttgatatattgactattttcaggcttacctccttagaggtagcaaagtggctgccccagctccacaccacactcttcttactttcaaatacgaagaagagagatggcatctgtcctggaatagccaaccaaagtttcatcaaacctggtcgatttgggttatgtacatttctcagaattgggccagggtgttaatgtgttgattgacttaagccaatcaagatttttaccccaggaactgagggtgcaactaacccaagcattgactgggatgtgaaggatgaagcagtggcgaatgcccctaggagagaagaatgaatacaggaagggcaaatagcaaatattcacaataatgcaagttatcatattatctgtcaaaaagtgttccatcaacatttgagtaatatatatttaattcaaaatgtcatacatgtcgatatagaggaattgtttgattgaaccatgttggaccttgttgaatttctagttaagtgaatgccagaaaaaggtgtaatatgttttatttttataaacaatgtaaaaaggccaggcacagtgtctcacacctgtaatcccaatactttgggaggccgaggtcagcagatcatttgaggtcaagagttcaagaccagcctggccaacatgttgaaaccctgtctctactaaaaatacaaaaattagctgggtgtcctggtgggtgcctgtaatcccagctacttgagaggctgagacaggagaatcacttgaacctggaaggcggaggttgcagtgagcctagattgcgccactgtactccagcctgggtgacagagtgagactctatctcaggaataaaaggaagggagggagagagggaggaaagaggaaagaacttgtgtcactgaatttatgagtttaagcttttttgcaaatgttaaaactggctttactaaatattagaatggtacagtagagtctgaagactgacttcaaattattgctttgccatttaactacctggatgaccctgaataagttatttattttctttgatcactggttttgttttctgctagatgcagatgtaagtaatacatctcaaagtttgtgagtatccagtgagataatatgtgttaaagcataaacacacggtccctgacttacaatggtccgacttacaagttttcttttgactttacgattgtgggaaagcaatacatgttcagtggaaactgtacttggagttttaatatgaccatcctgtttttactctcagtacacaattcaataaattacatgagatacttaacactttactatagtataggctttgtgttagatggttttgcccaactgggctaacaaaagtgttctgagcatgtttaaggtaggctaggctaggctacgatgttcagtaggttagttatattaaatgcattttcaacttaaaatattttcaacttatgaatgggtttgtcaggatgtaaccacatcatatgttgagaatcatctgtaatgaaaagtcagagttaattgttacattcaattttactacctcattgggttgactttacctggccaaagaaaatatcatcataattaaaatgtaattctattttgctaacacactgcctttgttacttaaaacctcttttgttttcatgttttattttggctgaagacgcctcagaatggcctatattagaaatatataacaagatattttaggataaaataagaagagatgtgctggtcactcacaaaatctgagtcactgccacaattaagaataaaagcttgggtttctgggaagcaaaggcaaaaagacaaacacagctaaatgcacagctctcattttgtaatagcagaaagtatatcattcaagaggaatgacaaccttgcttagggcaaatctctaaatagaatatattccatcaatctttctgttaaggggtgttgaacagcataatggaccattgtaccataaaacttacaagacccagtaagatttgaaactattttggacagttttcaatggaggtgcagtctgtcctgggtttgaatctgcctttcactcactgtgcaacactggtaatttatttagcttctctgaggctcagcttttttgtctctaaaatgggaataaaaacaatagtacctccccaatggggttattataaggattaaacaagagaatgtatgttgaagagattggcacagtgctctgaatgtagtaagcacttaataaatgttagttgttaaataataattataaattctatccataagtatttattactgtaactagatatctggaaaaaaacatattagcagtgagataattttattgtgattaaagaaagcatgtgattgaatactgaaaaatatgaccagggtccttcaactagataaaaaagaaacctaaccagctggaaatctaaaggagaaaaatgaaaatattgttctggttctctctgagccaattaaaattttctgttgtttttaaaacaagtccattttggactagaactgaaagtctccaacctactgtgagtagaaaaaaagcctatggtaagaaggctcaaaaagctaactgacatatgtgaacccagggtagacctcataatttacaatttcccaacagttcctgcaccttagaattttgcttcgatgtgtgtagactcagcagcatgttgtaggcacgttgatgtgttccagccatccacttatataaacactattgtcttataggagactatacattctgactgcagtttaccaaaaaaaaaaaaaaaaaaaaaaaggaaaaaatggagtaattgtactaactctagatataatacaaaataaaaatacctagagtatttcacacatactaatgcattgatggtagatagctttttaagtttgtcccttaaataatcaaagtaatagaatatttggaattattaaatgttagcactgaaaggagtcaggaatttataaggatcagcttaatacagtcccttttttttctactttttttaaaaatttaggtatggaaacgaaggcccacatgcaattggctagttaataataaaatgaaaccttgaaattatatttgctgactcctagtctgatatgtctttcacctcaccacagggtgtttgttttttgttgttgttggttttggggggttttttgtcattatttatttttgtttctagctattgttgatttttaatgtttgcatttcacagaacaagaacaccctttttttccaagtattctgtgattcaaaactctagtacactctgccttgtagcaaattggacctaacttttttttttttttttttttgagatgtagtttcgctcttgttccccaggctggagtgcaatggtgcgatctcagctcactgcaacctctgcctcctggattcgagcgattatcctgcctcagcctcccgagtagctgggattataggcacccgccaccacgcccagctcatttttgtgtttttagtagaaacggggtttcaccatgttggccaggctggtctcaaactcctgacctcaggtgatccacttgccttggcctcccaaagtgctgggattacaggcatgagccaccaagcctggcctggacctaacatttttataaacccctgatttgctcaattaaatgtgaatttccaggttagttgactttgattggagacccccatacagatggcaggggaagttatagtggtacaatatcacacaactactcacctagagttctgtagacctacttgagtttgtatgaaagacagcttctttggcttgacctttttacttgtctactggtggaaagccacagtagactaggtctcagggaactgccaccaccctggtcccaaggcagacccctccacagccatcgcccaaagagtacagtggctagggttggggcagcaaggtagtgagaagaaggtatggcagaaattgccaatgccaggactaaaaggacctgccagctagtggtggatttggaattcctctttcatcagcaatactgtaagtcctcttatcccccagttttccttctgcaccagctcccaggatgggattaaaaggagagtgttcccaaaagctacttccagggcagggcttatgatataccaaagttcaaaaaacagttacaaaacagtagatccagtgtaaatggcaatattacgtatatgtctgtgcttccaaattgtctaccttttatatagtatgatttgcataataaggcataaaaggagtaagtgctactttttttcaaaaaggctgtgactgggccagagaaaatttggatgactgcattgttcaaaatctggttggctctgatagatttagttgtagatataaatatattttttaatcatgtcttctggtttaaatatagacactgaatttcagaaatcccagtttatgataagtactgcctttcagggtgtttgtctccattacatctagttctaaaaagatatgtagttctgtatcagtttaatttcagttttcttgttaggccattttggcgatcattccccacatattgtgatgacaactacttttatatcatgtggtgtggtcggtattgttatgtatataacagaaaagtcaccatagacaagtcaaaagcaatttgatgcaaactacccattatccaagttttggtagcagtgaaacagacatgtttcatgagagaggattactgagaagacagctgtcatttaacattcctaacactagaaaaaaaccataaagctagatggctactctaaaatgttattgatcagttcagagcattcagttaattatgttaagttttcatcgatttgaagtagtttcaggggagatctctgcattagtgaaatgtttttattttaaaaatatttttttaaaggaatatagtttacttctttcaaataatcccacaaatttagtattccaaagagaccactttgtgattctttaaattaataaataagaaatattttctaaggcatcagtaagactttaaaatgaaaacatcattgtttaaccataggaaaaaaatttaacctatctggtagttaaagcaatacaaatttaaattccaatcaagtgttattttcacctataaaattactaaaaatttttgatttgagaatacagagagttggataagcatataaattttagaaagaggctaatagttcatatcgtttagctcagcaaatcagcttctggaaatctattttgaggaaataatcttagagacagaaagatctctttgcacaaaaatgttcactgcattattatcaataatagaagaaaaagcttgaatatccatcattaaggaaattaattatataagtaaatcatggtgtacacgcgcagtagattaatacccagctgataaatgtgatttacgcagaatttataacagtgtggaaaacactcattattaggaggaaaaaaatagtaacaattttatataagttaggaagtcagccctattttggaactacatattaatgaagatagaaggagatgctgaaattttaaaaatctcttaagctcagccattatacataaggtcttatttatgttaatatgtagtcattccttttttttattattgcttgtacaaaagtaaaagctgttctctttccaaattatctcacatgccaagttatgagggtcataataacatttttatcttaaagcagaaatatctttagataacacatttaagttttccaaataatttcacttcattatcctttttttatttgtgtttttcaatgtattatttatgtatctcatgattttgctgtattactcttctggaagaaattgtatttcctggtaatttctccttgcttgcacatctgtctaccccccaaaactccacacaactagaattctgagacggtatttagtggctgttaggaagtcgaacctatatatttgtttaaattttttttttcagaggttctacagagcatggggattgtttaacattttctaggcacacatgatccagttacaaagacaaagcaccttgtgtttctatagttatttttatgtaaagctattaaaggaacaggaaacatctttcggcagcctttctccctacaactgccccaaaaatagtcattagtattaaacataacagagactaaaattgtttcccatagatccttggagaaaggctgcaaagtaacactaaagcatttggggttatttataataaagcctgtgcaaaagaaacaagatgccaattcacgtgtcaggcagacagtggcagctgctttgttactatgtggcactgtcccatcctaaatcaaatgggaaatgggtactgtttgacagatactgtcatcagtacaaacattattaaaataattaaacagcttcttcttcttttttttaatcttagggacaggctgttggtttgttcgggctttcccagccctggtgctcaggactccatgcatattcctacaccagatttttgatccagccaagcctgagctatgatttttttatcccagtgggacagtgtagctatgttcttggcgttttctgcctattaccagttagggtctgtgaacagaatctccatttgtgagaacctcattgtggatagcacgcagtggtcttttcattttgattgatggttctggttctgcaccatctggcttctgataggctgcattaatcatatcctgaactaagaaagtgtagacatgtctgcttaatatgtacccatacataatgtagcattagttattcattcatcttgcaaaacagtcataatgtatgcaaggtctttatatagtaaaacataaatattaatatgcgacccattaatgctgtttttacttgtactaacctcccactagtacatttgtttatgaagattgaagaattaagagaaagaaggccatgtgcacatttacatgaacacatatagttttgctgatgtctcctataaatttagagtgatgtatgtctgaaatacttatttgctcatatttactttatatatatgtatctttaattgcctcttgaaatacaggttaaatgcaagctgcaatacagattaatttttctcatgtgaactgcttgcatcaaatgtaggtcatccatttgccggggtcgtgggggcgtatgtggccgtgctcttttgtgctgcctctggctgggcccactctgtcccctgctgtgtgataatgtcgagaaaaaaaagaggggccagcagaggccagataggaattcagaagtcaaacaaagtttgctccagatttaggactgtcatacttttcaggagctcaaattcggttttagaaatttgctaggaccttttccatttaagagagatttagtgtgcattaatcataatcctttcagtacctagagaagggaggggaaggggatttaaattctcctgggaagttaccttgtacaaaattgctagagcatatttcttgagatagcaaattaaaaccataacttcataaaacacattttatgttttattaattatgttttgtcataaaagcactgtattctgtgtggttacatcttcttgtatgtgccccaaattcaaagcatgtgttttaatgaattatactattgcagaataagtgaagattaatgcttgcgtgctgcggaatacaaaacataatccacgctgtaacagtaatcagtcatcgaataatgcatgggaaacaaggcaaatgatcatagtttttgttgagaaataagtaaactacagcttctgcttgaaaagtaattgcagtgaggtttaattagtcacataagctctatgagcaataccaacagaaattatataaaatgtaatgcagggattcaaactgacatcttaagagtttcaaatattaagataacaccatgtagaaagctggaaaaaaataatttcagaagtaaaattagtactttaatgtccagctctcccctctcttattttaaaactacttttaactgtttcttccaatagtttagatcccattattgtttaatttcttctattaagtgatttttttaaaatatgcccaccactaagagcactgcattgacaaaccaaactataaagcaggaaatcttacgtaaatagtctatgaccatgaactactgatgtagttctaggaatttgtgaagagtgctaattttgcttggagaaggcagagtttgtgtcttgactttgcctccaaactagctgaatgatcttaaaaacaggttcatactgactggcctatttccagattaaccctcattttaagatgtaatagtctgagtgagatttttgtcttaaaaaaaaagtttaataacctcaagcctggtttcttatcttgaaattgaagatcatccctgcccttagttttagttgtttgtgagggtcacatgagataatgcatgtgtgttataaacttttaagtactacaaaaatatatgtactgtcatttttattgattaaactttcctggatttcatctgctacattcatgagagtatgcaggatgataggttctcctcccatgtcacagtaaattttaagaaccaataaaatgatgaatacatgtgtttcctggtgcctgaatttctcttctgtaagttccctctagagtttacgggagaggttaaaaactacttttccccggtaaaggaccatatgctagttgactacataattacaacataatttaattttcttcttccagcaacatagaaactattggactgtgcttctttaaaattaaggacattcatctggaagctgggacaggactgaaagggaaggtattctaaaccaaaccatttcattcgctcaggaaggcagtgccagaaagacagctttcaagaggccagtgctccgcttctccattggagaacgggtgccatccaggggggaggcatgaacagatggataagttagagaacctgacagctttcctctccctccacgagtcgtcagtagactttgattagaaatgtaataaactcccataatgccaaataaacttccttcaagtatataaataccaaaacacaagtgattttcttatttgtaacattttaatgaatcttaatgtttttgcattatcatgaatatatcagtgtttacattggtcttgcctctttttcatgttaccagcttgtccaaaggacaaccagacatgtgtatggttctccaactcagggaaatcactgtaggccatgttttgtgtttacttagacttcaagtgaagttaggtgtcctctgtatgcttatacctagtgtcatagcacagatttatatgtgtgtaaacaatgtgtttgtaataggactcaatagtctttatatacagttttttaaaactctcattcatttattgtcactgtacgcaagacgttgaaaatacaaacagtaagattctgtgtggtcccatgtcttgacacactctcaggctgttgggaaggatggagatgaacagctaattttaattctgagattcatatgtaatgccattactacccactattagtaattactgtattattggtagtagtgttaatagcaaagcataaatgtgttttaaaggaaccttgttataaaagtttaactgaaggtcatttgaaactttgaaagcacaaagtattcagtgctagcttcatgcctgaaaaaggtctgggggaccatgactcattaattatttcattcaaataaatctattgctctttctcctaagaactaaaaatgtgtactttttttttctaagatggatatttaggggtttctctaaactgttgtggttcttgtgtcaacttcccaagaacacgatggtcccaaggtacctttttgagtttcatatttgccttaaattgtaaccaagaaaaccaagaatacccatccaaataacttgtccagtgctttttccttcatagcactgaactctgatgtgttatttctttggacgccttctcaaattataaaggtaacacggaggaattacttcctagctgtctctcctatactgcaataaattattgtcctctgctcttcccaaaggcctccaaggttattgacagccccgaccagcgtctaccattgccatcccctcgcccccaccccttactaaagtgtcccaccccacacccttgaatacagattagaatcaaagaaggaactattgggaggagaagggggttgggacggtcatgcatgatgcagtttgtcagcattaatgtgaacaaaaggtcaccaagactcatcagattgacaacggagaaagaacatcattctctgcttttagaaattccttattttataatttacctagcatgctgccaattatttaattttgagttaaagatattgttcttggtgaaaaacctatttacttttaatcatagttgattaacctgtatattactagttatgagttatttcacttatttacagtttgtacttgaccgtcaccgccacatgcagatttatcataaaaaggaaggaactattctccttaatttattttgtttttcacagcctgttatggtttttaaaaggagataaggcatgaaaaagccctgaaacaatgggctaaagtcatcctctgaatatgtgagatattttttatcttttcagagaatctttgtaatttagggacattttaagaagtaaaacacgtatagaatgggattttttttctttttttaaaacaatcatttcattaggtttctatattaacgagtctattcacagggcaaaatgacagcatgatagctgtttaagctcattgttttcagatggcagaaacacagagtaacaaaaggaaaagcctccaatatagttaatataaccaaatgttagaggaggtaggaagatgcttgtcagaatcaaataacttataagccatggtgtccatatttttcccaggagtggaaagccttaatatcacagctattcagtttttcattccacaaacatccattgtttataaacatttctagaacaacgctctgtgtagcatacgcatatgccttgtgctcaaagacagtttgcccttgttccttttagtctcctttcagttgtattcttgctgttttattcattttcccccttttccctttcacattaacaaagtaattcactttcatatgtatttctagagttgtatttttgtttcaaatgatgattacatccctcaaccccaaaatgtctgggtaaatagtttatggccatctgtattctgtcatgcaaaagaagatggttcttccaaataaattcaatgactcagccataataacccacatttgtgtgtgtgtatgtgtgtgtctgtgtgtgtgtgtgtgtgtatgctgtatgtgtgtggggggaactatcattttataatttcaaccacagacaaccataacccagagctttttaaatgcccatcctttcacaaacataattttatttctaacatttttgtaatccaaatgtgctaaaacatctaggcagcatgctgtatatcagaaagagtaagtgctttgcagccaagtgaacctggcttggaaaatgctttctctcattgactagctgtgaaactttgggcacgtttcctaatctatctgaccctcacatttgtcatctgtgaaacagggaaaatagtatctattctgtgagaaatacaactctgaaaacaactgattcatagtcagtactcataaaatctcttgcctatttcctttccctttcttctaaataatttcttggataatatgttcagtagtctagacacttggaaatgctgaattattaaatattttcatgtttcatttctcacatctttcaatggcaattgaaaaaaaaatacattaccataagacttaagcacccggacataagcatggatgagctcagtcaggcccatctgtatacatgaggtcaaagtcaggtcccaccccggagaacactgtaaagtccagtttgtctcctccggcagcaagcttctcctttctccttctgtgtgcccttcttgctgcttatggactcggcgacctcgcactgtctccagtcatgcacagtcaagcctgctttcaagagagaatgtgagaggcacgtccattacaagatatacattattgaaaagggtcaataggagagtctccctggctattttcattttagcagaagagttgggatttaagccaaagtattagctactaattgttgattctcatgtgttagtgaacctttctgttttccagcagactttctggaacatgtcaattatgatgtccctgaatattatttttaattggctctttcacctttaagtggctacttttgatgacttctgacccacaaagagatccacaaatcactggaaactgttcccttctggcagaaacccatttcacttgtgaccaagtcatccagtaaaatgcacaatgtcatcaaggaagggaattgggaacagaacagaggatgttacttacagcagaactactagctacagttattcctggtcatcaacatgtcccaggaaagacttaaagagcaagaaaaggtagagaaaaataacttctacctttagtgcaaaatcagttttactgtgcctttcctttcttgcctttttttccccttgaaacagggtctctgtctctcaggctggagtgcagtagtgtgaacgtggctcagtgcagcctcaacctcccagggtcaaatgatcctcccacctcaacctcccgagtagctaggactacaggcacgcaccaccgtgtaactaatttttaattttttgtagagatggggtctcactgtgttgcccaggctggtctcaaactcctggactcaagcagtcctccggcctcagccccgcaaagtgctgggattacaaatgtaagccactgctcccagcctcctgtgcctttctttaaagtctttacttttagaaaatatctgaaagcaaatgaaaatctcattaataatgaagataatgtattacaaacaaaaatacctttttttcccctcaggtaaattacaagggtattttcttcacaatccctaataagggaaagactgcaaaaacgcacagataattgttgataatctcagctttctgctgactttttgcttctttctttgttgtactgttctgatagaggatttgggtagatacagaagatcaaggaggaggaatatagaggaattcacttaattgctaaatgttcccatgaaacatgaatgatacactgtcaaacactggattatatactgccttggtgtgttcacttaattatatcttagcaactagactgtacatttctcaagggtaaggactatgtcttatgtctttgaacacccttaaaggaacctaggctagtagttgacattgaatagtttctaagtaaactcttgccgactggaattgtatttacggcaaagctacttgcaaattacttgcattgagaccaaatgtaaacactagaggagccagacatggttttctttggacacatcttggacgtgcctgatgtcctccccacctgccttgggcatccctttatgataaaactttaattcagtcaaactggtatcactgcatgtttttaagagacttgcccactttctgaccaaattatccatctacccaaggttctcagtcagggtcggtgtcactctatcaaggggctatatggaaatagggagggtttggtcgttgctagtggtgctactggcattacgctcccaggggccggagatgctaaacatgctaaatgttgcacagcacagtctgtcacagcaaagcactgttgtgctcacagtaccgctagcgctcagcattaaaaaacactgggttccttaaaaacttgtcctgcttgctatgtgtattagtccgttttcaggctgctgataaagacatacccgagactgggaagaaaaagaggtttaattggacttacagttccacatggctggggaggcctccgaatcatggcgggaggcaaaaggcacttcttacatggcggcgccaggagaaaatgaggagagaagcaaaagcggaaacccctgataaacccatcagatctcatgagacttattcactatcacgagaatagcacgggaaagaccagcacgggacccatcacctccccctgggtccctcccacaacacatgggaattctgggagttacaattcaagttgagatttgaatggggacacagccaaaccatatcactacacaagccttatatttcaccactccccccttgcacgctatatttaatccttactgagctacttcgttctggatcatgccaagctctgtctacttctacatctttgcagattttatttcttaggctcctgacctactttctcttctagcaaatgttttttaatccttcaggactcactcagcccaggcacctccacgaagcctttgcttcttacaaacccagcctggaatatgtggcatctttacgtgccttcaaagcactctgtgcttccctctgccaggacatttgtcccagtgaattatggttatttactttcatgtcctcccactagactaaaacctacttaagaataaggtgtatgtccccgcgattcactcagtgcctgacacatagtgggtacttaataatttttgaatgaatgactcaatccatgacattgtcaggcaggaattagttcatttggcagatattcactgtgtattcctcataactttatgccaaggaagagtcttggcatgaagcaacactggcattatggatggggaagaaaccttaggagtgaagtaggaagaaggggtagagaaattatccacataaaagggttagctcaggctttattcgctcagtagcccttaagactgtgaatgggatatgtagtaggagggacccagccaacactgttcaaagtttggagcttggacccagccagtccacaaacatattgacccaaaatgaggtaactacagaagttggagtaagcatttaggaatttgacagaataattttgtgtctcttaaatcttatactgaaaacattggtgcttgtctttaatgccattttttctagtcattaatctttatcatatcttataaatcaattggttcctggtggatccaaaatttttttttccaaaaaaaagaaggaaggaaaaacatttaaatagctggtcctcagtagtgtgcaccagactggtctaggtgttcccagcaatgactgtgttttgtaccagattccaagttagatgccaaagaatcagaaatttgctgccagttccttccttccttttctcccctcttggcaagagaatggcttacttgagatagaggcaagcaggtagaacagggtcctctctgagtacctagtgttctaggtaaggcaatagtacttagccagagctgccatatgaaaaaaaaaaaaaaaaatctgctcatctggatcaagccagtctggcaggagactgggacaccatagaatctggggtgcccagtttttacccaaacagtagagtttatggtaacataactaaggctagcacctacctcctggtggactggtggccaccaatgtaccctccattctgatgatgatgagctcaagaactaaatgagactggctggattcataggataaggaccctcattggcagcaactcagcaggttatgggaggcagtggccaacatgcctaggataagaggagcatagtgccaggtattatgaagattcagacatgagcagtgttgttgacaatttgaaccaaaagcatggaccaaagtacgaatagaatgctttaggagaaaaagagaagtacaaaatgtaatactgcagccttaaagagtaaatatgaactagtttgtgtgcaaattcaagcaaggcaacgttacttttacaacattattggaagaagttgaagatggtaatggtagtggtacatttattgactgttaagtaagaagcagtatgaccctcataaagattgtttatgtgtagcagggttgaagtgccatgtgataaaactcataagctttacttacaagagttctaactagtgtagaaaaaaatcctgccagacagcgtgtctgctttgtttggaatagaagcataaatatctaatttgccttgttacagagaaaaatgcatgatctatgcagcatgtagccaaataatcattctatcaggctcaaaatgtagggaacgtagttaatttgcttctttgccctaatccttctctctgaatttgtacttcatttagtcatatttcacctcttagaagctaaaaacacaattttgccagaagatcaaaaataaaagcagcaatagcataagtcagtataccctaaattaggaaagttagaaacacacacagtaacaaatctctcaaagtttgtttttctctcaacgtttctctagtctgtaggttttttttcttttccatgtaagtgttgtgtcatgaaagcaagtgtatctcaggagtgtaaggtaggaccctataaacctttaatattagcatttcatcacaaaagttcctttgttaatttttctgttgaagaaaaatgagggtgactagcagccttagacaaaagcttagtttttgttttcaaacaaaattgacttgatgtggtttgggttagaaattgatattttattttcttaatttgtcaggcttttattttttaggtggtgccttgcctgtgttagatgtttcagtttcctagtgtgtttgtaacacccaaaagcaaatgaatttttatgaaaccataaaaatgatcaactataccctcttatatagcatgttcatgtgcagcataattgtttaatgctgttttctttccacattaagtcaacctgaaagattattgattgtcacaaactctgtttcttcatgccagaattctccagacctgtgtctcaagggaccctagtcgggagggtaattgttgctgctctctgttgaatacccggtgacagcctgtctggatcgactcaggttctggaatggtgcatctcacgatactgagtagcctgccattctgctgtaaagtgggagtagcccctcatttatggctaagggaagagagagttggatggtaaaaaaaaaacagcacaattttagtaggtatgttatattcagaaaagactgagataccattccatgtgaagttttaaattttgccttatttatagatatgtgcccaaatcatcatgttagttactttcatttgtgtagtactttctacaaagtactttacctatgaatcatctcaccacctagccaaataactctcaaacaagttatttgacttctttggtcctcagttttctgatctgtgaaagtggcataaaattacactgcatcctattagccagcctcacagagttgtgaaggtcaaatgcaatagagcttagacatgcaaatgttatattccctgcagcagagtaaagtcacataaatgaacaactgtttttaaagcaactattgaatgctaaatactgtgctgtggtcagcggagtgcagtttcatatactgggaatggattctggcattcctgtgacattttatactgaatcacctgttggtccttaaaaactgaagataggccaggcatggtggcccacgtatgtaatcctagcactttggaggccaaagtgggcagattgcttgagaccaggagttagagatcagcctgggaaacatggtgaaaccccatctctacaaaaaataccaaaaaaaaaaaaaaaagaattagctgggtgtggtggcatgtacctatagtcccagctacctgggaggctcaggtaggaggatcacctgagcccaggaggtggaggctgcagtgagccatgatcattatgcctttgcactccagcctgggtgacacagtgagactgaccttgtctccaaaaagaaaacacaaacaaacaaataaaaaagatgagaacaggtaaattgagtgtggggtgaggagggagataagggatgtgccctagctttacatattttctaagattttctgcttgaagtattcttatttgctttaaatctgagatttacaaaaagtgatttcaacctcatgacgtgtccagaataagttctgctttgctaggcttgagccctaggtggtcatgtccccttaggctgcccagagccttcaggattgtaatgtcttacacatgtttctaggagggctgcagagctgggtggcatggagctcatttgcatgcacttgattcacagcctttatttccaggcagtcacgttttccttctcagaacaatgtcctaactgttgaaagtgtgcagattttcatgtttgttctcaatgatgaagagcagaaagtctataaaaatgttaaattatggtaataaagtaaatgtcttcatttgctgagctgatcttttcacatttagaataaatatctcctttgtagtaactccttagaaaaattccaaaagctttgtaacagtattatgagaaaagatttttttcccctcctcctgtgaaactggttagcaacatcccagaaaactagaattctctagtaacccctaggtcaagtgcccatcttcacacacatctcttttattccacctcacttgtgaaggatcagcttattcctaattcctagctgctttttaggggaccaagttaatgtcaacaaagaatggtaaatcagatttgcaatctgtgatgttagggaatagagtgatatcaagtaattagaaagaatcacacagatcactttaaccacttcacagtccaaagaagcaaagtctctgtctaaaattgcacggctgccaacctggataacgtagcaggatcccatctctacaaaatatcaaaaattcaccgggcctggtggcatacacttgtagtcccagctactcaggaggcagacatggcagtatcacttgaacccaagagttcaaggctgcagcaaactatgatcacgccactgcattcagcctgggctgcagagtgagaccctgcctcaaaaataaaataaaattacatggctggtttatggctgattccatagttcagtactgttgacaataggcaacacaaagagtggtatttcctaaaggttctagtggactagaatgtaacattttttaataaaattaattcatgtgaaaactggcttggagattgtacccttctaaactgctaatatccaatgttacatcctcctcctctccttaatgggtctggactgcatgcactacagttgcccagtaaaataaaacatcgtcaaatactgcattaggtatcagggaccaggcatttgtctgagctccaacacgtgctttctgggtcttggatttttctctgctcttaaattagaatgattaatttaatcattaaattagatggctgacatgaacgactaatgtcttcgtggagtaccattcttcataaaaattgaccaaaaaaaatcacagttcacgtcccagagcccaggaggaaagggtgtttttgatttctgaccctaacctttctaatctatccttcaaattcaggtaggttcggctcagaataaaggtggaaagagccaattggaccttaaggttaaacattggagagaggaggaaaactctttttgacagcctctagtgttatttgtgggatagactggtccctctaagatactcttaaatttggcccggcgtggtggctcacgcctgtaatcccagcactttcggaggccgagacgggcggatcacaaggtcaggagatcgagagcatcctggctaacatggtgaaaccccatctctactaaaaatacaaaaaaatcagctgggcgtggtggtgggcacctgtagtcccagctacttgggaggctgaggcaggagaatggcatgaacccaggaggcagagcttgcagtgagccaagatctcgccactgcactccagcctgggcgacagagcgagactccgtctcaaaaaaaaaaaaaaaaaaaaaagatactcttgagtttacctttctatccaagatttctttggttctataatcaaaataaagcttctgttttcccctatagttttcctgtctgattcagatccaagtctacatttttggaagcctgcacgtgtccatggtccatcagcaataatgtttatggacgccacgaccaaaggcttcttcagcaagcacaggcaggggattgactggtgggggggaagtgaatacctagaacctacggtccaacaggtagtcttttgctgtgcaagcatcaccaagtccaggcaaggaccatttcgagtttttaatacataaggtcatttttttcccccaatgtttctggataaataaaaaagataattttatttagtataaagaatgctcaaccagataaaaacctggaaagcttgagtccacaactttattagtatgttgctttttacttttaaaaatggttttaatatttgatcatccaaaacgtaacacccgagtaactaacttccttatgagattggcaaatagaatatgatgggggtaatggggccattctggactccgtgggagatcagaccatcacacaaaggcttagaggtggaaataataagaataacaaatgctaacttgtagctctgtgtccattgtccactgttaattcacaagagccttgatagtgatcaaagctgagcttcctggttagtgccctgcaaccaagaccaccctctctccttgagtcctgtgggatcctgactttactttgacttgagaagaagctaattatgggttgatttctggaaagaatgattaataatcacttccatttggcaaaataaaatctgtggaggcaacactggtgtttttactaccttatgaagcaacgtgaggaagaaggaaaaaatcatgtataatcttttgcaacaagctataaaatgatttttttttgtctttaattaaacaaaagcatttttattcacagaatgttatgatcatattgctagtacagcttaatgcttactttttaactaattcattttctcatttgtggcagtctagaaaggtttattaaatctaatgactgttttaggattaagtaggcggaaagcatgttctaattacggggatggataaaagcaaactaattaaccaaaaaagtgtatttccttcctcatagatgtctggtcagccatatctgagatgaacttggcttacctagctcctgagttttttaatcatgtttttagattgcattttttacaccatctgtaccattaacatgactgtaatttctgtcacagttggaagcttcagttaataaatgttttgtttcggagcgggatgggaaggcagacaggaaggtgggagtgtttatgaatgaaccaaaagggaagggactgtgatctgaggagccatgaagtgaaaatcctggactgacttagaactgtgaatttggggttgtccttttctgccccaccttataaatactcttaattaatccttctaaaaaaatccaacctagtagaaagtattaatcacctattaatcaccagctagtcaaaaaatctaaataacttaattcatagacaacagagcatatacagaagaatgtgtggttgttttatgaaattcagaaggatttgtttctcagtgttgtgtatatcctgaacaaagcacagaatcacagtgttgtagttgagagttccaaataaataggtattttatcctatttttttaattacagatttttctggatatatttttcttttttttactagtaactactgcttcaggcttttaaaaaacactgattatgttttcaaagttgaagaaaatggtaagttttaaagcatctgtaatttcaaagagtgatagtatattgattaaaaagtttatagaaataaataataaaattttgtttcagggagaggaataggcaagacacaaggcaaactgtagactaattcaccaaaaataagtacacatacttttcaattttaaaagattaccattcatgactaaaaaagaataaactgtatgaagtgaagactgaatttttagttaaaagtcttattatactaggatgaagttttacatcttgtagcataagggacattagctttagtattataaaggagatatcagtatatattgtgtgcctgctgggtgcttagggatacaaaccattaagatagaagcctacctcaagaagcttactgtcagtaaacatttggaggacaaggagttacagtagaacaggaaatgtaatttacttcaaaaaacttttttttttttgagacagtgtctcactctgttgcccaggctggagtgcagtggcacaatctcagctcaccacaacttccacctctcaggttcaagcgtttctcctgcctcagcctcccaagtagctgggattacaggcatgccccacctccaggcctggctaatttttttgtattttttagtagagacagggtttcgccatgttagccaggctggtctcaaactcctgacttcaagtaatttgcccgcctcggcctcccaaagtgctgggattacaggcatgaaccaccacgcctggccccaaaaaacattcttaaatgatgatttatgtaataaaagtacttcagtgatagacaatggaaatagtacttatctggttgcaatgatttgtaggtagtggtcttgcaacatttgctggtgatacatcctaaagcctcacgattcctcacattcccaaaaagccttggaatgtatcactgcatccttaagttatgctaataaaagtaattgaacgtttggagtgatgctggcaggcctttctgaaagtgactgcgttcactgagagacagtaaagaagccacacatagatgcaaacactgggaagttggctaaggtgactcattaagtgagtccatcgtatctatcaatcttgagtaattcgggaattccaaaatgtgcagcagccaaataacaaatgaatgtcccgaacatttatttatttatttattttgagatagagtcttgctctggcacccaggctggagtgcagtggcgctgtctcggctcagtgcaagctccgcctcctgggttcacgccattctcctgcctcagcctcccaagtagctgggactacaggcgcccaccaccacacccggctaattttttgtatttttagtagagatggggtttcaccattgttagccaggttggtctcgatctcctgaccttgtgatccgcccgcctcggcctcccaaagtgctgggattacaggcgggagccaccgcacctggcctgtcctgaacgtttctgttccaactagtgatggtgaggatctaaaaatttcccacataaactgcaggagttaccaaacagcacgcttccgggggcaagaaaagaatggatgttgggtatttatgaatacccagcaaggtattcaggttttcacagaaatacccaggtattacttactggccttgctaaaaatcaaaactcctgatgcctccttagcgattgtacaagcttgcttccatggccatttcctttagtgcagggccgtgttctctaaagggaacagtgtagttatgaagtttgttgtaatgaaattttccctgtgtgaccaaatcttcacccttaaaaccaaacctagttggggcaatgaaggcaaatatagccaaagcctccataaaacttgctttaaacttggcttttagtgtgtgtcagttagccaaacactcttatcaattaaaccagtgaccttgggattgatcagaggaagcagtcaagtccacttgatatttaaaatggcttcatataattcccatgaagtcccatgaaatacaacagcccaagttcaggttttgtcctgtcaacttcgtcctgacaggctttctatattccatcactggctttctaacttactcttccccagactgaaatcagagtaatgaaaacagtcaaactgctcatgaaatgtcacattactatgagagcacacattatttctacagatattttctatcagtcactagatcactactcaaatgacagcagtgcctgcctgaaacatggtttaaaaatgacagccccatactgcaaagactacttcagcagtaaaatttactgatttgtccctctgatcttagcctacaaaagataccaaatgttactcaggaataaataaaacatttctagaaaaggagagaaaaggttatatgcttcattttgcttatcaatgtcatttccaagccaacaattttattaggggtaggagtatggggacatgctatttttagtttgtgggggagaaatgtgacatttagaacaaatgtcatagcatttcttcaataaaaatccatgctgtcagctccctagctctagagaattatagaaaagccgtactgaactaaaggagaggcaacaataacttgatttttagtttaaccctctccgacccagcctcagcgtggctggacagtagtaacagtttttgtgtgttacctagctctgggaagcagtcgtgcattcgcacaaagggtatttgtttaaaagaatctattctgtctacctaagaaatgactctgtgttcagccaaagccctgtgacctgttttgttcattgaaccttgaggagaagcaattttttcacaaacaaaagaactcaaatatctactaaaataacgactccaatatgaaagccagaaaatgacttttattgcctgtaaacaacaaaaacagtagaggacataattattagactttaatagaaaaataaatatgtaataaataaagttctcattatggaacatttgcccttatctcatttcccccttttttggcatatattcacattctatcgtgtagtatctctgggttgttatttaacttttcaggacaagagccatatcttacatttctctaaatcctctgcagtgcctagtacagtttttgataaaagtattgaacaattgaaacattagtttgaaaaatgcagttcgtatctacagttttttttttaactttctagctctccctggcgtgcggcctccacccccaacacacacaatgattattttcagcctttgccattttcaaggctctgattctacttgctccatccttactcctactgagtattaatagtagtctttgctgacagtgacctgtgcactttgaaaatacgtattatcatctccactaagtgcgaagatggagacatctgtggcgtttttgctcttctctcctttgcccttgcaaataattatgtgcttcattcatgatcttttttctgtctttcgtgtctcagaagagggtcctctctttcttcaccaagttctttcttcccctaaactctcaatcagatcccttcagcctgtcctggaatcccaccagttgttccccagtagtctctgtcttcctttttctaactcctccccttcactttcacatgggcatagcagtagtctccaatttaacctgctgtcttctctaattaccattaatttgctaaacatgaattgagcactcaataggtacaggcattcagccaagtaataagggtatactcttgagtaagatgaagttccttctctaaagcagctcacaactgccacaccgattcaaccagcaacttgtcatatgacccccacaaacattcactcagcgaacattcgtccagtcaaattcaggtgacacaatgagtgctaatgacagcccctgctctcaaggagctcgtagtctatgctatttctggagcctatgctagctatacctcttgttttgaacttttacttatttactgcccgtaatgattatttatgttttatatgtaactgtaatatcctcaatgcagcttttcttctattactgtgaggacaaagactggttttcaaaaactgaattactttttgtcttttgtgatctttgtttaacagattacctaaacacagatccctatcattcagccactccagccatgtactacgcagatccaaggaaggagtaccaaacacatctcagtttaggcggccttgcgcatcagtgttcaagaaatatttccattcgactcttagagtaccagcaatttttgaaacactgttccattttctaaatttttttgagtcttttatctctcctattctatttaatcaccctactatataaagccatttgaataattcatgttcactggttcagaagtaggtgatgttttgaaaattcatttttatatgaattagatatatatgatttagtaatttgtatatgtccccaattatattcttaacctgttttttctaatagtgttttgacatgactttttaacacttgtcatctatattgacaacctcattggcagggtagaggtatgtgatttctttttttttttttttttttttttaatcgttaagcgtttaaccatgaactctcaaatacaaagaaaagaattgcctctgtgtggatttatttaagactgtaatgaattaacctaatgccatttgaatttagattgcttctgcctctattctgataagttagcgaacatatgtgacattcattcaattatggcagctgtttaatcatcaatagtaatattttatcttaatcataatgtaggctgtatcacctctagatttgtgtgcccatatgagaagacgggtatcattctcttagctagcaacaggattcctcttaggaaaggagctggctttgcttaggaaactatcttgataaacagttcaatggacaaagttaaaacctgaggacatgagttacaaggaaacaagactaggaaagacagaactaactgctcagcagtagaaaaaaaatagagggatttttttctcttagcataaatgagagaaagggtaataaaagagagggaagaagtggggaataactaatattcagttttaagtggtttgcatttttccctgtgtggacagaactaagccagaaaacaaaaaattgagagctagataagacctggagaatgcaggtcctctggatgtttaaagtcatttgagaaggacactggacttttttcacacagggcaaggatggggaaattagagccaatctaactagatccaaaggggcggggagactccagatgacatctgggtctcatagatattcatgcctgcctttaattcccagccctgccttttactagctgtgtacctttgggaaagatacttaattgccctgtgtctcggtttcctcatccataacatgggaatctcaaaagtgcattttaaacaggttgtcatggtgattaaattaatgcatgtggaagaggttgggaaaatgttttgcgtgtaagtactggttaaatgccacacacatcatccatactcatggaaacacacatatgatagaagatttgggtttgctttttatgtgcatgctttaaacttaactgcaaagaagtaatacatcaaaaacccattctaaggaaacaaagttggcccagtacccctaatttctagcaacttcatctctcccttaaatggaaaatattttataccctaaacaaattaactaatgagtaacttactttctataaaacaatgtttaactccatatgtcatcatgtattttcaaagaccaaaattttatcaatatctggatatattaaccaatccttatacttttgctccttgagaaaaatgtattgcttagtttctgaagcaatggtgtaactaggtcttttgatataatgttaaatgttttaatcatttgactcttgtctacatgaaatggaaatgtaaattgctttctaaaagttgttaagcttcagtggtggctaaatactctacaatgtgtaaaatattaaaataccagagtaggctgggcacagtggctcacacctgtaatcccagcactttgggagtccaaggcaggcagatcacgaagtcaagagatggagaccatcctggccaacatgatgaaaccctgcctctactaaaaataccaaaaaaaaattagctgggtgtggtggcacacacctgtaatgccagctactcaggaggctgaggcaggggaatcacttgaacccaggaggcggaggtttcagtgagccgattgtgccactgcactccagcctggccacagagcgagactccgtcccccaccccccccaaaaaaaaaaaatacaagagtgatgacattaagaatgtaattgctgtctattttgattgcttttatttaaaacgtttactgctgacctattggtagccatttagaatatttaccacatttattacaatatatctagaaactcagttgtaaaaaattttataattcgattcctcaaaatcctttagaaaacatttagatttagattttaaaatgtttagaacatatttttccctaagcaattgttttatctagttttttttccccccgaattatattatgtgtcatcagcgtgtgtgaggatggggaggacagctttaagaagctgctgcatttagtaccaattccttgtacaattgggaggagacttttgaaataaaatattctgtttccccagctcaagctggacatgaaaatcagaaacatggaaggagaaggggcatagccgtgacaggaaggggaaggaatttgatttgaggagcgcctggagaagcctagtctcacccaggacatcacctcccatggtagcacctttgctatcacttagtacattttctgtcttgagacggtgaaagctctttaagagcaggcaccgtgtctccttgctgtatttcagtgcctagcacgtatagaaggttaatgagtatttgttgaatgaattagttgattcacttataagtcactttgcaatttggtgattattcattatgttcaagagacctgtttcccatgcattagtaattagtcctactgggaatgaaatttcataaaatctgtgagaagggcagcctgacagtgtgtgtccaggccttccaaatgtgctccagaatatattataaagggacagggacggatctgagtaaacataaatctgtgaagatgttcattgcagaactgtttatagtaataaaatgtaaagaacaacctaaatatcccatagtgggtgatgagttaaataaatgttgcattcatatggcataatggtagtgactaaaatcatgttataggagaatatttagtgatagggaggggagcgttcactgatatttcaaaaactgaaaatgtattacgagataacatgtatgtgatcctaatttcataaaaattattattacacatttgcttaggaaaaataagactgagcggggcatggtggctcacacctgtaatcctagcactttgggaagctgaggcaggtggatcacttgagctcaggagtttgagaccagcctgggcaacatggtgaaactctgtctctataaaaaatttttaaaaaattagctgggcatggtagcttgtgcctgtagtcccagctactggcagggctgaggtgggaggatagcttgagcccaggaggcagaagttgcagtgagccgagatcgtgccactgtactccagcttgggtgacagagcgagaccctgtctccaaaaaaaaaaaaaaaaaaggaaaaataagactggtaaaatatacactacagtgttaacactagttatctttagcagaatccctttttttcctttttgtgctttttctatatttttgaaaatttctaaaatgaacatttattccttttgtaaagaagggaaagagaaaggaaagttttccagtgccattttgtggagtgatgggacaaatttgtctgaaaggaattgaaacgggaatgggaggtttagaaggaagaacgatggatgtaaggaagatagtgagacatggatcaactctgagctgcagccactggagaatttgtgtggtgggattactagaattcaagcagctggagaggtgcagagagatccctaggagcaagactggtgtgcatgctgctgtggttgctttggcatggaatccttctaagagtatcaaactgtataaagtaggtaggaaacagaaccttgtatgcctggtaaactttgccaaggagaagggtctgctctctgcctaggctggtttttcagcatatgatttaagcatattttcctttgactcttcatatgtgtttattgatttctttttctgcgccatattctttgtttctactgtgatgcttagagagatggtaggtagggtggaaagagatacgctttgaacttggcagaattcagccgacatagatttgatccctgctctatcacttatgagctctatgaccttggaaaaatttgctccagtgctcctagccagcagtgttagaatgatgctgataataatcaccttgcaaggttttaagcaagatacatttatgtaaagtcaccaactcagttcctttcacgataatgggcagccagtaaatgttacttattgttctcaagattgtcttttctcagccagacactgttgtatatatgcctgtaatcccagctactcaggaggttgaagtgggaggatagcctggagtttgagaccagcctgggcaacatagtgagatcctgtctcaaagaaacaaacaaaaaacgaaagattgtcttttctcattgttctttcttgattacacaaacacagtgtgtcttataattacaaagccatatgcttgtgttgatatcttgtttatttgtttttgtagtttttacttaagtaatataaaaaaatagctaagtgaaaatcttcacgaatgaaagcaacctctttgtttgttcctcgtcatcctaaccaaaatcagtagtttgatagtacttctgtttcattatgacatacatctaccagtcacctaacctggccttactgaaacaaaacagtctttgagaaatgtaagcacatcactcagccttgttatggaaaactggcagagcacctgggtgtgcccagagggactgtgatttcacttctcactccataagcaacatccttctgttgtgaattaaatcttcacagtcaaaatctgtgtctgcatgtgcttgtttatttggaaaagaaatgttattcagagaggcattttatttgtaatacttgtggagcaatatgatattaagtgagcttaatattggtagagtgctcttttcattttaaagattcttcacatgcatttgtttttctttctggctttcctctctgttattaggccaacagacaagttatattttatacatatgtgtcagtatgatgctttacatgtgtttataacatatatgaatatggtatatactcttctgtttgtgaattgctgtgcatatctgaggatacgcatgttagtgaactggtttcaatttacacaaggaggtttcttttttctgctttcatccaacctttattgaggacagtaaatactgcctcttatctcccatcccaagctgagttcagcatctggagaagcttaaggtcccaatgcatcaaattatcttgctcaaactgttgtttattacagtcaattttgtcctgtcactccagtggcagaatgtcaaagcttttctttgcattgccttcagcttttagcctctgcagggatctgatatgctgctcctgctttgccagggggtgggttggaggggactcaaagggtcatgatgaagctccaagccagataactacagcactggttaacctccttgctaaagctgggaagggtttatgccccaccatttcactccctggaccacaaacatgcacttcattttatgaatgtctgttaatttcctatgtttccatttcttttcttttgagacctgtgtaaccacaagcaaagcatgtatgatggtattcatagaagaatagacagtgtaagtctagaaacttaatgtgaattttgtcactgacaaatatgtattctgtaatctgaacagtttaatttagataaatagtttatcttttaaaactctgactagaataaacattcacatgaatttcccatttaagtgtttaaaacttcaacttctaacctttttttcagttagaaacatatatgtacctaattatttctttttagttttatataattgtgatcatgtgtataattatacatgatgtagctttctgggatgaagttttgttgtgacaaaaggtgctttccaaatacgtttttgttttgaccattgtcaacatagttaataatctgtagaagtttgcctaatgccttcctctggggcttcttgaccttgttttctgaaacctccttttttttttttttttaatttttttaatgactcctgtaatgtctcatcaaaaaaagcagtttctatagtattcttgaaaaatgagtgtaatagagttggggatgataaatatatttccaggatggaatacaacttattcagataagaaaaaatctggcaataatgaaacatttcacactgattataagctaggaaatattcctgtgtttctacttaaaatcagctttagcccaagcaacctcttcttttgcttggactatggaagttgccttctgactggtccctccatacccattcttgttcctctctcgaatctgttcttccaagggaaactagaatgatcttttatacaagctgtcatagcaacctgtgacactactcttcatatacatcacacttgccattttatatgtgtgtgattatttgatcactgtccatctcccttactagattgtaagttccagaagggcagaggccatgcctggcctatggtagatgctcagtgaagagttatgggacacttaaatgaagacagtcagatctgtactaagttttgtgttgtgaaagtatgtcctcagttgtcctggtttacacggttctcacagataatccactctgaacagcgacacctaattcacttaaccaccacttggttgagatcttacctcctgttctgagtccgcaccataggctagccttttaaaaattaaacccttacttcaggcagagtttgagattcaaaaatttctccatagttccacccaacccagattgggtttgagaatatgcttatgtaacagacaagagtgggagattattgacttcctagctgctcttgaaaaagatctttgcaatgaggcctgattattttcatatcatgtatttccagaacaagcaatgtgcaaaaaccctctgtgacaccaaatgtataggatttgttcttgtgattttgggctactttttgcatgtctcagttttcaacagttctctgaggaagcactttgcttatttggcaaaataagcatattcgtggtccacattgcagacccgctttaagtcacctatctccaggtttgaaagtttccgtggaagaatcaataagtcgcttttggctctaaaatggctcctgagcagtcacctttttgttttcatcccatctgttgttttcgaatgggaaataaagattttcttttttttctttttttcttttttttgagatgaagtctcgctctgtcacccaggctggagtacagtggcgcaatctcggctcactgcaacctctgcctcccgggttcaagtgattcttctgcttcagcctcctgagtagctgggattacaggcgcccaccaccatgcccagctaatttttgcatttttagtagagacggggtttcaccgtgttggtcaggctggtctcgaacttctgacttcgtgatctaccctccttggcctcccaaagtgctgggattacaggcgtgagccaccgcacccagccaagatttttttttttttattcactgtaatttttggacacagacacacacacacacacacacgtgtgtgtgtgtgtgtgtgtgtctgtgtccaaaaatatatatatatgtatatatattttttaactttaatttctggtatacgtgtgcagaacatacaggtttgttacataggtatacatgtgccatggtggtttgctgcacctgtcaacccgtcatctaggtttttagccctgcgtgcaggtatttgtcctaatgctctccctccccttgccccccactctccgatgggctctggtgtgtgatgttcccctccctgtggacacatacatattttcatttaaacagtggctaatccagtcaagagaatagatcctggaagattagaaaatgcaaattaagaaaaaaaatagggatcaatggtaatacaggaagccccttttgttggctgggggggtgcagtgaaggtagtgtcaaggaacagggaagacaaccaccctgttgctggtgacacccagcctgacctttggtgtcagctcatagtaatcactttgctgtcctgagttaaaagctatcatgaaaaccttatgttgaatgggcccatcttccttatgtacttgacaaggctacattttttccctcccctccaacgatatcgtatgagattgacgttatcagaataaaaatactatggattgctgtatttttcaatacagcaccagatcagtaaacaccatcttataagtaacaatgactttctgcttcattaaaaaattatttatgctatagaaaaacaatattgaatggtagttcctttgtagaaactacagctggtgcatgctgtagctctcttttcagtcagtgtaagagataaactgttagcaataatagagagatgcccattgaactgaatatgctctttttaagataaagaactttttggtggtgttaatcacttatttgcctttctagagaatgtatccacttaatatatttataggggtgatctacgtttcagatttataaagtctctgaatatatatttttaactatacacataaaaattaaatttagagaaaagagtctcaaaattcactcttctgtaaagctaacatataaactctgcttctgcatggcttcttttatgggcttggagtaattaagcagacataatataacacataaaggaatttattaggcttttattaaggcttgataatttgagtttcagattttaaatctcaaagggctcataattgttgtcattttctactaaaagctgcatttagaaagaagttaaactgtggtgcaaaggaaaggcacgtttcaatggaaaattcaaaatgcctttttcattaattcagcacttgaatgcaagtgcctattgtgcctagcgggaggcttttaataagtaatacagacgctgcttacatgacttaatttatgccgatattttcttgaaactgtgttagttgcaggaagtagaggtttgaggttgagatatgtcctggtagagagggaagagattatttcaaactccagaaatgtgagtgaattctaatttgccaagccaatttaagtcttagaagtaaggtttttaatttcactattgactcaagaaatcactgggaccattccaggtctctgcaggatgaattttggaatagtttgtaacattgaacagccatcttctgattaaacatcttctctccttgttaactcctaattccccataaaataatctatttggggtcatggaaatgttccccaacaaaagcaatactttaaaatttaagaaacctagaactgaaagctgaacctctgatggaaaacaggtaaatggggcattgaactctgaggcccattccatggttttgcccagaaccagctctggccttgagatttgagttagcagaattccagttaactgaaactttgctctagaattgaaagtaaaaacaaaagccacctgactcaatcagtctcagcatcacatatgtaacttccttgatgcttgttagctttgaaggacctagaaaaagtctggcctgctgggcacagtagctgacgcctgtaatcctagctactcaggaggctgaggtgggagaatcgctggagcccaggggtttgagaccagcctgggcaacatagcaagaccttgtctctaaaaaaaaggttttcttaattagttgggtgtggtggcatgtgtctgtagtcccagctgctcaggaggctgaggtgggaggatcacttgagcccaggagtttgaggctgtagtgtgcaatgatcacacctatgtatagccactgcactccagcctgggcaacacagcaagaactcatcttgatggaagaaagaaaggaaggaaaggacaagagggaaagggggagggaggaagagagagagggcctggcttgaatagcttaactaatgccacagctgaacccttctatggtaatcacagtgaggccaactgggacagaacaatattaggaatcaactccctagcacacaaaatctgcctttaaatttaagcctgatgtataacgctagcaaatgcccgttttgcctcctcctcactgccagcacaaccttgccttgtgcaaaagtcacttctcttgagattactgcagatgtggtggttgttcctgagttctcgttcatgagccaccttcctggggtcggttttataacctcctccacttcattctctcagtgatgcagaggcctcacatacatcattagctgctttagactggatcctgacctcttaatcttcacagtaacccaaaacaaacacccgcttggggccaccggcagaacccaccgtggtttgggaatacagtagcctttagtgtcttgatttcaagtcaccatctttttcactttcctcatctgtttctttttcatcctagtcatgttccctctccctcaaaagttctttaaccaatcatccaaaatccttactgtggaggcctctaaaccacaggcgtttgtcagatgaaaatcagaaaaaggcatgtggtgttgagtcataatcttaaactttgtagtcttgaaataatgctgttatctggccgggcgcggtggctcatgcctgtaatcccagcacttcaggaggccgagagacgggtggatcacctgaggtcaggagtttgagaccagcctggccaacatggcaaaccccatctctactaaaaataccaaaatcagccaggcatggtggtgcatcctgtaatctcagctacttggaaggctgaggcaggagaatcccttgaacctgggagacggaggctgcagtaagccaacatcacaccattacactccagcctgggcaagaggagcgaaactctatctcaaaaacaaaaaaagaaaagaaaaagaaataatgtgtctattttagttattaattaggctccctgtccctagcattgcccctctacctagctccagaatgacctattccactgctcctaattgttggtctactaaatgctggtccaggatgacattttcaccaaactgcagaagagataagaaaaacaaagacagtacaacttacagcttaaattgatgatttaaaagatttaaaatcacttcctattttgaaatgatttattgtgatcatagatttgaaattttaaaaaattatgtacctgcttgtagaatgaaaagtacacaaccttataaacaagctgggttttttaaaaaatttccactcattttactagcatttagaatctcaaaaactgggacctagatttagccagaacccagaaaactgggacctaggatctagccagaacccagatttaacctcactgccatgcctcataccctatagcagccactgtaacctacaaaagcaagtccaggtgcttcaaccataacacacacagaccggggctggccctttaccactatccatcattgtctcccagcattccctgtcctggaactaaattggcttgatgccatttatgcctaatattgctagccaggtaaaatccatccatgatggtcaagtgtaaacttagaagcttatattcataaacacagactcaaaaattctcagcatcaaagatgaggtcagaatgccccctcatcttccctgactactttctgcttgaaacaggcttcccgcctttataaactggattcactgtattcatcatccttgaagcttgacttgaccagctttgtgccagcctttaagccaccactgtagcttgcctcttcatcaacagcatgtatacataatattggaaagaatctttttaaaaaaatgtctttgccatcactaggctgtaaagctccaccagaggaatctaattcatcttcatggcatagcacacactgggaagatttctctttaaactgaaatgaacgaatagacagctaagatgtggttaatcaatgtgaaagcaaaaaccctttctttcctccttccccaggtgtctcttcaaaggaataaacttccttcctggccaaagccttgtggcaaagtaattgaccacagctttgacagcaacaaagatgacctcttcacatccacttccttagccctttccttccactttctgtttcaggagaagaaggaccattttgttgttattaaaatgactatgctgttctaagaatttctgactgattactccactcctgccatcagcttcttctttacggcccaactctcctaaaatatggtgctggatttgttgtgttgtagagtaaaaataatattgttattgtgaattctaaggtcaaaatataaagagtcagaaaaatagctgatagctaatggattctttttatttactccgaacagttctaaaaggatatagcaaatatgttcatagcttctttttacttttgggagtttttacatttgggataattattaaaaatctttataattatccatctccttcattttgctttacagagaaggaaatattgaagttaaatgctctgatttgagagctcgtagaagaaacaacattagtaaattactgtgttgacgtatagttctcattttcatagtattttccatttcattcaaccaaaggcatttctttagcactgaccatgtcatgtggtagctgctgaggacagaggatgagtaggacacttcttactgcctgagtcaaggaggctactaggagagtctgtactctgcgatgacagcacagtgcatggcatcctatgagcgtgctgacttaaaagagagagagctttacgcacctgtgggcaggagtcaactcaggggaagtttcccagaggaagcaacacttgaacttaaagcctagttctgtgattaggaggtgattctggaagtagactgcctggattcacatcctggctcttccactgactacctgtgtgaccttcggaaagtaactaaccattctatgctgtagttcccgaatcatcagatagggaataataatagtgcttacctcatagagttgctgtgagcattacacatgttacatatatgaagtactcagaacagagccagtacagaattagcattcatattgttaggagttgacctgataattaaattgggaagaaaaagggggtagtcgtagggatacagatgtgtgagagagcctgccatgttcagataacttcatgtagtttttcactattaccagaaaatgaggtatgacgtgaaagagtgcagagaggtgggaattgtgaaagcagactttattctgtaggtaatgagggaccgttaaaatgtttcaggtgattagatttggactttgtaaagaaaattcccctaccagttttaaggctggaagagggaaaggtagggtgagtttgaggatagcatgaagtagatcatacataacatgccaggcacgaaatggcatagacctgcaggagtgccagtggaaaagatgctacagcttctcctgcagcagcttcgttaaaggctaattgctttaataacttcttgataggccaggtcctttgacatgctagccatcaaccaatccaatctcctcatctgaaatttcactattaaaaaaacttcagtggacaaaggtttagctttcaatagactaatcaaagagagcatagtagaacattttgattgaaaaggaaaatgttttacctgctaaaaagtatttggatttttaaatttgggatttaaaaaaaagcagagagataatcaagtaactgtgatgcagaagttgctaacctcattgtaccccactctgactgtctgtctcatgtgatgctcctattcatatctacatcagtgccggtctcttaagagggcaggtgtgaaagtgaaaagaaaacaacccttgaagacagaacacccagactgacatctggttccaccatataccagctgggtgaccttgagtatgtcacttaacctctgggagcctcagtttccttatctgtgtcctagagataatgatacttcaaatagttgtcatgaggaacaaatgagataatgtaggtgaaagcaatgtgatatcagaaaagcaaaacaggcactgtggcttgcctgtttgtacatctattatgggctacggttagtttatggcatatcctgtagttctaacaaatgtgcgcttagtttcaatggtgtttttgagcccgtgagaaagagtttgagtagtaatgccattagattttaagtttagagttgcttttctaaaatatttctgccaaaggtactgtcaaagctgacaaccagctgacttaatcatttctaattactgtgccaccaaaagtaaccatgactgattcatatgaactatggcaggactgttttataaatattagaaaacacttaattagcctggaaccaaagatggcaattagtttataatagatatgaaaaccctatccaacaatagccacttaactttaaatcatttagcccatgtcaccagaattattcttttaggacctactgtggtcaagaatacacactctcgttcacatcaaattgatggcaagtccaagattctcagtattctattctttgaccttcctttgacaccttaagaatgcccactctcagatggctactgcaaagcttgtaaactgattaagtgaccaaaatcttaactgtattattaatggatggccatgtgacagtaccttgtctaagacattcttcaccagtgaaataaatcaggagattccattttatttaataaattaaattcatggcttcataagccttactcaaggagacacaaggcactgccagctgatgttataatctatgtcggagcttctaaggccctctgtcatctcattccgcagatgtcttcagaagcccttgaaactattgcaagctgataagtagacgtgcacacccaagaaagtatactaaattataaacagctttgcagaactggcaaagcattatcgtttggcagtaaacctgaggaatggttaagttatgttccaagctgcatttgagatatcctgcatgtagtcaaagactgcagttgaccataggaagcatgctgaccggtggcttgagcataaaagccgaaaatgcagttaagtagatcaagataatcaagttgaagtcaatgtaaatcaagtcaacccttctttctgggggcagttgagaacctcaaacaccgttgtgcccagccttctgctcctcctcctcctgagaaccagatccaaagcagataacatccaggtgctccatctgtttcatcagtgctgctcaggaagggcatttgagattcagtcaagatgggatcattttcaggttcctaacatgtcaagcagcctagaaagacaactcatttgagcagatgctgtacaggtaacatatggaagctacagagagattaatttttattcactagtgggaagaccctttaatacttaactgacatagctacacatgagaaaaatttcttttttatataattgcacatttccttggactcaaagctattgtcttacaaatcagaaagtaatacaccacaattgggaaaagtggaagggtaatttcaaaataaaaagcataccatctgtttctaagggctaaaggaatgttctaaaaatcagtgtagtttcaaagagctataaatacaatttgtaatgtactgtcatacccatacccacataaatagcaggcttttaccagttttcttttaggtaatgtatttagtaaccaacagagccttgatcaacagagctttgatatttttctgtatttttgtcttgcttttaattcgcatctatctctgtttctctctctccctcatatacccttttctcctctcctcttctttataaatatccttcttcgccaaaacataaatatgtaagtgtattgttttctgcccaagacaggagctaatttaaggtagatacacctcctgggctgcaagacaaagttccagattagtcaagacttgtgagaaattcatgtgaggggcaaagaagagattatttatgtggagaaagtgggaacctacataggattatttttatccagatgaaagaaatacgggcagaagcaaactaaaatggtctacaagttgggcattaaaaaaaatacaactggaatattttacaaagtctgccccatggtgataaatacacacgagcagatattacaatgccatgcatctgtgtccccaccaaaaacctgtgtgatttaaaaagtgatgttaatccgactagcataacccttggtgggttcatctgttttctgacaagatgaaaaagtgatagaaaagtcatcagatctctggctgacacagtggcttatgcttataatcccagcactttgggaggctgaggcaggcagatcacttgaagccaggagttcaggaccagcctggccaacatggcgaaaccctgtctctaccaaaacatacaaaaattagccaggcttggtggtgcatacctgtaatcccagctacttgggaggctgaggcaggggaatcacttgaacccgggagggagaggttgcaatgagctgagatcgcaccactacaccccagccttgggtgacagagcgagactctgtctcagaagaaaagtcatcaaatttctgatgaatgtggtatattagtctgttctcatgctgctaataaagacatacccaggaccgggtaatttataaaggaaagaggcttaatcgacttacaattccacatggctggggaggcctcataatcatggtggaaggcaagaaggagcaaagtcacatcttgcatggtagcaggcaagagagggtttgcagaagaactcccttttgtaaagcggtcagatctcatgagacttattctctctcaccagaacagtacgggaaagaccccccccaccccatgattcagttacctcccactgggtccctcccacaacatatgggaattatgggagctacaattcaaaatgagatttggctggggacacagccaaaccgtatcagtagacaaattcatacctatcactgaaagatgcaaagtaatgatgaagacagctaatgttctgtggagcacacaactgaagtttaatgtctgctgtcttcagccttgtctgataaaatgctggaagcatggcacctgagatggtcactgggaccatattttactgtctgcagaagaagcactggtgggatgaatcacctcctgtaatacatgggttaggaagaaaaataacataagtagttttattagttttcttattttaaatacagtgtctacttatgaggttggttggttggttggtttgttggtttgttttgagatggagtctcactctgtcacacaggctggagtgcagtgatcttggctcactgcaacctccagcccctaggttcaagtgattctcctgccttagccgcccgagtagctgggattacaggtgcctgctactgtgcccagctaatctttgtatttttagtagagacagggtttcactatcttggccaggctggtcttgaattcctgacctcatgatcgacccgcctcagcctcccaaagtgctgggattacaggcgtgagccaccacgcccgaccgtacttaccggtttttaaatattttctttcttattaagtttggcattaaaaaaaagtcatgacactatttctaaaatgtttctgatgcaatgaatatgttttactgatattttcatgttgaaggtagggaaagctttgtgtaatttacagaggccgaggaagacagtaagtaccctaacctccccagacagattccactgcttttagttggtactgttaggctatttagaagacttataaatgataatctgtttacagccctgtcattaatcagcagtatttttaaattatcttaatactaaatgaaaagttgaagtaatattgtcaccatcaccacgcagggaacagtagctctgatcacctgattacccacttttattagtaagatatttttaaatggctttgatttgattgtttaaaaaatatatagaaaatctgaaaagtaaagagaagaaacaataaaaaaataattaatcactatggtccagcacacaggtttcaccattatgatcagtttggagtatttgcttcctttagaccttgggtatttattttattttacaatgctatcattatattgcatacaagttacttcttttttttgagacagagtcttgctgtgatgcccaggctgaagtgcagtggtacgatctcagctcactgcaacctctgcctcccaggttcaaaggattctcctgcctcagcctcccgagtagctgggattacaggcgcccaccaccacacctggctaatttttgtatttttttagtagagatggggttcaccatgttagccaggctggtctcgatctcctgacctcgtgatccgcccaccttggcctcccaaagtgctgggattacaggctgagccaccctgcccagccagttacttctaaaaatcatactgtgagcactgttttgtgtcactgaagttctcagaaaccttttctgtaatggctacataatactatgccattgaatggatacatcactttattaactattccactattgttgagcattcaggttgtctccaatattttattagtataaattactccataataaatacctcatactatagatgtattcttagaagcacaattaataggttaaaggatacaggtactattaggttaaaggggttttggtagaaactgccaaattgctttttagaaaagctgtccacactcccaccccagggccttcagttccaatgattaacccttttttgttattggtgaaggatttgtataatgtgcctttgtatttattttgcttatatttcatccagatttttattttgcatcgatgttcagaagtaagattcatgtgtagcaatggatctgaacattttgtggtctgtgactcattcgagaatctcatggaaaccgtgaaccttcctctccaaaaaatgaacatactgatacatatgcagattttcacatattttaagggaacatggacagtcctccccctaaagccagtcaatattttgttgctcacctgatactaagtgctttatatgggggttatttccttgaaccctcacaatcgggggtatcacagaggaaagtcacttggtcaaagtggtatcactatgaaatggtcaagctgggactcactctccagagcctcctgtcttcatgatgttcgtaccccaagggaaaggatcccctgttttattattcctcttccacgccccgtggtcagggttttccagtcatagtcatgctgccttcctaaaatctagtgggatcattttctgtattttttcccatgctctggatctctttctgtagcatggggattgtgtttcttgaaagtttgaaagctttcttggctgggcgaggtggttcacgcctgtaatcccaacactttgggaggcagaggcgggcagatcgctcgagcccaggagttcaagaacagcttgggcaaagcaacatagcgagacttcttctctacaaaaaagattttaaaattagccaggcatggtagcatgcccctatagtcccagctactcagaaggctgaggggggaggatcgcttcagcccaggatttgaggctgcagtgagctaggatcataccactgcaatccagcctggtgacagagcaagaccctgtctctaaaaaaattaaaaataaaaattaaagctttcttctctagagttttttagcaggaaattatttaatgacattttcagttgcttgtgtgtacattggtttcctttgttaaaaatttttgaatcaatttttataattattttctccaatgactacgcatttcattagaatattctttttcatatttattagcatagagttgtatgtaatattctcctggttcttagcacttccttttcattcctcattttgtcttttatcttttttttttttttcttgattggctttgccagtgttttgtctgcttcagtattaattttttgtaaatttcattttgtttttgtgaggtttttcctccttcacctccccacaacacccttctttcctcctgcatcccccccacacacccaaaaatactcttggatgagtaattgtgcctatttttatattttatatttttgtaatattttatattacttcttcatttcttagggtgtggatgttgttggagttgttcctctttttctaaatgctaaagttgaatgtggtgtttgtttgttttttaattcttccatgcgtaatggtctgatcttttctatttttcaatcgacttgtttggactttaattcagtgcttatttaggaaagtgttttaaattttcatatgtgctatttttataagttaatcattaagttttggatagtagaatcctaggttcatttgttcaagaagtttgaccattatagggagaaatgaacatgcattgacactcattgatgagaagagaagcttgagggtccacattttctattttgtttaggtcaaaaactacttactgattacctactgtgctcgaggacctgtgctaggtagtggggctataactgaaagtttcctttctcatggaaattttggtctaccagagaatgcagatgaatacacaagcaattacaggaactgcaggaaaatcaactgaaaaactaataagaccattgagtttgagctaactacaagataccatcaaaaataaaattaaggtcagacgcagtgactcatgcctgtcatcccaacactttgggaggctgaggcaagagtaatccttgaggacaggagttcaagaccagcctgggcaacatagtgagaccccatctctgtgaaaaagatttaaaaattagcaaggtgtggtggcactcaactgtagttccagctacggaaggctgaggcaggagaattgcttcagtgcaggaatttgaggcagcagtgaactgtgatcacacacacctctgcaccccagtgtgagtgacagaaaaaaagagagatcctgtctcaattaaaaaaagaaagaaagaaaaaattaacagaaagggacaaattaaataaacacaatagaaaaagatctcattcgctaaaggaactaagcaaatacacctggaaataaatctaacaaaaaataaatgttgtaagacctttatgatgaaaagggatatttttctgaagactataacagataatgtattcttgtataggacagtgtaacatgatgatgatagtatcaactgtccctatgttattcaatagagtcggtataatcttagtcaaaagttcaacagggtttttgatacattttagtacaaagtagtaaaaaacttacacataatgaatgagggtaaacaaagtttaaatgaggaaaaatagtctcaataattgtaattcagttattataactcaacagaaaaatggacaaagagattcaataaacacatgaaaagaattccctctcaatagcaattaagaaaacaaaaactacaaaaaaatatttgttccccttttatgtcaacaattaaaaaatgttatatacagtattgttgggtgtaggtaagaaaaccctcataaactatgtggagagaggctgtggtcacagtgctaaatgatgccaagaataaaaaaacacattgataaggccattttggagggcaatttaactatatatatatatatatgaaaatcaaaagtataactattcttccttcaacctagtaattccacttctagaaaaatgctcaccccgtatccaaagagatatgcgttattgttggtaatagcttaaaattggaaacaagccaaatgtctattaataggaaagtggttaaataaattatggcatcttcattatatggcctcctgtgcactcatctgaaaaataaagtagggctttatgtggcaacataaggcgctgggctttctcctgagagcaatggggaaccattgtagggttttaagtggaggcacgacatgaccagacttgagtttttaaaatatctctctggatggattatggattatgggaaatggatcagagagacataaaatagagtcaagaatcccattaggaggccatttatccaattgggcattaatggtgactccaagatatggcagagctgaaactgcatttacacagccaaaagatacttaggtatggcaatacattgtggtattttattttgacgttattttgggcagctttggcttacaaatcacttacctagacaaggatgataaaataggttttctgactataaaatctatttactaaattggttagaattacaagtctattcattttgttaaatttgctttccaaataaagctgctcacccctctttgttgaaacaacaaagctcatctaggtgaccatccctctctttttgccttgactctcaggaagctcagagacaaatttagcactcaatgtagtgacctatacttaggtttagattataattagcttctactttttcttccacagatttagccttttatttttattttcaaaggctacatggttatgtgtgtcatttattgtacactgatttctccatttttaaaaaccagacaggtttaaaattactaataaataagtgaatgttaaagttaccatcttagctgcatagtctgtttgatcccttggtgacttgaaaggtgttgtttgacttttatctcctaaagttgtgaatatttcatattgatttagcaaaggtcttctaataaagaagggaccattttaacttcacagcaggcttcatggtagtaatctgctcctcaagattaattaagcatttgtaacattactttataactgtcacttgtctgtaaaattgaagaggtagcatagcatggtagtttagagcttggcctttggagccagactccagggtttgaacatgggctgtgcccgtcacctaccagctgtgggactgtgggcaagagacttaatgcctctgggtctcaggctcctcatgaagagatctctactgcatggggtgttttgagtattgaactggctaatatttgtaaattgcttactatagttatttgttaagtgataaaatggaatggagatttcttttcctgttgtacatccttaggtggaacagatgttaattcatttaagactatgtgataagaggaacattaaaggtttaacccttgattcttatttttgtatgcatgtaagtacagttctaaaagaaaacatttttctatacattaatgaatttaaaatcatagattgtttatgcgtgtttaatgctgattaatttggtgttactgttgcaaggccaaacagtgactcacaaagaagtgaacagactggcatttcaaacaatgcacaggcaagacaagtgagtctgctaaatatgcagctcatctcttcaatggtgaaattttagatctgcttggtttctttggtaaattatagtctaaaggagaccaaaatattgcttggaatttatttgcgtagcaagccgcctgcacatgaaggatagtacacgtgtgctagaatgtgaaatcttataaagcacaaggcagcttaggcaaagggtcttcctgtacccgtagtctgagaatgtcttcatgggctggatgttggtttttttttttttgttttttttttttttttgagacggagtctgactctgtcacccaggctggagtgcagtggcacgatcttggctcagcgcatcctccgccacccggcttcaagtgattctcttgcctcagcctcctgagtagctgggattacaggcgcctgccacagtgcccagctaatttttttttgtagttttagtagagatggggtttcaccatcttggccaggctggtgttgaattcatgacctcatgatccacccgcctcagcctcccaaagtgctgggattacaggcgtgagccactgcgcctggccagatgttggtttttaaaaagcaatcctcacagccccctaactgttagataagaattatgattttaaaaatccacaactctgctattcatttgaattatttacataagcaaggcctctccttctcaaattggaatcatactgcaatatgctttttgaggcttttgggtattctcagttaatttaaatagacttgagtagaatgaaaattgatcaaatattgcattgtttttaaagttaggtctcttgtttttcacttgagagatttttttcctccactttaatacattggctcatttccatttttatatttcttagatatcatgataattattgttttgataaattcctactccccatccgcccttacacatacacacttaattttgttagagaatgtatctgttatcaaatacattaagaactacctctgcattgtaatgattatgaatttttcagagatttgatttaactgcctaattctgtttagaagcctcagtttatgagtttttttcccactgtcctttcattaactactaaaaatgaatacattaagaaagtaggtgttttaaacaaaaccagaacacttgatttataaaacaaaagcttgatttaaagagtatgatatgtcttcaacctggttgggtattatttaaagttttcctctgatcttttttttttttttcagtagcaaagagatatattatctccaaaatggctaatggatctatccaaacattggttttataaggaaattgaagaatcattatttacgaatatatttgacaattttccaaaaagataatgagagcagacacgtggtgtaaatagtatgtttttgataaaaatgttctcttagcctagcaaccaaatcagaatgttgaacaaacaaaatgagaagtaaaatgttaaaatgcattctgtagtattttagttaataattttatatatggttctttaagcttttcccattttataattgtcaaaactaaacagcttgtccaaacaaaagttagaatctcacttgaacccaacctatcacccactgatactttctttagtctatcaactatgtaatgaaatatgtcatgaaatattattattaaaggctaattccagccaatgttgcaagcataaggcacaggagaagatgagagatggagatttaaggggcaatcatatagtatccaaggaaaaagccttatcatggggaaagagtaagatgatagagaaaaggaaatagtcaagaaattaacatttctgatcatcattctaaactatatgatgggggttacatatttaaggatcttttataacataaaattcctgtacaaagccagtacctgtattttctttgtaaatccattaccatttatattgtaattctaatgatattggagaaaatatgaattatgagtgtgctgttaatatgatgtgccctgtgtaattctgaactcaaatagtgaagaggaagccatgtttatttaaaatgtgggagcatcatttttcttaacatttatttttagtgttaattttatcttgcatataagaccttacttggaaaaaagagaggatcacatggtgaaaggtgatcttgttaaaagtcattgcagaacaggttaatttgattgaaaatgatccccccacaaaagtttccaaattataacttagtctcttgtaccacatggacctttctagttataatggtgatatcaacatcccagcaacctacattcgtatagcaattttcagtttcctaagggatagcacctgctctcatttgttaaatgaactggttatacttggttctaagtgaggatccaagaggacttacctaagcacaggagggcttgaagccgaactccaacctctgcaggtttcatggtctttctacagcactctgatagctcacagcagactacacagcttaggaaataattacagcctgccacaatttttcttaatttttaactgaaaaacaaaatctcaactctaaaatttgatggacagtgaggttagtttgagaagttgagaaactcttattttccattatccctgttatcttttcacctaggacacagcaagtgacgtgctcattgcatgggcagagattttcccactcctggcactgcttttatgctgtcacctcttttcagggtgagggagggccacaataactttgcaaagaaagtcccaggttttcaaagagagcagagagtgtggggtggaggtgggagagaatgagaccttagtagaaacactacctgaaataggcatataaaacaaattaccccaaatcaacaactcattatcattacagggtttacttgttcgcagatgtttccttcatttatcagtctagggccttatttaacctcaagactaatactcaacaaagccacatgctaatcatgaggacacctatacaggggcaagtagttcctcaaggggcatttatttccctgtattttctaggaaatgctattgggagggtgtattttaataattagcattaaatttgtttcatatttttgcctagtagctttctctcaagctaaagaatttggaaagacttgtttattcattatatatttgtacaaaaatcagaaataaagttttgaggattgaatattttaagctgttattaccttcctaaaacagcatttttgtttgctgcagtagtctttttccacatatacttcaagtaatggaatactatcactttgaattttaaaatgttaagcaaaacaaaaaaagaggctggtcctggtggctcacacttgtgatctcagcactttggtaggctgcctgagtccaggagttcaggaccagcctgggccatatggcaaaatactgtctctacaaaacaatacaaaaattagctgggcgtggtagcatgtgcctgtagtcccaggtacttgtgaggctgaggtgagaggattgctcaagcccgggaagtcgaggctgcagtatgctgaaatcatgccactgcactccagcctgggttacaaagcgagaccctgtctcaaaaaaaaagaaaaatcaccagcttcaccattataaactatgtgattctgggtaagaccacctcaacccaaagggcattggtttcctgatctgttgaatgagaataatgtctactcaccctgtagggtgtttggtgacaaaataaggtaaaccatttcatcaccagaacaaaagtagtggtatggtaatgcttgtgttcatagtcatcatggtggttagttgaagaatcaaattttctccatctgatgcttgaactttcttatgaatccttcctacccactaccaccttcatttaaaacagtgactctgagacctttaagtttctttttttttttttttgacctttaagtttcataccacacttgccagtccttgtgataccaaataatacgtcaactggaatacaccagcaggcttgttttaagtcagctatttacagctgctagtgtttttagaagcaagcagaagttagctgtctggtcccaatggtaattatctgatcttacactgatttctagaaagcctcagagggacaccacctgaatcaatcagaaatagctagtaaggaaattgaattaacattttgaatttaaaaacttttttccagatacattttttttttactatgtatgagtcacccttaaggctactaattttgctccattaatttttattcatcttgtatgtctgctaaaaaagaaacagcaattacatcttttcaaagaccttttgtagtttttatcttctgtttgtgatctggtaagaaaagaactgtttatatctgagtttcattttccccaaatctctgcattagtttgaatgtatctctaaagcttatgtgttagaaacttgtcttagtcttttttttctgctgctataacagaataccacagactgggtaatttataaagaaaataaatttatttctcacagttctagaggccgtgaagtccaagagcctggcagcagcatctgaccaggcccttactgctggcagagagatcatgtggtgaagagcacaggagacagagacagacacagacagaaagaatgcatgcatgtgcaagagggtaggagtaagagagagctgagaaagccacactcacctttataaaaacccactgtcgagatagctaaccaactccggagatagcaactttaatccttcacagggtggagcctaagcttatgaccgaatcaccacttaaagattctacatctcaacactcttacaatggcacttaaatttcagcatgagttttggaggagacatttagaccataccaaaatttgattcccaatgtggttatattgggtgttgggaccttcaagaggttattaggccatgagggcccccatgagtgaattaatgttgttatcatgggagtggtttcttataaaaagacaagttcaacccactcttgctgtcctccctctattgccttctctttgcccttctaccttctgccattggatgatgcagcaagaaggccctcacgaggcactggcaccttgatctttgacttcctggcctttagaaccatgagaaaataaatacattttctttataaattatccagtctcaggtattctgttatagcagcacaaaacagactaaggcagagatctaatcacaaattttacatgttgatgttaaagatagttttcttagtcagtattttgatattaacaggtctgtattttatatgttgtaacctactacaaagcagagaacttttatatggccattttgagaaaatattttaattatttctcttccttctctactggtaagtgaatggtaataatgaaaatttctctttcatttgccatttctttctgctttactgtactgatagactacctgttattaatggtcattacagtacctcttattttctcttaaagaacttgttttatgttttcttcaagacacgtaataagtagcaaagagatggtccagcattgtttactgcagaaaacagtgcactaggaagtttggcacctaagacctatatctaacttacacagtatcctgaaccaaggtacttaaattctctgtgcttctgtaagttggcaaccacaaaagtctatgtgaaagtgaaaaataagaaactagatgaaataagattattatagctgctctttgttatgaagatgataacaaaaaatacagctattctaaggccttcagaataaattatagaattaaatttttgagaaaaatgccattgatttatttcagtttagcaatttttcaaaaggtttcagtgcttgacagtataactgtaagaatatcactatttattaaaagagctgcttcattcatttacatttattgagaacctattgtgagtcaggcatttaggtgctagggataaagttacaaatgaacaaaatctctactcgtggaatttagaatcttgtgagcattcttctaggttatttcccttaaaatttaaggtaactagtttgctgaaattaaaaggagtattttaccctgctgtagtgctatatgtgtgtatggttcttaaacttcacgctgtcctgtgtactgtttagtaacagaattgtttattattatgattctggtatgttaatgaaggggtactcatttgcaaataactgtttaatctgtgattaaaatctggcagctctcttaaaaataaagaacagttaaaatgcatagtcactgtcctgctgtattgaatatgcaattgaaaaacattaagaaaggcatatcctatttatcacttttaatgaatctttcaccctggtcccactgtaagcccttgatggtattcctgtcatcccatccatatgctcctaaaagcattaactattcttggctctgtgcatgccttagtataaaatcaaaatctctaggttttgatcacatataagcaagcttaaaaaaatcattatcattaccatatcctcattaagatgatgggcccctgaccatctcttcatgtttgccttgcaatctaaaattcatgtatgcaaagggaatttttcttatccttttgaaagaagaatgataaatatttatacagccttaactctttcaagcaggcataggatcatgttttagaaatgacagtaagctgctctaggttttttttttttttccagcataattcgtctttccaatagctactgaaaaaaatgaattgcagatttatcaatattggagaattttcctgctctcttcccattaaatatgtttagtcttacatttctgcaacccttttgagccatggcttcgaaaagggagcaaagaggtccctctgcttttcagacagggttcctccagagggctggcagtacgcccaccaggagtgctgacctgtgctcaagcccaggatcctaattcctccggcacctttttgcttttttagcatatttaacaataatctagactctaagtaactagtcacatatccgtacagtgttgctttctaaaagttactcctctctgaagcagcaattagagctccaagacagttttctacttgaaattaaaattccctcatgactacttgaataaagacgtccagtagtaatgttgaagttatgaatgtgtttcagctcacagagctgtcttcttataataaatggaagatatgtgtgaagttggaatttagttaaatatagaccatcctggagatagtagaagtgctgcgggttatgttaccaacaataatctaacttgtcctgcacctgctgttggacctcctccatattattacttctgccactgactcccaaaagccaggttattaatctgaagacaactcaagacccaagccacatcattactgttgtaaaccagaaataaaattctaagccccccaaccaactgaatgcacccctcctcttggccgggggcattcaaagttaacctgaaaaactgatactttaggccatgagaggaagcagggactgggggttggaggggtaggttggacatgcctcattatgctctcctctgtttggaattcaggtacaactgaccagcagtaacattaaaacagagaacttaagactgacaaaacagactttttgtaacaataagataccagattccaacctgattctggtatagcatcacatgacagataacaggccctaaaaaaatgaaaatattttaccccgaaatacatttctttgaccttttttttttttttttgaggtggagtctcgctctgtgtcccaggctggagtgcaatggcacgacctcggcttactgcaatctctacctcccaggttcaagcgattctcctgcctcagcctcctgagtagctgggattgtagacacccaccaccatgcccggctaatttttgtatttttagtagacatggggtttcaccatgttggccaggctggtctctaactcctggcctcaagtgatcaacccacctcggcctgcccaaagtgctgggattacaggcgtgagccaccacgcagaaaccagctcttacatgctgagtagttcaccacacagagaaaggccttttagaattcaagtgatcttctaaggtttattttaactgtatactatcatgtgcaaagtatcatagcattaaaatatctcaccttaggcctccagccaatgcttttatttaattaattaatttatttatttgagacagggtctcactctgttcccaggctggagtacagtggcacattcatagctcactggtgccttgacctcctgggcacaagcaatcctcccacctcagcctctggagtagctatagctaggactacaggtgtgcactaccacgtgcagctaattttttttttttttttttttttctgtagagatggggtttcaccatgttgcccaggctggtctcaaactcctgggctcaagtgatctacccacctcaacctcccaaagtgctaggattacagggtgagccacagtacccagcctaagatttgaatattctcaaggtctcttagttcctacaatgcagtaattttgtagcagtttgaaaatccagacatactatataggttttcccagctactccttgagttggctttgtttctgctatttagtctcaggaactgttgcagtggttcctatctacatctgtgataaacagcttttcctagaacaacttgcagacatggcaatgttcaggtttaagtagacgatgtactattgtgtttggcaggagaggccattaaaaaaaaaaaaagcagccctcatactaaatttcttttgaaaggtgttactgatcaaaaaatatagctcagaattgaaaattgtttggactaaataactgtgtcctttctctcaccttcccattcaatccttccacctaagtagattgatatgaaaaagtacataggattgcttaaagcttttatctttgttagtaatcaccctggaagaatttttaaattattgatttaagtagaatcttttattcttggtttaaatgtatacaaaaactacctacatgctcacctacaatctcgattttctttgaaattcatctattttctcacttgtctacatcaaggggaaatagggagcgaggataggtctgaaccaaagtactcccacttaaatggcatgatgtgtctacgtatctatgtgtgtgtgcgtgcctgtgtgtgcacatagcaaattactggttgcaataaaatttgttagaatttcaatttggcttcattaagtctgagacagtgaagtaatactaagggagaaatagaataggtgaagagaaataaatactagatcaattttctttcaagaaagacgttttagaagaagtagtattcattttttaggtcatcattgacatttctcaatattatattcctataaactgcatatcaggacttgtatgtgcttgaggaagctacattttcacagcaggagaggaaatcagaataaagcattgagatgcaggtgcacagtaatacaagtgggctctttcccctgcagcctgaatgcctggccaataatgcagaagctcttggagccgggctctcagggtctcccggagctaagccaagaagtatgggggtggggcagggggggtcaggagagaataattgttattcagtcttctttaatgagatgtattgcccactgctgaaagattgtggcagtgccttttgttatgctaattagacaccattagagcttggctctctttgatttctgcttaatcttttctgcttcctcagcctcaatcctgactggcaaatggttgaaagatggtggggtgtactgcacgtgttatttattgctcacatctatgctgagttctttggggaatgggggggaatgtaagatttatcttaccaaaggcagttcctattttggacgttcatttttggcttatttttaaaaaatgaattttttgataatgattactttctgccttttaagtccaaatgccactgttttttatatggttgcttttgcagccacactgaatggaaaatgacagattggaaaatgtagatggcctctccttggttgcctgattttccctaaaaacagtgagcaagctgatcatgccataaggttttagagatgctgtggtcaaccagaaaaatggaagcaagaataatttaatggtcaaaaagagcaattttgctattcaaaattcctgcctttacagtttatagacatgtgtatacattccttcctaaaactaaaacattacatttacatgattaccacagttaagagtgtggtgaggttttttttttaatttttttgaaaaatgactaatatcctttctaaaacagtgaaatggtagatttccgttaaatttttaaaaacaacatcataatgttttagagcagccctctccaataaaaatatggtatcaaccacagatgttacttcacattttttgatagccgcattaacagagtaaaaagaaacaggtgaaatttgtttgaataatatattttatttactccagtatatcaaaactattatcatttcagcctgtattcagtatagaaattaatgagatgtcttacattcttttattcatgtgaaatttttgaaatccggtgtgtactttgcactggtgtatgtttgataacacatctcaattgagattcgccacattttaagtgcccagtggccacatatggctaggactactgtatacatggtgcagttttaaagtaattgggtaattcaccacttgcctaaaacaactggcaggatagaatccatttttaacattatagattaaatattatgaggtatgtgaccttgaccaagtcacttaatctctaagggacctgtattctcatctgtaatatgaagagtttgtcctaaatgatctctgaagtcctctcttctatccaatccagctctgaattcatgattttaaaaattctcatttagaagttgggtaggctggagcttatccatcctttctcataatttagtatttgaaaagaagctttcttatgccataaagataattagaaagcgtcctgcataccacacccacacctttttttcttccaaatgtctgaatctttcttggaattattctgagttttataccattggtaatgcctggtggtgtagctcactgagttgcctgactccccatgcttttggaatgaggacttggagcaatgaaggtgtgagggaagttggcaagtagttactgcagattactagattacataaacaatctctctctccaatgcttttgcttttgcttttctctttttttaaatttggcttactttttgtgtcgtcagtgaaacaaaacttctacaagcaccttccaagaaagtgacctattaaatgttatcactggtcacttatgtaccttttggggatggggaatgtatgaaaaaaattttttcccagaagcacagcccagtttcatacatatttttgcccatttgtgaaaaaaaaggacatttccttattttagtgtttattcgttgaaaattaagtgaaacttttttcacatatgtgctgtatgtagataatttagatttttggttttgaattgcttttttagcagtttgtttttctgttgggaacatttattgttttcttactgttttgtaaaggctcttcatattatataacctataacatgtcattagtatatatgtcatacttgcaatttttttctatttgctttttgactttgtttatgacaatcttaatatactttttttaatcagtagttaaaaacttctcatttatggcaacatagcattatgttaaaaatgtttcatcaacacgttacatgtctaataatttatatttcctccaagtattttgtggcttcttctttttcatcttttcaactgacaaataaaattgtatctatttaagatgcacaacctacttttatgagtaggtccctttctgagaatctgctctcaaagaagactggcctagacttgccaagtaatggctgagagagaccagtgggaatagatcaagagggtggaagtgaacggaaattctgttcaatttttaggtttgcgcttttcataaaaaagttctacacttatatccagtgttggctccatgggccctttccatgaatcagatctcatggatagatcttactggcagtatctggccatagaacttcagttttcaatattgagcactttcccaggctgcctgggcatgacagagcttgcccagtgtggggaaaaacagacctgatgtactttgtgccggctctgtgataggagggtcaacttgtttgggtttgttgagagggtagatttcatgttatatgttcttaccacaatttttttttttaattccacaaaaagctttataggcaatacctttgaatgctctagaatactcagaatgtacaggcaggtggttaaaatgcagctgctttttgaactggcagtttaggtagcactagatttggatccctgacgccaggcaggaaggcatcagtgtggcatttcctgtgtaactatttgctcttactattggctctcgatcagcagatgaaaatagctttgttactaagaatgggattttgcccccagctgggaagagactacctcggattgtcttcctcttactggggtagacacggctagaagaaaaccaaccagcgtgaagaaaagcacaaggagattcttgttagaagaaacttcatggtctgattcagtagaactgcctcgggcctggtctttgtatcttgtatcactgcacaaagaagggaagaataacttttgaaaagccaaattgttttacaatttttctttctacttaggttatttctgaaatgcaaagaaagaagaaataaagctactaagatactcatggcaattaatagataagcatatatacttaaaaatatggctactccacttcaaaggaacattcttccccttttgagtacatttatatctattaataagtgtatctaaagaattttttttccacagaggacaatgttttcaaataatctaatgaatgcctttttttgtcattgtttaagaatcagttaaccagtctagcgctttgagaataaactgtccaacatcttctcttaagaacccttaagtagaccaacaaattgatggctagcattttgaatacgatggacttaaaggctcattacttgttttctatgctatcatcatttttgacacacattcttgtgtcatggccctatttcattatagaatggcattgtggagtaaggatgatattaaattttaatgttattgctattattactgttgaccgtttttagcataagtatgcctggttctttaattccagcttctgcagggccagaaaatagaagtgagcataaacagtcaggaaaattactgtatacccaggagacccagcatcgcgtgctctgcctgttgtgaatgaggaatcaaaatggaaaggttatcattttcattagctaggaaagaacaagaccatacttttctccaagtgtaattacagcggttcactggcaacattacactgcagtaattagtctaaaggtgtatgtgagggcaggcttttgcacagacactagaaatattatttcagagttgaaggtcacagccttgtatttaacatgttccaggcagcttaggggggaaaaaaaaaaactaatttgactggagctaaagaaagacatttgacatttcccagagtcatacattcagaaaccagtcaggtcgaaaaattgtattttattttctacaataaaaggcaaaacttagctgcagaaatagcatgtcagaatattctgtaggataagcacagataaaattcaagtttattagaaccatgatgtaaatgattacaggaacttttgatatgtgtggggttttttttgtttttttttttgagacggagtctcattcttgtcgcccaggctggagtgcaatggcgtgatctcagctcactgcaccatctgcctcccaggttcaagcgattctcctgcctcagcctcccgagtagctgggattacaggcatctgccaccgcacctggctaatttttgtatttttgtagagatggagtttcatcatgttggctaagctggtcttgaactcctgacctcaggtgatccacccgcctcggcctcccaaagttctgggattacaggcgtgagccgctgcgcccgggctgatatgtgttttaatctttgccttaggaagagaatggacagaaaaaataattgtcagcagctcttaaagggaaacaaaatagtttctttcttccttaacaccattttcaagaaacaaatgtctatcttacacaggtccatatatctacgtcctttgtgaattttttgttactctatttaaatagtaatattgaaatctttttgtaactcagcatctcagaatagaaattgattgacattattttccaaagccacgtcaggctttctgtttaagtaaagtgaaagtaagaagaaaaaaaagttataaagagaagagcaactttacatacagtttatgtttaaagccatatatgagtttaagagaaaccttttgctttttctagtccaaagaatacttttgcaagcaacatttcttactgagttaaaagtattagcccaaataccctgatgtctttgtttaatttgagtaatgtctgcgtttcttcacacaattctgtttctctctttatatccttatatagccttgtagaatattgtttgtttcagggcaaatgatgacttagagtgtacttgaggaccattcattcagcaaccaaattctgttggaaaccactgctttttaaatgcaagtgtgtgttttatctgcactctctggccatatggttagaactgatgtttttcacaacttcaggcacttgggaaatttaagcatagatgtgacacaaatgacacagctagctgattatgtaacttactgaaaaatctaccccaaaattgaatttaaaaacattgctatttgtttgtcacagacgtttctctgctcaaggaaaagtcatacactgcagaattagatccgtgatgttgtaagttttccacagctagcaattaaataggaagcattgagtagtgggaagagttcaaagacttccctttcttctgccactgccactgccactgagcaaatcacccatcttgccagaccttagttctctccctgtgaaatcagagagattgctaagctccctccaacatcttactttctttgtctgtctaggggaatactgcttttattttctgcctttgtggttttcattaaaaaaaaaaaaaaaagtataagagcttttctcatatcttttcaacaaggcctagaaaattgtagcacactcattctttcacagctgggggccgtgtttcccagcagccctgagaggtcagcagtaatgcagggtcttgtagagacgtttcctgcgccttccttcactttagtgaccgagtcagagaaagcaagggatagttttacaggaatatttttataattcatttttcttttttttttttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccaccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccataattcatttttcataaaatatctttaaataacgttaaaatgatgaaatgaagttctgtacatcctaggaaaaaattactttctctacttacatttgatgaataaattgtaaagtatgcctagcttgttaaagcaggtgccagaaccaacagccactttcaaaagtccatagaactgaattcagtaaaggaataagctctgaaggtaagaattgtcccttacttcagagagctacaatcaagttactacaatcagttactttcctgacagatctcttaaaaggcaaagctttgtaaatggaaactgagtttcccttggaaatactatagcatttgtattctcaacagaagcttttaacctctagcatgttacagaaattaaataaacatcattttatttaaccagccataaactatatgcctataaacaaatcagaaggaaaaggacatctttcttaggattacaagaaaatactttgttgagagttcctttttttttttttttttttttagagataggatctttctctgtctcccaggctagaatgcagctgtgcaatcatagctcactgcaaccttgaactcttggactctcaagcaatcctcctgccttagtgttccaagtagctgggactacaggtgtgcgccaccacaccctgctaattttttttatttttttgtagaaacgaggtcttgctatgtggcccaggctagtctctaactcctgtcctcacatgattctcccaccttggcctccccgaatgctgggattacaggtgtgaaccaccaccacacccagccaagctttgttgagattttggcaggcttctttaaggaaacttcaagacactcaatagcctcttgagacaccttgtaattgtttcctggcaggtactgtattgaaaatcaagttgttggtttaagtacaccaagaaggtagctgtaatttgcagagggctgtaagcatacatttactgtttaaaaagagagagagagagagagaacaagagagagacaggcttgattagagtacataatttccttcagctaattcctatgaaacctttggatgtgctgatccgcagcctacagatctaccttcaacaatgacttaaacttcacaattgaaagatctttaaatattgtaatccacctccccttcaacagccctactctcttctccctacttccgtcccacttctaccaacctctcatttttagatgaggaaagtgaaggcccaaaacatagtcaggtctctttcatctcaaaaataatctcactcagaccctgtgtctttgtcccctactgaccaatccatatatgtggcatctgttgatttcaaagaaccctcttcagacttttttcccttgggttctgctagaactgtgtgcttctgcttctgacctttcattgtccatccatcactttcccctttcttcctatccttgaatgttacaattctcttgacgccacccaccagaccattctttggacttagaatttcagttgtatcttaaacatttctgctgaacaattacattgtgctctgtcttagttcattttctgttgctataacaaaatacccaagactggataatttataaggaaaagaagtttatttggctcatgattctggaggctgagaagtccaagatcaggcaacccatttagtgagggcttcaactcagcagaaagcagaagggctttcaaagagaccacacacgaaaggcagcctcacattataacaccaggctctcatgtgaacttacccattccctcaagaactaactcagtccctggagaaagacattaactgatcctaatgacctaatcacatcttaaggacactgcctcccaacactgttacattgtcaattaaatttcaacatgagttttgtcagggacaaaccatagcaggctgccagtcacacattttatgagaaccatggttttcaacctcttccttacttgcaggattttgtccatttttcacagtgatgtaaccttttcctgttggtagtttcagctgttaggcaaggatctgtcagtgacggtgaggcagccatagaagtttgcttctcagatgagtgtagagtctctttaagacaaattctgatcccttctagtggactacctctgccattagcataatagataactgagtggtgtggtcttagagtcctgaagatatctgtagccttgccacttttctgcagatgccctgccttagttctatgactagaacttccttactcagatagcagaggcactgtttggatatggcaagccaggatgattactctcaattttgttatgtgagggtctttaaccacacacggctaccatatggggtgggagagacagcatctagaaagtgtaggggaagtggctcattttaaaaagaaatttgaggcttgtatatgtttccttagcccacaagttcctttgcaaccaaggtgaagttgcatcttccagaatgtcatctgaactcattcttccataacttcagtgttgactttaatattatttggaatagttgtttctcttaaaggttgtatttgattttcacttcagtgtgacttcattcattaaaaaatattgagggaagcatttattattttttgtttgttcatttgttgagataggttctcactctgttgcccagactggagtgcagtggcatgatcaaagcttactgcagcctccaactcccgggctcaagcaagttttatatatttataatatatatgtatgcatatatttattttaagcagtggggacggattgcagcagcttttgatcaaagccctagccttcctaggctcagtttttttccgtatgctctggagattttgtttagagacagagtctcactctgtcacccaggctggagtgcaggggtgcaatctcatctcactgcaacatctgcctcccaggttcaagcaatcctcccacctcagtctcccaagtagctgggactacaggcacatgtcaccatgcctggctaacttttgtatttttagtagaaacagggtttcaccacgttggccaggctggtctcgaactcctggcctcaagtgatccacccgccctggcctcccaaggtgctgggattacaggcatgagccatcgtgcctggcctctggagatgttttttttatttatttatttatttatttatttatttatttatttatttatttatttgagacagggtcttattcagtcaccaatgctggaatgcagtagaatgatcacaactcactgcaccctcaatctgccaggcccaagcaatccttccacttcagcctctcgtgtagctgggactataggcacacaccaccacactcggctaatttctgtattttttatagagacggggttttgccatgttacccaggcggtctcaaactcctggactcaagtgatctgcccacctctgcctcccaaagtgctgggattacaggcatgagccaccgggcccggccactctggagatttttaagggccttgccaatgagactggggacacaaataggatgactcctcagttgaggacacaaataggatgactgaaaaggtgtttgccactatgaattagtgcacattgcggttctcctgagtctctttggcaaataatagttaaatactcacctacaaatagttctcttatggttgattaaaagcccagctttctactatataaacatagcaagtctttttaactctgtatatattactgtcattgttatcatctccagatgaaatagagcagcccaaacatgatgggccttactctccacgttgattctaagaagaagaaagaagcagcatagttttcagtggctctacaatttcacattgttgttaatttcctgaaaacttgatgttaaatgaagtgtaattgcagatttccttaagaaccattgacagatacttatcctaagtcataagcaactcacactgtgaaatgtgtgcaaacattctaagttttcttctagaagaatatacttcagtgatacccaatattcaccagccctttttgataaacagagccattgaagctcaacatggaagttgggggaaatttctttttttacacttgatttttttaaggggattaatgttgccagaacttccattgtttttcagacagtgaaaagagtctttagtaagtgtcatctcagagaccttacaacttttggctaagagggctatattttgaatgagatagtaaactagatagtaaattatggtgtatttaggtactggcattgtatgatagagaggggagtttgatttgttttttaattgttaggtggtctatttagtgcagctgtgtttatgtttccttcatggtaaccgcctgaacatggtgacaagtccctacaaatgagaataggaattttaaaaaattatcttgccagtgggctttaatttgggggggtcataattattaagtagcattggtaaaaataatccccggcacagtcattcagtacagttgttttgctgtatcagacattttgacaaccttgtaaaaagagtaactgagtccaggcatggtggctcatgcctgaaatcccagcactttgggatgccgaggcaggcggatcacctgaggtcaggagttcgagaccagcctggccaacatggcaaaaccccgtctctactaaaaatataaaaattagccgggcatagtggcgcatgcctgtaatcccagctactcgggaggctgaggcagaagaatcgtttgaacccgggaggcggaatttgcagtgagccaagatcatgccactgaactctagcctgggtgacagagtgagactctgtctcaaaaaaaaaaaataataataataataatacttgataccttaagtgctgcatttcacagtagaataaacttggaaattatagaatttccttagaatagtcacacttctttacccattgttttggctgatttacttctttgctattaaaaatgggtgcctagatcataatgtacatcaattctgtggaaaattagcaattccatgtttttgctgtctttctctttaaaaaataataaatgaacatggggtcatgactgcagcaaagagacagttgcctgtgacagagaaaatgtatataataagtaaatagctctgtgaattactcagtactttcagaattgtatgtaagatatgaaatgtggaggtgcaaggtcctaatgactagttttccgaggcattttctttagtgttacatccctcataactcaaatgaatgtttattactattctttcatattgccaaaatattttcatgaatttggattagaagcagcttgttctggcttgttttgcaactttgtttcaggaaacaaagtgatatttagaagatttttgtatgtcatagaagctttaattatcttacttatgttgaaggagatcaaattctgtttcagagttatgtaagaaaataagagtttatactatgctaattttatgttgccagataattaatgtctttcaaaaaatttgaatccgtgatttgaacagggttcgctgttaaataaccagcaatgtagagtctactttaaattcaagaagacgctacttggtccagacctacctgggctagcctttatttttatttttggattcacaggtgtttacccttatctttcctttctttccctccccttctctccacagattggtgaaagacaacaagtgttagtaacagaagaatcttttgattccaagttttatgttgcacacaatcaattctatgagcaggtaagaggcacttcagtattcttgagttttctccaaagtgagaaagagttctgaaagtttaagcaaagggcatttaaaggggagagtgttgaatcttgtcacaacaaggctgttttatcgcttcaagccagccaggctaacatggactttatctttgtgacttactctacaatatgttctgtacaaaggaataggtgtatttagtctattttagttcacattaatctttgacaggaccagctttaggcttttgggcgtttggaaccaggcaattagcactgccagaattcccacaccctggcaaagcaggggggaaagtcctgctcagaccacaggaaggatgtctgcatgggcgacagcagcatgaaagggcagggatttcctctcgctggtacatcacccggacagtttttttagttggttggttgattggttggttggttggttggttttttagttttgtttagttttagcatctgtttttttaacttctaccttaataaaaatgctgggagcagaggaaaaggagtctattccttggactcaactctaattgtatgaacaactgtgcagaccagtgtgaggatcaaaccagcttcactgtgagagctttgaaggccatccctaggggcgcccccaattactagccctccttccctggccatctaagttggcctgcctttgcccaccgaggagcctgacttctgtttcagcatcagggtttctactcctccaggtgggagagcaattcaaaagtgactgaggaaaagagagtgcctctttcagggtcattgaccctggcaagggccaaggccagggaagagatgggatacgccctcctctcccatcttatggtagcctgtgtctcccatctcatgatagcctgtgtgggagactgtcatgggcgtacggagattttcactgatcattctggattgtattaaaatcaaatggagcttcctacttttttgcttctttcttatcagataagaggtgaaaatgtttgctatggatcatggctggaattagagcttgagaagatgctgaaggccaaggtggacaagtcggatgagggatgggcagaggaagcaggctgcctgtgtcagaaggcaggaaagcaggagctgaagaggcccccagcattgacattccccagggaatcatctcagactgggcagtgcgtccccaggaaacaggggagcttttcaaagcccagactaaacgtgctctgttcagtaccggtggagactgcagttgaggaagggctcccagcactccatgtctggcctgcatcgcttccccatttccccatctcattaatataccccagagggccattttcctattcaggccaaccttctgctcagccctggggaggagcttgattgcattttggttgcctcttctctctcctttctcttgccatctgggttttgcctcagcagggaacttttttcccttcattttaaaggcagtggcatgcctcgttagctgcttcctccaatttaaagcagtcgggctttttccaattattaaaactggaggaggggaaaacactgagcccttcattcagatcaaggcagcagatcaaggagggttatttttccccagaatagtaccaaatctcccagggttagtttggtctagagattttcttattttataaaaactgatttaaatgggctttttatatcctaacactaaagctcttttagttctttttgcctgccctaagtaattcaccacccaggtgacctttttcttctactttgatgaagcagtgtactcagtggtcataaaaatcaaactcagaccaagattcaattttgcctttcagagagattggctgtggaactcctggctctcatctgacttttctgtctctataactaagcatatcaaagattttctaggaattatttttctaaataagatgagttccagagatgaagattgtatctagatatccaagtattactggattagaactggtctatttattttggattctaacttgaaaagactggcaagtcgctgcagtgctaaaatagaagtgtaagggagacatcacacacacaagctacctgtgggtcccaaaggaagggaaacgtttgcttgaagtaaacaagtacttttatcaggaatctctagtggaaagagaccacctgacagtttcctgtgaacaagccaaagtacccttcagaggactggttctagatggaggtagattcccaggactgacaaacacatgccttttctaacagagcaagggaaatgaacggcagctgttagtttcaggagtcatttagctccaaacagcagtgtacagtgttattggaaggttcttttaaatgtacctccttctccctcaaaacacagcacacacatgcacggacacaaacacgcaggcctgtttgaagtgtcttttcaaaccattactctgacagctcacttggaaagtattaaaagtataaggctttcatcagtattgtctcggttttcctcattgcatggaatagccaaaagcaagatatcaaaggcctgtccagaagtggctggctgattgctgggggatttcccaggtctgccttccacgtgcctcaggacatcaggcacatcctgcactggaaaagcactgcccaggggcccaggagcccctcccaggagtgcctttccttcctgcaggctctgcagacccttgagcagctagaagatagagtccactttgtaggggatcccagaacagaaaaatgacattgagggacaatgaggaaacctggataattaggtatgccttcggttaataatattaatatatcaatttgggttcattaattgtggcaaaagtgctatactaatgtaagacggtaaataataagaaaactgggagttaggtatacaggagctctccatactatctttgcaataattctataaatctgaaactgttctaaagtaaaatgtttatttttaaaaattaagcctctgaaacaaatgtgtttaaggttttagtgccaaagaaccctgcgttcatggggaagatggttgaagtggacatctatgaatcaggcaaacattttatgaaagggcagccagtatctgatgccaaagtgtacacgccctccatcagcaaaccgctagcaaagggagaagtctcgggtttgacaaaggtaagtaaaagatgctctcctctctaccctgctagtaaaacagcagctgtggaagcacagtgattccaggccatgtttctgttatcatttatagttccctttttatgtatgcatgaggctttaatcctttctgacagattgaaatctgaattagaaagatgtgtttttgctgatgccgatagctttgcttctctggctgtaaagagaataagctctttctgcttccagtttagaagcagggggtaaaagccattatttgcaggtgaaaatgttgacaccaaaagatgatctgatccagtatgtttctatgtcagtagatcctgagtggaaggggatgaagaaaggggtgttttcttgctttacaaagctgtttatactgtagtaaaaacctacagctgaacaggcactaaaccatatcatatatgcagttatggtgcctttcagaagggtgttagctggatatctactttagtcatgtggagtgaaaattaaacatttttttctttctataaaaaagtaacctgacccctattttataccttggtaaatatggccgtttgccaagctctctcacatttcattgagctacagttgtaaaagctgatggagtgtgaaatgaaaatgtgtatcacatttctaagcatcatttgatgtcctttctccaacacaattgttaagcgcttaaaaaaaaaaagcatataacagtgatttaacatatggaaaaaaataactgatatttatctggccatgtaattccgaaattgttttaatctgtgcataatcttgttcctcaaaataaattgcaaggacatgttcgttaaaataaagggaataccgcttcactctggcaatagtaccgcttcactctggcaatagcaacaaagacaatactattgtctgtgttctcactgactgtggcactggattcttgtgtccgacagcagtgataattcacatgtgcttcacaagtgcccatgaaggatctgcgtgcatggccgtctaacccgtactggaatggtatagaccagcttttgttaaaatcctaccaaatgcatcagcctgcatgatcaggagataactctaaaacttgataaacataaccattcatttttgctgtttattaaaaaaaaaaaaattgtacttgggggatagtatgggtggccaggaaggagcagtgtaacctggcatttaaattatattgctagagatttggcttttgatatgttagccaatactttgaaaaattttttaagaagtcagcttattttttgttttgttttgtttttccacatagtgtgttttacaaggttaattttagattgccacagtgaaaagggtttctcagcaagtagcagtagtggggaaattattatttcaaagactctgcctggtttaattccttcatgtttgcctcttggaaagggagtattgtaaacatcaccattgataatacataaacaaggaaatgtagtgtccctctattcgttccttaactatagtgttactgtctaaaagggcagttccgtttaaattctctggggcaccctttctactctcccatcctttcctctagcctagaaaatggtgttatcagttctaccaccagcccagctctgaaccagaatggcccaaaagtcccggataagatgaggaagccagttggttgctggtctgttagagcctctagaaatagtgttgtagcatgaggccagtggggtaggaatattgatttgggtatttacattaagagaaacagtaaggcttttgttggttcttgtttgtttgtttgttttgagagagggtctccctctgtcacccaggctggagtgcaatggtgtgatcacagctcattgcaaactctgcctcctgggcgcaagcaatcgtcccacatcagcttcctgagtagctgggactataggcatgcaccaccatcctggctaatttttttttttttttttttttttttttttttttttttgagtcagagtctcactctgttgcccagcctggagtgcagtggcatgcagtgtcagctcactgcagcctccaccccccaagttcaagcaattctcatgcctcagcctcctgagtagctggaattacaggcatgtgccactacgcccggctaattttttatttttagtagagacagggtttcaccatgtcggccaggctggtctcgaacccctgacctcaggtgatccgcccacttcagcttcccaaagtgctggaattacagacatgagccactgtgctcggccccagctgatactgtttattttttctagagacaggatctcgctttgttgcccaagttcgtcttgaactccaggcctcaaacggtcctcccaccttggtctccctggcatctaaagcaaaatactgtgctttggacttattttgtctcacttgacctcttttttttttttttttttttttttttcctgaaatgaagttttgcttgtcgcccaggctggagtgcaatagcatgatctcactgcaacctccaccttccaggttcaagcgattctcctgcctcagcctcccgagtagctgggattacaggcgtgcgccaccacacccggctaatcacttgacctcttttgatgaaattgatgagaggtacaacagattagaagggtgttatcaaaatgatggtgggaatgggtgaaggttatatgcacatttttagtgaaaggggcagaagaataggaaacttgagaaaaacacagttttaagatgctaagaacatcaatatttttatcttgtgctcacatgcagcctaatttttcctgaagaaaaactgtagatagacaggacgtggggtcagcaataccaaatccatgaccatgtaatagtttgaaaaattatctgaaagccatcatcaaagattgggatcaaggatttttttgtttaattccattatggaaatctatttatggaaattttatgaacattttcaagcatacacgaaagtagagagaatagtataataatcccacatacctattacccacccttagcagtcatcagatgacagccaatcttatgccatctgtgttcttatctacccctattcccccaaccctgattattttgaagaaaatcccatttacattttatttcatctagaaatatactagtaaatacctctaaaagataaagattccttttacaaacataatcccaatatattgtcaaattttaaaatcattacccataattgttattggctaaatactccatacctactgctaggaccctaagtcaacatttatggcgtgcttatcgtagccaaataccatgctaaatatgctacatgtgttcactcatatcgccctcataaccctgagaggaaggcactattattatccccatttcacaaataaggaatctgagcatccataattcaataaatagcttatctggagtcacaaaatttgaaggtagaagagggaagccaggatttatatccccactttcaagcctttgttttcgtttttgtgtgttttaattgtggtaaaatatacgtaacataaaatttcctgtcttactcatttgtaagtgtatagttagtggtgttaagtacattctcattgttgtacaacccatctccagaactttccatcttgcaaaactgaaaccctgtactcattaaacaataactcctcatttcccccttccctcagcccctggtaacttctaatctactttccgcctctatgaatttgattacttttggtacctcatatcagtggaatcatatgctcaccagtgtttgtctttttgtgacttgcttatttcacttagcataatgtcctcagggttcatccatgttgtagcacgtgtcagaattttcctccttttcaaggctaaatactattccattggatgtggatgccacatttcattaattcattcatccattggtggacatttaggttgcttctaccatttggctgttatgaataatatttgctatgaacatgggtgcacagatatctcttcgagtccctgctctcaattcttttggatatttgtgcagaaataagattgctggattgtatggtcctctatttttaatcttttgaggagctgccatactgttttccatggcagcggtaccattttacatttccaccaatagtgcacaagggttccagtctctccacattcacaccaacacttattttctcttttgttttgttttgttttgttttgatagtagccatcctaatccgcatgggtcaagcctgttttgttttgttttttttgagacagagtctcgccctgtcgcccaggctggagtgcagtggcctgatctcggctcactgtaagctccgcctcctgggttcacgccattctcctgccgcagcctcccgagtagctgggaccacaggaacccgccaccacgcccagctaattgttttgtatttttagtagagacggggtttcactgtgttagccaggatggtctcgatctcctgacctcgtgatctgcccgccttggcctcccaaagtgctgggattacatgcgtgagcccccgcgcccagccttttttttttttttttttttttgagacagagtcttgctctgtcgcccaggctggagtgcagtggcgcgatcttggctcaccacaagctccgcctcccgggttcacgccattctcctgcctcaacctcccgaatagctgggactacaggcacccgccaccgcgcccggctaattttttttttttctttgtattttagtagagacggggtttcaccatggtctctatctcctgaccttgtgatccgcccgccttagcctcccaaagtgctgggattacaggcgtgagccaccacaccggaccagtcaagcctgtatttttaagcccaggtccatactgccttgcccattttaattgcaggagtcttattcgataacttctggacaccagtttctttttgtataccagagtaaacttacactggatacaaaaaaataataagtaagagagagagggaaaaaaatgagaaaatgggcagttttaattatcttctctgtgggttcagttaaaaatggcattagagatctgtctctcttaggaatatgcgacaatgtgaacattactgctgtctgttttaataaaggctaactagttttactactaatgttctttcttcttgtctggcctatgttataacacatcgcttgaatcttaccatttctaagattgattcttaagaagtcagaactattctttgcctggtacgagatagaaaagaacattttctcttctaattttaaacttatgaatagtttgattgcaaagttttttttcattgaattcattcttagtagtaaaaattgctttaaagaaagaagtagagtagcatcgtggaagattgaaaggatctggagtctgtcaggtttgggttctaattacagtgacagttgctatgatcaagtacaactttcttgactcacagtgtcttcatttgtataatggagctaacaactgatttgcagaggattaagttaaatcatgtagacaaagtgcaccatgcatagtaggtatattaaatattttaaagaaagaattcagtaagtatcactttaaaaagcagtggtttcctggcttttattttgatttcttttactttaatttcttttttttttctttttagacagagtctcactgtgtcacccaggcgcgatctcggctcactgccaccttcgcctcctgggttcaagtgattctcgtacctcagcctctggaatagctggaactacatgcatgcaccaccacacccagctaatttttgtatttttagtagaaacagggtttcaccatgttggccaggctgctctcaaactcctggcctcaagtgatccacctgcctcagccttccaaagtgcagggattagaggcgtgaggcaccacacccggcctactttaaatttttttttttttaagtactttgcagcctgatgcagtggttcacgcctgtaatcccagcacttcaggaggccaaggcaggaggagtgcttgaccccaaggtttaagaacagcctagcaccattgggagacttcatctctataacaattttaaaaattagccgagtgtgatggtgtatacctgtagtctcagctacttgggaggccgaggtgggaggatcacttggccccagagggtcgaggctgcagggagccactgcagcccagcctgggtgaaagaatgaaaccttatctcaagcaaaaaaaaagtactttgcgttcatggatttcactgtacattatagtatagcaattaagaacatgaattctggattccgattacccaggtttgaatcttgattctactattacaaaaaatatgatcttgggcaagttactcaatgtccctccacctcagttctccctatgtaaatgagtgatagtactacctgcttcataggatatacatggaaatggcttagcagtcaataaatattgactactattttcattattaatttgtggtgcatgccaaggcattattttactttaacttgtgaagtaaaagttgcccaatatcttatcatttcaaatgttgtattcatcagccatagatttctgacaatggcagatgaaaccagaccaactgctgagattcctccatgagaatgacaaattaacagaaggagattccaataatactactacagcgttggccattcttacggacagacatttcttcctcttactctttatgtctttttttttttttaaagagaatattctagaatggaggcctggacttaccattctctttcttacaagttaagagaaggctgccccagggtgcctcagtgccacctgtttctcatctattgagactttgatcctgagaatggattcacttgagcagttagatagctcagccctgacacagccgaccgcgcttggaaaggaagcagaagttttaaagggtggcatggtttgcttcattaccagacaaaggccagcaggatattcaggtgtactgagttttatgtacaaactatactatattctcagagctttgacccttggaaaaacacagttaaaatgttttcctctccatctgacattcatttccagaaccagtgaagtgaaagggtctattagttcaaggccagatttgaaagcacatgaaaactacattcatgaggttaagaaatggcttaataattaagttaaaacacttgaaagtgggtctaatttcagacaggtcagctaaccgtgctagaagcaaatgagggcgtgtttcttcctatttttccttccacccccaagataactggctcccaagcagttttttctgttccttttttttcttactaaactttatgtgagactaaattcttcatcgctgctaagttcacgtcacaaacaattaaaaccatagtacgtttaatattttatgcatttttctttcattttgtatcttgttagtttcttttacagactggttaggacgtatttgagtttcacagtctagatacatagcttttattctatgctgctgagctatattttattgaccgttgcagctgaattagtatgactgtcacttcacactgtgtttagtgtgtttacaataccttccgtgtaccaatttgagtaccatccaaagtatcatcagagcaagctgatgctaaacaattagctttcatttcacttgcatcactaattgtgcaatcactgatgataattctcttcctcctgagggttgtagctggagcatcgtgagggaaattgcatgcatcagggaactaattgtgccttgataataataatagctaccatttagtgaaccactactatgtgcttggtattgaggctctttactcgtattacttcagtttattattctagcctggcctagggcagctagaacacgatgaagttctttatacagctgtacacacccacatagaggcatcataggatgggactgagcaggcattttccccacctctccatcctttgtccacgttcaagataggaggcagaaggagcagtgagcctgggacaaagacgtggaccgacttccctagctaagcgctaaggaaaagaaccaggcccccgagcctgaattacttacatatgcaacatgcaggtagcacctggcctcttataatatgtttcaatgtttattatccaggaacggaatgaaatcttagagatggaaataatgaatatgggcttggtcttcgagaagtttttggtcttggctgttcctctggtaatactgctaatcaattgtgaccctggtagggagggattggtgtgagggaagtggtcttgtataggtatgctagctcacctgtgcgacataattactcctgtggttaaagttttatggataattttcccaaatctaaaagggatcccttaagagcaaaagggattctttatcatgaaagcagtgaatggaaaaaaagcctccttaggagaaccaaagatatatttcagcagcagcagaacctgaaaggtcatctaagcccagccacctatccctgcaggatgggactagggaggttccagaagaccatgatttcctgtgatgatttgaacccaggtgttgggaaccactcttccacactcacattttcactgcactatttccccttcacatgtctttaccttttcactcagtcaacaattatcaatgacgagtatgacactgtatgcatcaaagaactaattgtgccttgataatatctgtctgtgtcaggactgtctgcatcagtcctggtttatacgtgttgtaatagtattaataatatgcccttattccactcctcaaagtattctagtttggatgataaattatatggtcatcctataaattccaaaagttgagccagcgctgtgtcaagcactgcttgggatacagaagttggagataccatcctgccctcaaggagataaagtctagttgggaagagaagatatgtgctgctgtggtctgaatgttggtgtcttcccaaagttcagtgttgaaacctaatcactcatgtgatggtgttaggagctggagcctttgggaggtggttaggtcatgagggcggagccttcatgatgaggattagtacctttataccatactaatgaaggctccagagagctgccttgacccttccattgtgtgaggacacagcaagaagactctgtctataaactagaaatctggcccccaccagacaccaaatctgctggcaccttgatcttagatttcccagcttctaaaacagtgagaaataaatatctgttgtttaaaagctacccagtttatggcattttgttacagtcaccgaaacgaactaagacagtatgtacatatgaaacaaaatctataatatgtcaaatgttaaattggttggcgttagatcataagaagttggaagataggagatctctgatgacttgaggtatcaggaaatgtatgggtcaggattctttgcagacaacagagagcagtttagttaaacaggaaggaatgtatgaaaggatgctagatggcccacagaattgttagaagggccagggaccagaatctttgctgagttttccagaaacaacacccagaaccacacaggagcttctggtaagaggtgtcgcctctgctccacctcccccagcaaggcagaggccccatgccccatctgcttcctcatgaagcttcccagtcaatgtctcacatatatcacatctgactgtggaacccaagtctcacatttacaccctggggacaaaggaggttggaaaatcatttttggcatctgtagtcatggggaactgtcaatgtggagagggttttcagacaacttctactacagagagtttcatggatatggactttgaaggtgagaagaacttaatcaggcaagtaaagaaggaaatttttctcactgtgaaaggaaccaacgcaacgtgacagaatgcacagactaagaagttgtgggcagttggaaggcacagggaaatcacctttagtataaagactgggacctctgggttttgaagtcaaataggatttatacctaagacattagacaagcacatatattcgtccaagacaggttaggctgcgcttcggtaacaaattaaccctgaaatctcagggctaacataacagaggtttatttcctgctcacactgagcatctaagatgtaccatttagtttgtagtttagagtcaggtagttgtctgctccacacagtcactcagggacccaagttgactgcatgtctccatggtaaggaaagacgattgccggtgaaccaggctttttactgcctcagcacaggagtggcacatggtatttgtattcatattcattggccagaacatccacatggccctgtctaactacaagagtctagaaaatacctacttttgttttaataagaaggagaagatatgggtgaatactagaagtttctatcatgcatgtgggaatattttgttttgctttgtttttgagacagagtctcattctgtcacccaggctctggagtgcagtggtgcaatcttggctgacttgtagtctctacttcccgggctcaagtgatcctcccacctcagcctcccaagtagctgggacttcagacatgcgccactgtgcctggctaattttttttttattttttgtagagatgaggtctcattatgttacccaggctggtctcaaacacctgggctcaagcaatgctccagcctcagcctcttagagtgctgggattacaggtgtgagcctccgtgcctggctacatgtgggaaagtttttgggcatgagcatagtatagtgaaagtttctatatgagggaaagcccatgaaagcaggccccgcctgactggtctgcccacgactggctccaggccccagtgcagtgcctgtttcatggttattgaatgaacttggctctcggcgatatgcagggtggaatggatgggttctccaccagaggcagggaacctacatgataggttgaaatcctctgttactccagctgatgaggacattaatatattcttcaatggttaaaaaaaaatcacagtcaagccactcaacctactctttgaagtcatttgacatcttgataagcagattgcaaaagcccctttttaaactgatagtaatcttgcaaatggaaattcttttcatgggaactatgaggatgagtactttagagcgagttgcttctaaccataaattgtagtttcctagtttcccttctcactttctaatgatgaaagtgacagcctatctctcctatgagactcagagtgtggatgttgcattgtacctaaaataatagaacattatttttaaataaataaaatagaatatgttcaaagaaatagagtgtgtttgttttctaacatagtttataatgtttaaaatttttttcattatttttaaatttttatgtatttagggggtacaagcgcagattgcttatatgcatgcaagcagtgttttaaatttaaagggctttggggaaacaaattttctcctgtccctctctctcctgaatgcaattctataaaattattgagaaacagaaattttcaatccatatatcaaatcaggtatctagggcagttttctgataggaagccaacctaaaaatttaagatgtagcaccttgcaaatttgccaacccctgagaaggaaattcaaaaggcaataaaggcaaagaaccatcagccgactttatcaagatcagcattttcccttccacaggcccctggctcccagggcttcctccttgaaaacatccgttttgaaggaatagagtagcccttacgcacatcaggtcagaccgtgggtttggcattttggctctgttccttactaattgtgatcactggtcacttaccctctctaggtgtctttcctcatctataaattgggaggaatagagtccatttgataggatggttttgatgtcgaagtgagataaagcttgggaagccctgaacgctgcctgacacgtagaagtgatcagtgaatatgtgatgtggagtggggggcatggtgatagtgaagatttacttggggcctggttgatcaagatactaataatatctcgttcatgaacatggatgatgttttgccctaatcacctatatgccatgagacgaggaattggtcattggtctttttaaacatacagtctttataagcagcaatagcatttgtaaaggatagctgcctgaaataaattctttgagtttttcagttcccccttttcactgactttgagtagctgtttcttttgttatccttcatgtgagcacagttcctctgaacaatcacaaagcatctatggtgtaagatagtggcattcactacaggtcttcttctcttaaatattcttgtgggaagtgatttcccctgccgtgtactatattatctgaaaatgaaacaatctgcctaacgagtctccctgtttctaccctgaatataaaccagattgtgtctctctcctcctcaaaaccatctagtgctccatatgactcagagcattccgtatatagccaacagaagggaaaccagggactcagatacttatatcccaatattcataccagcattattcataaataacccaaaggtggaaataaccaaagtatctatcaacagatgaatggacaaacaaaatgtggtatgtagtagaatggaattttattcagccatagaaagacatgaagttctgacacatgctacagcataggcaaatctggaaacatgatgtgaagcaaaataagccacaccagaaagggcaaatattatataattccacttatgtgaaatattgagaataggcaaattcatagagacaaactaggttaaagcttaccaggagctgggcgtggagatggggagttccttaagggttacagagtttctgcttggggtgataacattttggaaatagtagtaatggttgcacaacatggtaaatataattaatgccactaaattgtgtacttcaaaattgttcaaatgttattttatatatatatatatacataccatataaaaatttttacaaaaatcatctaaggtttcccagcatgttcagaatgaaagccagagaccctacaacagcctcaaggatcaaggtcccatgccttgacctctctcccctcgagaacactggcctccatgctgctccttgaacatgaacacacgaggtctgctccctcaggagggcctttccaactgctggtccctctgcttggaatgcccatctcttagatgtccctggtacatacttcattcaggtctctgctgaagcaccagcttatcagtgaggtcaccctgggcagtcgtctataaaaccccaagccctcaccatccaacacaacctagtacttcctattcttactctactctattttctccatggcacattttatcaccagacatattaaatatttacatgtttcttttgcctctagttaccaaaattgaagccccatgaatgctgagactttacttcattcacctttgtgtccttaatgactaggatagggcctggcagggagcaaatgctcagtaaacgtctgttggatgaatgaatgaatgaatgaatgaatgaatgaatgaatttgttccggagatatatgtataccccttactgaaaaggactgcaagaccaaaaagctggttatcctagatatgggttatcttttgccatgataaatgccctatgacaaccaaccacagaactgcagtggggctcagctgatctcagcctggctcactcacacatctgcagtgcactgtagggtagctcagcagctcttctaagcttggtggggcttcctaaaatgtatggaggttcagcaggcatttggtggatctagatggcctcaactgggactccgtgggtgaatcagccctgctccgcatgcctcatccttcaactggctgacctgagcatgttcccgtggtaaaggcaaaggaatagcaaacagacatgcacaagtgcttttcaagcctctgcatgcatgatgtttggtagcatcctgttggccaagtaaatcacatggccaagaccagggacacactacagagttatgtgacaagaagatacagatacaaggaggtataaggaattgggaatattaatgtattcagtctaccacaccctatgaaatcttggtgtttttgcctgtgatctgcgcaactttcctcctccttttctacgtccccagaagacatcacattcagtttcaacctgagatctaatcctttcagctctacaactcagtgtcttgtttttaggtagtgagttgtagagctggaagggttggatctggtaaaaagaatctgaaatctaaacgttaatggaagctaagggaccttgtcatagtcttttctatgaggaaatgtcaagtgctctagatatccggtgcttttctctgaggtacaattgtacccagcaactcaacagtatcaccctggggacctgtggtaggcagaataatgccccccacttcaccccccaaaggtgatcgtgtcctaatccctagaacctgtgaatatgttagattacatgacagagagaattagggttgcatatggaattaaatttgctcatcagctgcccttaacataaggagggtatacttgattatccagatgggcccagtgtaatcacaatggtccttaaaagcaaaagagaaaggcaggagaatcagaggtcagagtgataggaatgctgacttcgaagatggaagcaggctgtgagcctagggatgcaagctagaaaaggcaaggcaatggattctcccctacagccctagaaggagtccacatcacacttgatttcagtccattgagacccatctgacttctgagttccagaactaaaaaatggtaaatttgtattgttttaagccatgcagtttatggtaatttgttaccgcagcaattggaaactaattgggaacttatcagactgattttatcccatagaatccatgtaaaaaatgagaaggtgtatattggcaggctgggcatagtggctcactcctgtattcccagcattttgggaggccaaagtgggaggatcacttgagccaaggagttcaaggctgcaagtgagctataattgcaccactaaactatagcctggaccacagagaaagatccggtctccagaaaaaaaataataataagtgtgtattagcaaccaagtggctgttcatgtcccatctattttccacattgaccaatcattttaagaaaggtgtggtggatgggtggggaacacctaaggcattgacaggcggtaaaggaaacgtgctaatggagaagagggaggttagcgactggggcccatctaagaaaagaaagagattcttaggggactgcttggagagttaatgtttgcaggaagcccacccacaggtcttgaacccccatcctggaccactttttcttcctttgaccaacccttccccaaccctcatctccagcccaaatcttgctagagcttctaacttacatcacatcagctgtgatgaggacttggtgtggccacttatctgcaatcatttctctagtctgggtgccatacctaggagtggcattgctgggttggccagagtgtacagctcccaccttaccaggtaatgccctcctgtctcccacagtggctatgttaatttctgccattaccagcagcagtgtcatagtgttctggatcctccacattctcacccatacttgatattgctcattttttttactttttccaacctggtatatgtaagctggtatttttgtatttttaacttgtatttctctaattacaaatgaggttgagcattttttttaaaatatatttattggttttatatatatatacacacatatatatatattcagattttctcttcagcaaagagtctgtataaaaagtcttttgcccattttcttctattggacgatactttttcattgatgtttaggatttctttttctttttttttttttttttgagtcagggtcttgcactgttgcccaggctggagtgcagtgatgtgatcattagctcactgcagccttgaaatcctggccttaggtgatcctcccacctcagcctcccaagtagctgggactataggcatgcaccaccatacccagctaagttttattttttattttttatttttatttatttatttttatttatttattttttaagatggagtatcactctgtcccccaggctggagtgcaataacacgatctcggctcactgcaacctctgcctcccaggttcaagcaattctcctgcctcagcctcccaagtagctgggattacaggcgtgcactagcacgcctggctaatttttatatttttagtagagacagggttttgccatgttggccacactggtctcgaactcctgacctcaagtgatccacccgcctcggcctcccaaagtgctgggattacaggcgtgagccaccacatctggctatttttgcagagacgggaactcgctgtgttgcccaggttggtctcaaactcctcgcctccagcagttctcctactttggcctcccaaagtactgggaccacaggcaagaggcactgtgcccagctgggatttctttatgtagtctagagtcaattatatgtgaagcaagtgtctcttcccagtttgcagcttgttaacctctctggttagaagttttgttcttttgtttagaactttgtatatttttgtgatttgtttaagaagtatgtcctccctaccttgtggttagaaaggttttcctcccatattgtcctaaagtttttctagtttttccttagccaggtaaatatttaatatatctgaaattgatttgtaaacatggtaggtaggggttaaatttcattgttttatctgtgtataagcaactgttccagaaaactttattgaaagtctgtctttcctattggtcttcaatgcctctgttatgaatcagatttctaagtatgtgtgaattggtatccagccctctacttggcaactttttgtattagttatctgttgctgtgtaacaaattacttcaaaacttagaaacttaaaacaacaaacatttattacctcacagtttctgtgggtcagaaatctaggtgcagcttctctgggtgcccgtggcacagtactgctccttcggctgcagtcaggctggcagccggggatgtggccttagctgaaggcccaactggggaggatctgcttctaagctcacttttatggtgatggcaggattcagtttctcatgggttgttgctttaaggtcttagtccttggctggctattggtcagaggcctccttccattccttctcctgtggacttctgcatagtgcagctcacagcatggcagctggcttccctcagagcaagcaagcaagcagagagagagagagatggaagctacagtactttgtaacctaattttggaagtggcatccatcatttatgttgagcattagaagcaagtgagtacattcagaccatagccaaggggaagagattacatatgggtgtgaataccaggaggcgaggctcactggggatcatcttcagggctgcctaccatacttttatagtaacataagtaattaagttttttaatattaatctaattttaagtgcctttccataggatcattattttttacttttaaaaactatattcaaaatagaaagggagaatgggcatgtcttggaacagatttttggaagaaagcataatagaactttgggagtgataggaaaatatgtagagatgtgatctttcttcagatggttgggttcagtttagtgtaattatagtaagtacagtcatctcttggtatctgtgggggattggttccaggacccccgatgggtaccaaaattcatggatgttcaaattccttatataaaatgacatagttttacatataaactacccacattttcccatgtattatctctagatgacttttgatatctaatacaatgcctacacatctcttcagattcatggattcaacatagtattcagtgtgtgacaaattcaagttttgctttttggaattttgtggaatttttcccccctgagtgttttctatttgtggtcagttgaacttgtgggtgtggaacccacaaatatggaggaccaattgtataaaccatgtaatttttcctaactagtttatctgcattttccaagctgcaaaactatcatggtgatatgtaggaaacattttacatattagcttctcatttatgagattctttgagatagagaaaagcacctgccgtctcctttattcgttttatgcagtttatagagctcagtgatgctgaaaccgtatttccagtgtcactgaaaatgatactaagaacaggatgagagggttgtattgtaataacagctaacatcacacatgtcttctttttcatttaaaatacaaaccaaacatctgccaacacactttcatggttacctagttggaatgaaacccttaggaacaattattttgagttgaactgatgacttaaagatgaagtttaatacacccaattgttatgtttgtgaacatcctggctcagtgcttcctgtgtgcgctgcatggaatgagaatggtttcgggtgtgagagactattgaaaagatttcttcatcagtaaagcatcttgacccaattcaccttttatttcttcaactttgccacacctgtggggcagctttcattcatactgatgcttatctccagccactaatgaggaatagatgagttcaggtttctactactatcatgaatgttgggattacaggcttcatggttctaagtgtgcctcttggttccttttttatgttaaagctcgtgcgtgcgtgcgtgtgtgtgtgtgtgtgtttgcgagcacatgtgcacttgtccatatatcttaggctgatatttagttagcagaagagacttaaatgacaagttctagaataatttccaaatttccaaactttgacccagtaaataactaacttgtgttttccttatgtgcagttactaagagaaccttttctacgtacctctctttggagaaaaaaatttaaacaatgaggaagcagtaaagataaatgtatctccagctaaggtgccagatctctgatagcataccttcttggcagggcttactttgtggaattggagaagttatgtataaacaaatgccagcgcaccactgttggcaaagatttctatactgtgttattaattctagatctggttcttctgtcctacaccctccccttattttggtaaatgtaacaagccaaaaattaggaaactattataagctcatttgagtgaatatttgttactaagccaaagattaagacagctaaaaatgaaggtattcagatagaagcccacagctggagtgtcgagaatgcattacaaagcctgaggggccacctttgctcattccttcttatgaaggtctgatgcagcagttcctgttagggatgcttaccttaggaggtgcttcctgaagtttatactggagagattaaaatataattgtgggccaggcacggtggctcatacctgtaatcccagcactttgggaggccgaggtgggtggatcacctgaggccaggagttcaagaccagcccagacaacatggtgaaaccccatttctactaaaaatacaaaaattagctgggcgtggtggcacatgcctgtaatcccagctactcgggaggctgaagcaggagagtcacttgaacccgggaggcggaggttgcagtgagccaagatcacaccactgcactccaatctaggtgacagagcgagactctatctcaaaaaataaaaataaaatgtaattgtgatagagatagcttataattttgtattcaataccagaatttttttcatggaggggaaacaaggtctttctctgtcacccaggctggagtgcagtggtgccatcacagctcactgcagcctccacctcctgggctcaagtgatcctcctaccttagcctcccgagtagctgggactacaagcacatgccacaatacccagctaattttgtattttttgtagagagggggtttcgccatgttgcccaggttagtgtagaagtcctgggctccagcagtccacccaccttggcctcccaaaatgctgggattacaggtgtgagccaccatgcccagccaatttcaagattcttttctatagtatactgtactgcataatgtatgttttaagattgtttccttgcattggtcacatatttggtttcagtaggttttctgcagagcccatatgttcaggcatggtggggggaaaaaagcctgttctaaactctaatttatcctgagatctgagctatcaaacaattttttcttcatccctgttagattgcacttcaagctcttaacagtgcctctgagccatgagaaaaatttacacatgagaaatgttttgaagccattaaagtaagttcagagcttaagagttgctttcacatctcttgagtcagatgaaatgcgggcttacagagagtaataattaggtgatgggcagatgccaagctttgttttttgatacgattatctctgtctttcatttggcaccgttcaagtctgcaggttgggcattctgaaagagagggatcactgagaccacacaggggcacatcagatctgttcctttggtggacgtcaaggcagaattactcagaatataatctgaaatgcatttgatcatacagtagatagtttaataatttatgttcagacttattagcaaagccttgtgtttactctgctgtcaccaaaataagataaaaacccacccgtgatattaagattagacagttcgcatgtgtatgtatgtgtgtgttcaagtttaaaatttttgttcatgattgtaatgacctgatagcaattacacatttggggtgaaaggggtaagggaaaaatgtcgcatgaataatgtctgatgtagaatttctcattcccagaattgaaacagaaaggctgacagtattgcgctctaattgcgtgactgtgtgaccgaggtcttataatggaaatgttcttccaaaagaaatggaaaggagcgattaattccaacttcaatttgttgatcctgttacattccagtgtacctataatgctgatggactatgcatacaacattgttttaactgacttcaagataaaatactggcatttttggtttggagataattgggtacagctacttatatgatattaaagagctcccaatttggggaatgtctagaagaataaaggagaaagatagcttggcacccttaatcccctgtatgtcctggtatctggtaataacatgaagcccagggacagggttgtcttgtcaattcaaggaagggagctggcatgtggaatgtgattgcagggccctggtaacacctgcaggtgtcagggacagaagaactcatttggaagctgcaccgcaagatgggaagacaggtggcaactctcttacagggatatcttttatttgagcagaaccagaccaactgttcctcattaaaacacattttgcaacgtgttctcatgtgagcgcatcaagtgtgtgtgcatgtgtgtgttcagagcatactcagcgatgtgccatctacaggtcacaattacaaattcgcaacgtggctcagaactgcaagacaggtagcgtgaaatgtctctgcataacatgcggctgacttttctggaatggcctctgtagggaaactcaaaataacaccattacctctgtgaggtgcaggggcaagtaaaatggataaaatctatttggtgggactgttgatcttgatagtcattgtaataactatgcagtgcccttgctctttctcatttgtatggaattatcaatgtatctcagaagtgttgctgtggggctgtacttagtatgagtaaagccaggccactcatctgcttcaccatttatactatcagaaatttgggcaagtgacttaaagagagggttaactcctattagctacttcactgagtagtctgaaggattagagagcacttagcgtcctgctgggcacatggtgaatgttctctaaatactccttctacttagtattttcacatagagcctatcctctgcctttctcgctgaatccttgtgcttctggttctccagccaggtaccatattacaacttatcaatattttgtatgagaaggaagaggacttggaagaaaggcctctaaacaacatgacttccttccattggaagcccaagcccatccagcccccaagaagagaatacttgtaactaggtgaagaaatgactaaaggaggcaaaggaataagtagaaatgcaaataccagttcagaaaacattaactgatcatctcttgggtgccctttccctcggagtcttgtctcttggggccaaaagacctgtgaggaggacacatctgaaggccctggaggcctgtttcctccccattttcttaggaagcagctagctcagcaagtctgttagctcagcagaaggaaaaggccttagcagaggctcggccgtggaggtttgctgtcctcttcccccaggaaacttcacggtcagccagccacacagtctcctagaggcgccctatccctctttccttgtaaacgtgtagagcatcacacttctgtcagagtgtgttctcttgggcagctagtttagctctgcctgaactgagtacgctttctggtgggatgcaagcttgggggctcacatatgtcaggagtggcaggcacagtcatgtcccccacccaaagatgtccatatcctaatcacctgaacctccaacgatgttaccttacatggcaaaaggaactctgcagatgtgattaagataaggatcttggaatgagaggattattctgggttatctaagtgggttcaatgtaaatcacaaaggtcctgataaaaataaccctatgatcacctgaggtcaagagtttgagaccagcctgaccaatatggtgaaaccccatctctactaaaaatgccaaaattagccaggcgtggtgacacgcgctactcgggaggctcaaacaggagaattgcctgaacccaggaggtggaggttggagtaagccgagattgcgccactgtactccagcctgggtgacagagtgagactctgtctcaaaataataataaacaataacaataataataatagtaaccctatgctactggctttgaaaatggaaaaaaaagggtcacaggccaagagatgtaggcaaattgtagaacctggaaagggcaaggaatcagattcttccctggagcctccagaagaatgcctcccagccaacaccttgacatagaacttctgacctccagaattgaaagagaataaatgcatattgcttcatgccctaggtttgtggtgttttgttaaagtagcaatagagaactcacataacatgctgtttctctgctggtaaggtttttccctagtaaccctatttcatatttatactatgtagtattggtgatgtatgactccttgtcccatttacttgtcagtctaataagaaatgtaagaataggtaaatggcagttcatatggaagggatatttgctcctatataaaatgtgaatatatggtagtaagtaacaggtagcaatggcagtatgcattcagctaacactggcccctcctaggtaccaggtcctgggcatctattggagagaaaggccacccctgctcagaaggagcacgcttagggtgatgcaggagccaggatccagcagggtgctcaccactgttgacacgcgccatgaggagggccagctgacaagacgagcaggcccacacggggtgggcagtggttgagagaggttttcctaaagcaagtcctgtcttagttgaggcctgagcaagcagtaagtagaggaggcaggggcgggtgatggttttagttcggagctttccaggaggtgcactccaccggctttaccatctcagagcccggggagtaagaggtgctgacttcacaatggacgtagcttcttcctcatgggttagtgaggaggtgcaaggcaggacgctgtcatctcagtgttggtagtaagtgctgtgggaggctctggccttctctgtttttcaagctacactcctgtgacgtcaccgtcacagcagcccttattgtgaaccttctgtattccaggcactctgcccggctgtgggcacattacttctattccttctgataacttcctaaggtagatggctttccttcttcacagaaaggatagccaggcttagagagtttaaactacctgcctaagatcacatggctgtctgaacctgcgttcagtttggtctgccacaattcaaaacccatgctcattcattatagtgtgtgcctcttaatggtatacataaggaacaaaaatagcacgggtcaattctattttagaagcaaataaaataatgactttgtaatttacaaaaagaatttctgaggacgtttgcgtttttcattagaaccacagaataccatggaataagttaatctgaattgacatttaaatgttcagaacacttaatctatatatatctaatttaatcctcataaaaaccctatgatgcacaaatactagcagtatctccattttacaggtgaggaaatggaggcaaaaagaggataaaatttgcctgagaatcctcagatggagctgggattagagcccagagctcgaggacttactgctcctagaaccggttccatctgtgccttgtggcgtgaaacatgctcaagttaaaagcatctctttcctttccccaacaatacgtgcacaactgctaaagacgaaggaaatagagatagactgttgttatcatcccaactgtctgtatttatctttaactgattgaaatctgatccctaaagtttctgaacatgaaagttttttttttttttttttgaaattttggtatccatacttggttctgctttaacagattgattactttgataggatttgataagctacacttttgaaaattagtagattatttttaagagttagcaagtaagtagatttagaaattaatcaagggagcagtgagatttacaagggaagacaaacccatgttaatcaaagttaacacagaatgcacgatgggaattttagtgcgccccttagtctttattataacaggataaataactccatttaacagataaataacgccttttgcgtaagcaaaggtcatatcctgccttgtttcaaatttctgtttttaaaaaagcatttctgagtagaatttgagttcttaaaaattgtctgagttgatgttccagcttgttttttttgttgttgctgtttttgttttgttttgttttgtttttgagatggagtctcactctgtcacccaggctggagtgcagtggcgcgatctcggctcactgcaagcttcgcctcctgggttcacaccattctcctgcctcagcctcccgagtagctgggactacaggctcccgccaccacgcctggctcattttttgtatttttaatagagacggggtttcaccgtgttagccaggatggtctcatctcctgacctcgtgatccgcctcggcctcccaaagtgctgggattgtaggcgtgagccaccgcacccagccccagtttgttttaataagcaataacattattcgaatttggtgtatgatactttgagcgatgcagatatgtattgaatttcaggaattgacaatcttgataaggttttaaaggtttagggaaggtctgagcctctgtttactttctagaactacgcttgtcgtgtgtgtgtcgactttttctatcggctgtttataatcacttcgcctataagcactttttattacattattttctattcatgatccctgctttcaactggtatggttgtacatttacatgtttgagcatcttggactttataagatctcatatttcccatatttctaaactactttttcttaagtatctcagtggtagtgacaattgaaatgtgcaaagctagctagctactgattattaattactctgtcatctgagaaactttaaaaatattatgtttaaaaatagtatcatcaaaatccttttatcaagatcttgatttggtaaaaggtgaaaataataaaagggcacagcacaatagagacaggatgcatttaccctctcctgctccgcggtcacgctcccgccttgatcctcaagagagtggcaaatcttgtggctgcatatgcatgcttctgcttctctgcaggatgcagggtgcagacttgtccagcaggcacaggaggaaagctcagcaccaaaatacctttatgaatcagttatgttcaaatatgttaaacatctgaggggtggagagaaaaaaaggatgcccgaggaagaatgactaaacttaacatgaccacaaataatcctctccggtagttcagtaggtaactttattttgaacaaaattttatggcagatgagttgaaaggagaagaaattttctgaaattgtcatcagaagtcaaagagttttgcttttattttaacccaggccaagaaggcgcagtacctgcactgcttcatgaaacaaaaaacaaaacgtgttatcaacccaactaaatgcttaagattttaagactcacctagtccttccccaggtcagcctgacacctggcctggcaccactaatcatggcacaggttcagaaccaaggtcaagcattctgaactggggatagggaaaagggtggattttccctgaagctcgtgtagccagtttcggggtctctcaatttgaggggccccttccaagaccctgtacctaattttgtattcattatttttttcttaaagagaaggcttcaggacccacaaaatctgggtccactcctgggtgaaggtatctgtgaacctcctgaagacaagagtgtgagcgaggctgtgtggatatgtaaatgtgcttccatatttttctggaagggtctgtgtagtcttctcaaagccatctatgacttacaaaggttaaagaactcaggcctcggagaaattaatcaacctcttaattctggtcttataacaccacacttataaagtgatggtttaattgctagaggcaacaatttgtgactcaagtagaatagcttcctgaatgtatcacaggacacattgatcaccagagacatagatgagaatgttcttgatggttgctcatctcattggaatacacactctcatattattcactcgatcagtcattcattcattcattcctaaacacttactgagtacctgctctgtgactgcagcctgctaggttccaagatttcagagatgaattaggcagactcgctgcttttgaggaactcacatagttcctatcaatcaattcagctgaaggactctgcattctttctccaggttcccacatatatgtgagtgctgtccttgagatcttgaggctattttaaatagaaatggaagctcttcagcataaacctcactccaaaatattacgcaaaaagccaccctcataagagagctgtctcctggggatggggacaggtcttcgtgcaccactgagctccagctcttgcctccccctgccatgggaaggatggtcccattctgtccagctgtgtgcctccttacgaaggactcagagtgcagggagaccagcaggatatcggcccggatacctgaggagtgcagcagtaaataatgcttccactgtcattatggttgagagacttttccttgtggctaacagctgtgttaattctgctgttagccttctacagacagagcaagaattcttcccacacaatcacatataaataggagcctgtggaaactgggctgtagaagttgttttcatttccccattcctattctttgtgtcttgcattacccaatcctttgaattcaaatcctattgattctacatcaaaagtctgttgttccctctgccgtcatcctgatagaggtcctcattatctcccatttcatctgttgctacaacttaccactggattttctaccccattctcctgcctcccttcagtccaccccacacattcctgttcctgttaccttctgcaaagcaccattccagtgtctctcctgtgcatgctgagatgcagcttcccaaacagaagccaaagaggtaccaggaggttgctagagcgcttggaagggaagactgagcaaagtaccatggttgttcaaagatactttgtgcttctgtggatttcctgtcctgtcctgcaccgcctctgggctgcccctccgccctagcatttttccttccatctagcatttctcatctgctccttccacacccctccttccatctctcaaaatgttattcaggtttcaacaggggagtcccatgttattgggggaggcaccgattctgaagcaggtacacgaggtgaaaatatcatcaattgtgcttcgaaactagagccaccctgacaatagccaggtgctcctctctccgcttccctggacaccagctaagaagccggtgaacagaaaccactgagaaaagctgcacagtcaggtccccagcttctcagctctgcccaagcagggtttcccaacctgttctctatctggcatgaagagaaaatgatgatagtatttgtatggcacacaaggtactttgaggggactgagtgtggggttatgtggggtgggtcactcttggcgcagccctcctgtggcagcagaccagctgggaatctttgtcctagggatgtgtttgctgaatcatggcttccatggttgttggttggtttgtttgtttttgagacagggtctcactctgttgcccaggctggagtgcagcagcgcaatcttggctcactgtagccttcaccttccaggttccagcaattctcctgcctcagcctccagagtagctgggactaccggcacctgccaccacacccagctaatttttatatttttagtggagacggggtttcaccatgttggccaggctggtctcaaacctctgacctcaagtgatcagcccgccttggcctcccaaagtgctgggattacaggcgtgagccaccacacctggcccatggtgtttctttgtcattcttccattgctgagaagatatggttgcatctctctaagagttaaatatgtctgtggtatgactccactttacacagattctacccttcatgaattctgccttgattttctataaacacggcccgtctttctcatacagtttatgtgtagtctggagtcatgaacttggcctggcccttcaaggaaaggaactgactcattcatacctaccttggggccacctggcccatggtgggtgttcaaacgtgtctctgttgaaggagtacataaaaggcggcaccttctggaacccattgcttgattgatatcacaacagggctttctctgcatctaaaaataattttttcctctgtttctctctttataggacttcagaaatgggcttgggaaccagctgagttcaggatcccacacctctgctgcatctcagtgtgactcagcgagttccagaatggtgctgcccatgccaaggctacatcaagactgtgcgctgaggatgtccgtgggcttggctctgctgggtcttctttttgctttttttgtcaaggtctataattagaatacaactaatggaaacatctataaagaagaatacatttctaattaaaatcttcaatgaacaggaaagcgacatctccattctccaagggcaataatttgtactggtcatgctgcctccttctcagccactcttcttaatgaggctccccctgtctcacattgagttgggcccattggttatttgacctaaaacctaatcaccgctaccatagcacatccttcaaattaaactgcttttggtttacttttagcaagaaatgcaagcggttgcatttttttctgtttgtttcaatctctaatctttaagtcagaacctaattgtacagtggctctggccatcttttcctcatgtggaagaattttctatctttaataaactttttctttgttttttttttccagatggagtttcgctcttgtcccccaggctggagtggtgcagtggcacgatctcaggtcactgcaacctctgcctcctgggttcaaacgattctcctgcctcagcctcccaagtagctgggattacaggcatgcgccaccaagcccagacaatttttttgtgttttcagtagagacggagtttcaccatgttggccaggctagtctcgaactcctgacctcaagtgatccgcccgcctcggcctcccaaagtgctaggattacaggcgtgagccactgcgcccggcctctttaataaatatttttaagtgcatcttccccttcaggctttgtttggagtcccagtgctacaaacattgtatttttcacagcagatgtgttcctgaaaagtgtatagaaacctgttctgggaacctgaatgcttttggaatgcacggggagagtctgccagctaaaggactcctggcaacattctgtgaaatatgaaactggaaaactggatttgtcgaaaactaattgtgcccattttctcacatttttgatccattggggttttttttttgtttttgtttttttttttttttgagtcaaggtctcactctgtcaccctggctggagtgcaatggcactatcttggctcactgcagccttgacctcctggactcaagcagtcctcctacctcagcctccctaatagccaggggctacaggcatataccaccatgcccaactaattttttaattttttgtagagatgagtgtcactatgttgcccaggcttgcctggaactcctagcctcaagcagtcttcttgcctcagcctcccaaagtgctgggattacaggcgtgagccactccacccagcccagattaaatgtttttatttctacctgccatcattggtctttactaagtgaagtgacttctttctttaacaataaatagaattggtatactaagcaa

SEQ ID NO: 1512 - DNA, 21679 bp, Homo sapiens
ttaaacttttactatcgaaaggatttactttggtggagttgagggtgggagagaaatgaatctttatgttctcctgttagagaatagcttttttccttccagctttcacactggcacatgcttattacaattctaccttgggaacatgacagaatttttttcttatgcattcatgcaacataaacagataattctaggaagactgtgattaagtcacttgcattctgacctattattttcatctctccctgactctgggtgagccaaaggctattaagatgatgttctcctgctcactcactaggcagacctctactcgagaagtgatctgacaccgcagtagctgatgctcgtccagtgactaaagcagtcaggctgaaaacagattttatctcaacaacagtcctagtttcttctgtcctcaaacactgttatttattttcaagataaaatttagtaacaacattacgaagtagcttttattcccttgggtgaataagatgtgcacatttaataataaatttgcttactaaaggtccttttaggggaaaacaaccttaaaaatacagttctagtccttgggcagtgaacaaagaaaaaatgtgcttgagaaacacagtccaggttaaaggaaaactctcagatcggttaatgcagttgaatttttgcttgagaatgtgagcaacgtatcagcaaatacattcattcttgtgctactcttcattatttagcatagagctaccttaggtgtttctacacatgctctaaaccaagagtaagtttaacatgtcagcagtgaggagtagacattttctactatagcacactgggagatgtttactggtactctaggtagaaatgactccattgtccactaagtttgggaaataaataatatggcaacattgctactggagatacataatgtacagaagcctaactataaagagatttgattaacgagacttaagtcttagtccagaatttcccaaatttatgtgaacatgggacatcatttttcatagcacacacgtgaacaagccattattctttaaacaaggtattacaaactcaaccactctggagaactgatgagcgcctaactgaaattattagactaaattcttagtaaacaatgttttctgaaccttgttcagaaatataatcactgcaaattattttccaagtgttgttctaaaaaacaatataactggacactagtaagaaagtaaggtaaattattaatccactcgcattcaattctacaaggaatgaaaccatttttaaaagtggcttagaacaaacaatttactgagcacttactatgcacccaccaggtatattccttttataatgtaatcttcaaaatgagctgtcaaactattggcccattttgtgaatgaggaaaatgaaaattaagttatataatcatgagtggcagagctgggaaatgaactcaagtctgtgactctgaagacatgaaaaagttacacatttcagatgaatgcataaactatctttatgggtatgacatgaaaagtaactgtagaatgttaccttaattacatttcctaatgcatgatgtggacagacattagaaaagtttggactcagttggaaaaacaaatccagcagttaaaaaagtcctttacttgcaatccctacccctagctaacccaagagcatttaaaaaataacttaaaaagtagccatcaaagataccaatcaatttcttactggtgaaatatataagaacttccaggagtcacaagagttccaaacaattaatttataaaaataacaaaacatttgtctatgaaaaaaagatcaggattcactctcatcgacgtcctcatctggatggtgctcagcatcctccttttcctgctgctgtttcttccacagtttggccatggccaggagtttgaggttaggttggttggcagcatcttctggaaagatgtaatcaaagtattcttcccagcctgcatcagactacagaaataaaaaatgaaaagataagcaaacgtgggtgatatactcacatatcagagtgaagaatttttactggaaatccggatgattacctccattttacaaaataacatcaaagtctactacagaaagaacaagggctgggtctgaaagactgggagtgagtaagcagcaactgtagctcagtgagaactaaactggtagaaaaacattctaaaaatctaagcacagctcctctatagccaaccaagatgttcagtgtctccaactacattgtgcagtcttacacttaagaaaacgtttaacgatctttacataatattcacccagtagcaaaagccatacatctgtgcattattattccaactccctaccttcccatcctcacctcctatcagtcactgatttcacttcccaaatattgttctaacaggccctgtggccctgttctagttccagcttccatgtcttgctcagcttataaaaactgcttcctgatgggtcttctttctccaatctaagccccttgagtctgccaggatgagaggctagcaatctggtcacgtcattttatgcaaaacagccttcactgactcccaccaaactccttcttaccgcctacaagccttctctggataggctcctatctgaaagttcagttccatcttcctccacacttacttcctattaaatgctctaaaaatatcacacttcatgaagttcccagactcaaccatcaccaaaacacctttgccaaccccttcccgttctccacctctgactggaccatatgttctaccccgtgtttccataacagccagattgcaaccatctcctactccaggtggtctgcttccattctaagattgtacatatgccacttaaaagtccacatttcgacgtcagaagtgtttctactcatgtgacgtgagatgaacagtcccagggcagagttcttaccccatcatcagtctggacctttcttctcttcttgactttctctggcatgagtttgtctactctctccttatctgaagctgttccaaattcttcttcaaaacttcgccaagattccagcagcataagtctctcttccttttcttcacagtttcgcatggttttgttagcttcttcataaatttgtctgcatttagtcaaacttccttcttttcctgaagacaactcaaactgagcaaagctgatccatacctttaaaaaaagttattattgaaccaaattaaccatatcactcagaagataataatgtagtaataataaagcgaattcccagttaatgacatcggaaagtaatgtgtgcatcactaatgtttcacagatgaaaacaatgaatatatgcttcaatataaacactgaaaatatttgattctacattctacaattaaatgtctgacatagtcttaaactcttgaaaagagtttaacttggctgggtgcagtggctcacgcctgtaatcccagcacttcgggaggctgaggtgggcagatcacgaggtcaagagatcgagaccatcctggccaacaggtgaaaccctgtctctattaaaaatagaaaaattagcctgggcattatggtgcgcgtctctagtcccagctactctggaggctgaggcaggagaattgcttgaacctgggaggcggaggttgcagtgagccgagataacgccactgcactccagcctagagacacagcaagactccgtctcaaaaaaaaaaaaaatagtttaactttttttcaatcttgtgatacccaagctactcacatgcagcataaacaatgacctggtataaacttaacattccaaacattccaaagtcctctgagactcacgtttctcttgaaaagcaaggaagtcattaaaaaaaaaaaaaaaacaaaaacccaaacacttaaaatacagaaatatatcattttcttctggactgctgattcaagcaaaatgaaagatcatctacaaagcaaggataccttgacatgctgcgtccgttgaagcaaccgccggtaaaggtttcgtgttctttctgtttcttcctgctcaatttcaaaatcaatatatgatttccaaagcacctaaggaagaaaagtaaatgggtcagtcttgacatttacaaagcagcatgcccccatccaaagcacagctgaagtatcactctaacctacatctaggaacataggatttttactgaacaactaaagaacacatgtggataagataaataacattggtatctataagctggccaaaacttggctagaattccagattacagaaaaagggccttggattcagtcttagagattctctttggaagtttttcaaatgcttgacttatcaagagctgagaaacttgccaagcatctcccaggtactccatattctagccacacgcaattgagcgtccagagagaaaacaggcccaggttagccagtatgcatgttcttacctctactgtacattccttgttattatgagagttcagtgcaacaagcattcactgaacaggtgcgcactggctcggtgcagcctggcagggaataaggatgaataaaccgtggcatggacacctgaaagctggcagtctggtggaggagccgaggacaactgatgaactcagtgatacccaaagccctgccttaattaatgcaatcagggggccaaaccattaaatgcagggtcatgttagtgcatgagattaacaaaacggctgggtgagttctacgactcatgtgagattcaaatctttcctagctgtggtttggtgctaccttgtgggtcaagcttaactactgaaggcaggcgaggactttcaggacagtgacaacagaagttgcaaggacatcctggtttagagaatacagggatgtgcagttcctacctccatccccctcgttctccgggtgggccagcctgctggcttcttccttgcctggcctcttccccagcccctttaggctttcctgctgcagaaggggcgtcacccacccccatgatatcccagttcatcctgggcatcatcctggatgtctactgctctggtatctaatgagagggctacttcccctgtcccccacagccacctttccacgtacaagcctaatctgagtagaagagactaagttagttagatcatcgttatactctaaaatacacccacatttagatggtcatctaaagtaagactaaacacgtatctcaaacaaaattatatttgacttgagatgctcacctctggcatgtctaaacgtggctgactgatggctaattcatagattgcccgtgctctgtcaatatcaccaaggattgtctctaattcagcgaatttaatccatgaggtacaattttcaggtccaaattccaggaacttttcataaagcttccggcatctgtcaaattctcgaagctgtagctccaattctatgtaaactttaaataatttgttctttggacatttgcctatggaagttccctggaaaataaaataaccagaccactgtgatactgtagtggatttaatctgtgcagttattgcactgccctagaggctgttctctgctgaggaagaatcttgcaaagtcaacatggcctaccattctttccctctgtggtatcacaatgtttactggttcttgacaaaaggctgaaggaaactcctctaattcactcagcaagaggcagtgttccagaattgtttgggcaactaaataaaataagatttgaaagtttctcaggatctcctagggaatagggatgtcaaatgcataaaacctcctataaataaaaaggacaaggcatggtggctcatgcctgtaatcccagcattctgagaggccaacatgggaggatcatttccgcccaggaggcagaggttgcagtgagccaagatcgcgctactgcattccagcttggggaacagagcgagaccctgtctcaaaaaaaaaccaaacaaacaaaaaaaaaaaaaagaaaaaaaaagtggaacaattaaaagtgcatttaacacaccaaaaagtttgcacaggatcagattactaattccagtctgtggaaagatttagtaactggtagctatagaagtttccaatattgaaacagaatgttaatttgccccaggtaataagaataatttacgcattattagtcagtgtttttacagaggacgcatgttttctaacatgtcccaggctataaaggtataatacttctgtcactctttaaagtaggaactgtacaacttccaagcaccaagattttaatttctttctcatagaacttgatgagacatcttgatcctttctttacttaccaatgctcttctggctaatgacagattcttctgtcgtatttcaaactgtgcatacagtatccacattttggcaaatgtgaactagaaaacaaaagcacaaaaatatctagcttaaaagcctcatccaaattaaattgaattaaaattaatttaaattaaccaaagccattggtaattcgatttctctaaaacttcagagtaagaggaatgtactctgcttatttacaagcaaagaccacattcatttcacaaaagttagaaacccacataccatgatccagatactatattgtactgcatggcatggtaacctctcctgagaaccatgatccagatactgtactgtactgtatggcacggtagcctctgctcagaacagactttgttttgtaggcatgcttgtatatgggcagaatgtcctacctctattctgaaaagtaactcagtcaacacttctacagaaggaaacacgttttgtttctcgtgctgggaaacaaggcggaggtaacatctcaaccatctacacaaggggcacattcatctgtgcatgcacacactcactgttaccaacaaacccgcctgtgtgtcccccgcacacgttgtgtgctctctgcatggatgtctttctccttccactcagactattcacattacctagccttctctgaatttatattatttgtttgtcaatgcaggttgtcctccaacctagtctgtgagctgttttcagaggcaaggagcatatctcagtcttatttatgttgtccatggtgggacagggaagcattttatcaatcaatattatttcactgaattacttcacaagtaacagaagaggattctgacctgtttgaaatggaacactttagagcaaacatacctttttgtgaggaattagttccaaagaggcttgatacacctgtcttgtcctctcaggatcctgtattaggataagaaattttcacaaaatattgaagtctgctgctaacactcattttactagttactaattttactgatattggtaaaaatgtacacccccaaaacagcatgtttcacaagttgttacttgcaaaccctgatttatgatctaaagtatgaacggccatgaaacttcagtttaagaatcaccaacaagatagccaccaaacttctaagcccttctttgtagaaagccgttttgcctgatggcagaaagaaacaaagatgtttcatagtctcagatcaaacccagaaggttaatacaaatgatttctgaaaatgccacttgatttttgctaaaagcaaaaatgcataatctagccagaattactcctattaatgagcaaatccaggaaactatatttcactaaattaagggctggttcactgttctctttcaagctccaagtgatatcttgttgtgcctcaagtaaaaatcaaaccaaagttaaaaaagcccctcacgtgtggccacaacaagcacagagggtttaaaatgttgcagagcgaatatataactgtatggatgaacagaagcctataaaaatttaaaactaaatttccttctttcaagaattacaaacatccacaataggtgagctgtgaatacagaagacaggaaaccattatcagctgacacataattctgttttttcacctttgcctccaattcttcatagagtgcatagttgatccaaagataaatgtagcgcttccagtgcctcttctcctgaatgggtgggacattggcaatggccctttcatagacttctctcacggcttcagcttctgcgtcactttctaccaagcgcaagtaatcaaaccatgcatcataattgtgtggattcgcctagaaagacaaccagtttaataaataaaaaacaaaaccaagagctgcacttgccaggttaagcaagctgaaaaaaggcatcaggctgactttctatattttagcaccttttcttctaaatgttacatgttctttcattttaaaaacaccatccctgagactgcataaatagaaaagaaacaggaatacagaggatagattactggccaggtgtcccacagcaaggactccttcatctatagccatcactctcacgacagtcaataattagatgcctattcttgccaatgcatttgcttaaatatgtgactatgtatcattatgtctgtaacaacagaatcgtatcatgctcacaattgttaaacttgcctttccaattaatagcaattcatctttaacatatcttgctaacctaccaccacatttaataacagacttagtcctttgcttggaggtatcttaattaacttgactaaggaagagtatttttaaatacacaacagaatactgaaggaaaatgacactctctttgaattgaaatcaaaatagtacattacagaaaaagagatgccgatggaaccctgtctagcatacatcttttgttcaggcagttaagctcaaaggtgatgtgcaaaacaggtttttggaccaatctctgactcttccaccttcttccaacaatgagctcgaatggattccacatttcttttgctccagttctacatacagtcaacaatcaacaaaacgacttacaacatgtaagtggcagagcaaatccaagtgttgtttgcttgccttttctatcagccttgtttattcctacttgtctgaaatagctgccaattggatcacgggcacatcatcacgagagtaatcactagtagtgctacttgctattattcattttagtgttgctagtattgatgagcacatcttgggttatctgcagagttgaccatccacaccagtgctcaccttcacttcttcttcgtactggaatctccgtttgctcacaatgatatcttcaataccccgcctatcaccaaacttcttctcaaagatggtataatttttaaagagttcttgggcatcttgttttgaaattctgtccagggcatacttgtaaatcactcgtaccctttcaaactaaatgcagacaggatgattaccttctataacacaatattctcatgccagtcacaactaggagagtaaatataacaaaatattacttataagttagattttgaggcctcataatatccagagtaagatgcttttctccctcttgttgaaggttatctctgtcaggatggaccggtactctgctttgagctccatatttaatactgtctacctaacactgccaactggatgtctactgcacatctcaaacaggtccaaaactgagcttctgtttcctccccactcaaactgggactctccccatcttcccaattttagtaggcaaggcctaacctacagtcacttgctcaagccaaaaccttcaggtgatcctcaattcctcttttttcctcatactccatattcactcttgcaacatgccctaccatttcaatctcttccacacagccatttgcttctccccagcccccagccatcaaactccactgttcacctggcccacttcaaaagtctccccactggtctcccctggttccacttttgccatctaccctcatacattctccatgaattagccagaggctctccttaaaatataaatcatatccaatcactgtcccgcttaaaacctttcaatgcttcccactggcccgaacagaatctgaactccctagcatggtccgtgcaagaccttatataggttgagtatctcttgtctgaagcatttggtatcagaagtgttttggatttgggatgtttccccagtttgggaatatttgcattatacttactggttcagcatccctaatccaaaaacccgaagtctgaaatgttccaatgaacatttccttcgagtgtcatgtcagcactcaacaagtttcacattttgagttttggattttcagactgggaatgctcaaacctgtatttggatggatctcaattctgtattatttgaactccctttttttttaagaaatggggtcctgctctgtcacccaggctagagtgcaatggcacgaacatagctcattgtagtctcaaactcctaggctcaagtgatactcctgcctcagcttcccaagtagctgggactgtaggtgtgcaccactatgcccactcaatttttttttttagagacagggtctcactatgttgcccaggctggtctcaaactcctggcctcaagtgatccttctgcctcatcttctcaatatttgagctattttcataggtacaagggaaaaaaagaactctcttatttgtagggcaatctctgtttccattctaaatgttttctgttctagggctttaagctttttgtttcccatatttattatcggttaagtcctttacttaggatgccaaaagactagttctcagtttacgggcattcagactaaaaggcttaattttcaaacaaagcacaataaaattaagacagttataatacaatctataatcagctcccatctgtagcttagtcacatatatatgctgttctctgtgagaagctgtgtttttgtattttgaaaacatctttccagggatatgtcagtaagaaaaaatggaaatgaactcaccatgcacaaaatgtaatctttgctaagctgttttacagtataatgaagttaggtatacttacctctttctgattttcttcaaacttggcaaaggcaacataaaggtgctcatccatatgttcatctccaaagaattccacagctctctcatacactttccgtgcatgggcaaaataagcatgtttttcttcaaagcgggcatacttgatccagttcttaacatcagggtgcacgaggacaagtgcaagggaattaaggaaatcccaggcaaaacagcatggcttaaaaaaatagtaagtaagtaaacaccaaaaccataccaaagcctggaaactccaaaaattcaaactacaactctaggggaacaaaacacatacaaaagtgtagaattaaacagtggcttctgtgagagcagggccacgcctgttcatctctattttcctccagtgcttagttaagattttagtggtgggtataaactcgagttggaagcaaagaaaaatctcaacccaggttaccaaccatgtgatcttggataagtcactgaacttagacgtctaagtctcagctgtttcatttgtaaacagggaaaaataatgccagcctcactggattactgccagctttaaatgagaaaatgtatgtaaagcccttagcacagtttctagccaaaagaacatggcaccgtaagcggtcaataatggtctggtcattaaatagcaccaattatattaaaatatgaatacttgaactaataattaagaaaaaaacatgctataaaaagaaaactgttaactagagtcaaagcagaaagttttgaattgtcattttaatctatcttccttgaataaatcattaatttccaaagtagtaatatattccaatatggcaaagaagagcatcagttctgaagctgctctactaggttcacattctatttccatcagcacctgtgagaacccagtcaagctacttaatctctcatgcctcagctccctcatctgtaggacagagaagttcctacactgcaaggatgttatgaggattaaacaacaatatctgtaaagtacttagaatactgcctggcacgtagcaagtgctataaaagctttcgtcaaactaataatattaaaattagtagacataattaagatcttaacattgtcacctcaacagagaagagtaaaaaaataaaaagatcttaatactgcataataaagttgactctcattatttctggtagttatgttctatttagtcaatgcgaacacttaattattgagtactgaaccactgctcctaggagaaacgtgtatatatacaatctcacattcatcatcatcttaaatcctaaaaagaactcatcctggcagattctatcttcattattttgtaagaaaagtggttcagaaatgttaagtgactggactgaggctgccccactgacagggattcaaactccccgactggccccagagccacagctccttgcactacatggcactggcccttcctgtctccaagctctaggcatggttatatgaggttaagaccagaaggcaagcctcaccttgttggacttcatgctctgtgcatgtccacaaatgactgtgaaagtgccacaattactgattttgggggttacaaataaattttagcaaatacgtgattttgcaaacatggaatctgcaaatagtgaggaatgactgtacttcagtttctaaaagtgctttcatgtgtatcatttaatcttcgcaacagcccaacaaaggtgtttttattcttgtttttaagaagaggacaccaactctcaaaggagttaaatgactctctggagccacacagctagtaaacagtaaaccttggatgaactccagtaaggtagtaatgaccaacacaaaccttagaaaaacaggactggcaatggcagccaggaccttagtacagttagtcctccagccatgggttccatatctgtggattcaaccaacctgagataaagtattcgtgagaaaaaagtgcttctgtattgaacatgtcgtttttttgcttattattccttaaaatatacagaataacaattatttatataacatttacattgcattaggtataagtaatctagagattatttgaattatatgggaggctatgcataggttacatgcaaatactacatcattttatatgagggacttaagcatcaccgattttggtatccccttgagttcctggaaacaatcccccaggaatatcattttccacaaggaaacattagcttttagcattacaataaaataaacccaaactctcactagaaaagactagttacccagaatacaaattttcattctgaccaatctctttccctacaaaacatagggaagctgataaactggcattcttgactttgagcctgacattaatgactgtgtgtcctgatcatgagacatctctacaggagcagcagcagcatccaggacaatcatggcaccatacagatctcgtccaaaggatatatcgctcataaatggtgcgggcccgatccacctctttgtatctcagctcaaagttgatgtaggagtgccaggcttgctcctcaggctgccactccatccagcgctcaaacacctgccgggcaccggcaacgtttcccaacatttcctccatgtacgtgtacttgtacctgtaacaaaatcacccgaaaatatctgctgtggtttagttcttccattgttgaatgggaagaagattgaagattttacctttcttaaaggttaaatcaaacatgttttgtcatttgtatgtaaatctgaaaaaggatgaaccattggaaaaaaagatttttttttcttaaaagttgcctagttcaacaagaagcttatgaataaaagattgcaatcaaaattttagttttgattacatagctatagaacattacgattatgacttaatagactatgggacataacagcatttatgtctgaagaaaaagtaggatatcaaattaaactatcatcatgtaaataaaataaatacagaagatgtggaactttgctagtctataaaaggctgttttgttagatcagaaacttaccagaactgattaactcgaggcagcgttgttatggcccggtcccagatatttcgagcatggttgacttggcgattcttcatttccatttctgcgtatttcagccagagtgtaatatttcggtagtctacatctaaagcacgctcgtatatggatcgagcccttaagaagcaagatttgcagggcatcaaaaatagagcattcaacacatgtagcagttatttcaaactatctggaatgcactgatgttttattaggtgtctaccatgagccaagttctgggcataaaaaaatgaaaagatataatgctctcaagtaccttacaaagtcttataaaaagacatgcatgcaattataatgcaatgtgatttatgttatagtcaagatctgcacgggaaacagagaggaagaaatgaaaatgtttggtggaaaaggctaagtagtaggtaattgtagaaatgagaacttgaggaacgttccgatttaccaggaaactaagtttggtgaggagggggtgctcattccaggcaaggagaacagtcaagcctcacgataaggagacatgatatattcagggagtggcacatacacaggcacagtgggggaaggaggtatgcggggagaatgcagaaagctagaccacaggaagggccagattgcaatttttattttttttggccattggttttattttttttggccattgtttagctgaaatttgtaaaaatctcaatatatacaaagcaaatgaaattgtgcttctttagctacaactgacaagatctatctctaaagcctcttctgccaccctccccaggactattctaccccagtactcctgaggccctcaagggaaccctagggttccatggaaccaaagttgaaaatttctacccgaggcacaatcttttacctgtgctttaactttttcttcttttctttttggtatctgttaatctatgaatcattatatacaaaactacactctcagtaattttacctttgaatctcctttaggctttcttcccattgtgcgtattttatccagttactaatcacagtcctgttttttcttatattatcttcaaaagtctggaagaaggcaaaaagggtcaagtcaaaagacaaatgactaaaaatgacagcacccttggtctattttaagtcttgtactaaaatggttattcattttgttcatatttaagagaaattacatcctggaatccttgaggaataagaaacccactacagaaggttacagtcaactaactgatactttaaaatggtctatgcttgtccctaataaaaaatgtttttgactattacctttaagtcctctggtaattctcagaatttcatatataacagcattagtgctttaaaacagtcccacattctagagtgaagaggtcaaatcagatcccaaagtcttctcatggtccttttgcagacctcaattccttttcctttctttctttctttctttttttttttttgagacaaagtcttgctctgtcgcccaggctggagtgcagtggcacgatctcggctcactgcagcctctgcctcccgagttgctgtgattctcatgtctcagcctcccgaatagctgggattacaggcacctgccaccacgcctggctaatttttgtattttagtagagatggggtttcaccatgttggctaggctggtctcaaactcctgacctcaggtgatctgcccgcctcggcctcccaaagtgttgggattacaggcgcgagccactgtgcccagccagatctcaattcttaacacagaaggtggtatagacagaagtacacagtgcagccttactaagcataccctccttcttgttgtcagttgttccatctgctaaacttccgctcactttgattcagcatcaaaaattatgcagattcaatttctttacactttaaccagacaactcatggcatattttatatagttcagaaaaatgctgttatctggtaaccagaagtacattattcatgcgtctggaaacacttaacctcatcttgccctacagaatccaaccaatgaggagcttttcaaactgaccgatacagtcttaacaattagtggactgaaagataccacactgactgaccttccttttccttagtttataatcatttaattcttcttcatctgtgatcttctgttgaggtggaggtggaagaagctcaagttctctttctttagcctctcttaagagttgttcagcagttatctgtacctcagccggggctttgtttttcaccttttaagaaagaagacatttctatttttagtagttgctcttcacacaaggcttaagaaacaaacatacattttttaggatatgaactttgttagtattatcacaagatgccctttttgtatgacatgttcccattcctccatgagactgaaaagaaaaaaaaaataccgttttctctcttattcatagtatctactgcaaagccataggtaaaagtctcaagagaaaaaggtggcaaaaataatagcaagttttcccttttagatgagtataataataaactttgaggccgtctaggtaaaattctgaccagaggttttgttttatcaaaatgtgtagcacatcttattaacagcattacaacctgcatttacagaattcttcaacttatttaatgccccggtgtataactgggtttggttttacatggcacttcaagtcaaaggcaatttcagtaagttctcatcattagactgtaagcttcttgaggtcttagaagcttacagtctaacgtagcttagagctgtgctgtccaacacagtagctatgagtcacatgtggtgagtacaaattgaggtggactgtaagtgtaaaatacacattggttttgaagatgaagtataaaaaagaataaactacctcattacattttttataccgattacatgttgaaatgataatattttggatacattagctcaaataaaatatatattatcaaaattaatttcacttttttgctttgtttttactttttaatgtagatatgagaaaatttaaaatttcatatgtggtgtgcattatatttccattggaccagtgatgcccaataaaagtttatgtagctgaattataaaaaatgttacttaatgccacatgtggagtaatgatgataatggtgatagctcatatttaataagcactaagtgccagacacagtgttacttgctctatatgcattactcctgcgagtcagacaaatagttatgtaaaggtccagttcaagagagtcatccgggctcaagaaagactggagggagggtatctgtaaaggcttcaaagtctgccacatattaagcacttggtaagtattagctatcaaaggaaataccagatagtaagtctactgtttaattaacttatgatactatactactcctaccgtctactctcgccctccgctgtcagctgggctaactcctattcagccttcaagtctcagcttaaaggtcatttcctcagcaaaatttactttcaggaccccttcatacgacccccttattcacgcccatggcatattctactttgcctctcggtaacatctagcaaggtcgtctttatacagaaactcgtgttttgagtactgcttgtggccagcgtacgagcgtagcttcccagcgcccagtgcagtgcctggctcagtaaatcttcaccgaaccaccccactccactccccagcaaaaccaccccagaacgaaggccacgccaacgcgggtcgtgctccgcgatgacaagagcccgcgccccaccaccagctgcccttcctctccatctctcagggtgagccttctccccggcgggaacactctctcccaacccgggcaccctcagggctgagggatgcccctttcctaggccacctcctacaaggcccctcgcgatcgcctaccttggccactttgggaatccgctgcttcccggccgcggtggaggccgccatgtctgcagcagtcgacctctggacacctgtccccggcacggacgctagaaatcggctctgagagctcaccgaaaccacaaagctttcagaaaacaaacaggatctcggaaccggaagcggaacttgcaggactgacctttgacctctcgcttgagccgtgacggaggcggcaccgtttccatggtgaccaggctgcgcgtcctccttgcggcagcgcgtggagtgcggcgtcctggagctgcggatgaggtgggtaacgccgtgctgactagcagcgacgcaaggactgcggtgcagggcgtccagggcgcatccccaggtcagcctccggaactgggatgaccaggcgaggacgagtggctctgtcgagccgtggcgccctgcaagggagtaagaacggagctccaatctggatgctcgagggcgggggaagaagggagagcgaggaaactaccattcccagcatgcgacggggcgagctgccgcccttttaggctgcaatgcctcgagcattgcattctagtagtctctgggtccacgccccctcgtttctggtttcgggacagttgtgcccaaataattctaaggtgcccaaataattaactctaaggcttggaattaaaaataacagaaggtactttgaagccagatattaggaaaaaatataaatagagtaactggaaaacaactcagtcttgtgataagaaacatgtttaaattctgtgtgtgccttaattactctagttaaattttcttagcctcaatgtcctcaactataaaacaaggctaataacatctgtttcactaggattaaagacaaatgctcagtagatgttagctgttataatacttaacctgccctcaaaaactgaaaagcaaaggttaagagaattttttttaatagacatttttagagaagttttaggttcacaacaaaattaagtggaagacacagagatttcctccctccacagcttcctgctatcaattattgtacctcttccctcctctaacagcctccaactcttaaaaatatcctccaccagagcagtacatttgttacaatcttgaacctacattgacacatcattatcacccaaagttcatagtttatattagggttcactcttggtgtacattctatgaggttggacaaatgtataatgacatgacttggcagctcatttgttaggataatttccacagttgcaaagctcttttggtgtttggggaaaatatatatttatgtatgtagtaatatcacgtctaccaatgcagatattactttcaacaaaagatttatgcagatttctagaactgcagtcagttataaccaacatcaatgtatttgccataactctttattaaccatattatttagatattttatctcacttttcaaaatttaaatagagaagattttatatcactttcataaagccacctaacaaaataaataaatattaaaaagatgtttctttgaagtgattttccttaaatgtgttactgtaaacaattgatttaccaaatgaatcattggtttaatcatctgttgcctttgctcaaaagtacaaacatgctagaatactttgcttctgatcaccatccttctctcttacatttctgttgtctggcaattcagttcatctctgtgtgtgttttttttgtttgtttttttttttttttttttttaggaaaaatgtattatccttcttactttttgccatcaatgcttttgtagatataccttcatgtttaccttcttatttcccagcatttaatcttgtattccacttctttctgattttattcttctcagaatataccatctcctagttctttctacaagattctttgaattctttcagtctttgtatgaaattgtctttattttatcttcattttaaagtgattgtttaggtttatcagtctaggttaatggttattttttccttttatatttttaaaacactattctagtagttagaaaactatgggccgtagactaaattcagcccattgactattttgtatggactgtgaatgagctagggatatatatatatatatatacacacacacatacatacacatatacacacacacattttacattaaactttatatgtagtttacattttaaacattttttaaaaattacatggcacatgaaaattatacataagtcaactttcagtgtatgtaagtaaaattttgtgggaatacattcatgctcatttgtgccgatattgtctctggttgttactgtgctacaatggcagagttgactagttgtgtagacaacatgtggctcataaagcttaatgtatttattctctggccttttacagaagtttgctaacccccgtgctactggcttctaatgttgctcatgagaaatattctgtcagtctaattattttttatagacagtctgtcttttgtcaggttcctttaaagttttctgtttgtctttagggttttgtagttttactatatatttggagtttatttgtattttttgctctgaactgaaggttcatgtctttcatccatgctaaaagtaattagccattattttcaaatgtttcatttattccttttggaattcccataagacagatgtttttcattctgtcttacatgtgtctttactgaattctgtattttctgtttctatgtgcttctttctagataatttgttcataagtatcttccagtttattttctttattcttctgtttttaacccatcctcttagtttaaattttaataaccacgtatttcattttttaagtttctgttcttttttaaataatgacctgttctcttctcatgacttttgtttctctttctatatttctttattataaacatacttagtttgtagtctgtttcagagtctatcatctaaagttcttggtgactcccataatacacagattgtgtggactagaatgccatacccactttagtctagaatttggacttctcagcagtatttttgctttattttctacctagagctttgtgtagagaaagcttgtcactttcttgggctggtgagtttaatttttctagccccctcacttaccgaggggcccatccaaagtcccaggtagatgcatggtttaatttttaattctctgtttggagtgaggtccattctatccccaaaacctgtgtcagatcggctcacatcattgccacctggttggagaatttccctcgctcgctttctttcttcttttcttgttttctttttaccaaagtcagttatctaattaattatacttccttattttattcagaatttttatatacttgtagcattagtttatgatatgtttcacaaacaagatgtctcattccaattttgctttcaatttaaaaccagaacaaggaatgacaatatttatggttagcttcgataggagtctagacattattaatttctccttcattgttttccctgttttgagctcactggctagtatataataaaatggctttccctatgaaggaaagaagggagggaaagagagaagagagacttacagaaattgagacaatgagagagaaattgaaatcattttgtgacctactgtttttgtcaacagcatttcccaaagtgtccttctggaacgttaggttctccactgttgccgtcattagagattctcttcccaaagagtgtcggaaag

SEQ ID NO: 1513 - DNA, 10785 bp, Homo sapiens
tccaagtggtcaccatttattgagcacctcaacttctctgatcttccatttcctcccagtggtgccttgatgcgggggggatgggggggcgggggggaagggggctgattatattttcataggagaaatgggacatgaaagaggctaagtcaccgacaggctcacacaaccctgcctccagagtccaaggtttggggaacgcatccaacccctcctcacccgtgacagagataccaggagagattcgagaggggatgggtgggggaggaccaattccacgacctgtgatattcgagagctttggagggagccctcggtgtgaccccttccgactgggtgtcttagggccatttaccacttcaggctacagccagtgagaccgtggtggagacgaaatgagggtgcagtgcgtgctacacacgaagcgctggaagggaggcatcgtgacggcggctgtgaatggcgtgtgtccatcaagtcacgctccgcttaccccactgcgggcaaacaggaaacatcaggaatctgatgctcaaggagggtcaggaccatgctgagcgcacccagaaccagcagaggccctgggcaggaggtccccaaccaatccccactcgctcaagaatcacacggtgttcagccccctcctccctgagacccaggagtccacgaccccaggccctccttcctcagccacagatgcctggggtccccagtcccacttcttctaggcttagtcctggccctctcctctctcagacctaggatggtcccccagccccctcctccctcagagcctgaagcccagttcgagacccttcttccctgagacctcgaagtctggggtcccagcttcttcagggtttcaggtgaatgggcccccgtctccttcccaaccccacatggaaggccaggtaaggtaacgggtttattcacagtgtcatttacaggcagcccccaccccgcggcatcagatcccggcgggaggcccgaagtcgctagaaggtggggacggccttggaggcggggggccgggccggatccccgggcgtccccggcgtcgcctcctcgtccagaccccggcggcccttgccgatggccaggcggggccggccgcggttcaggccgtccaggagcgcgcaggcctggcagagcgcgcggctggccagcgccccacagcgggagcaggcgccggggcgcgggggccgcgcggccggggccagcgccaggcgctcggccgagtgcacgaggtccagcaccgcggacggccgcgccgcctccaggcgcttgagcaggtcccgggcgtggccgcggaaggcctcgggcgcgtagacgcactcctcggagaagtagtcgaggcggcggaagtgcgcgtacagcaccacctccttctgcgaggcgaactgcagcgggcggcagcgcggcagggcgcccccctcgccgggagagcccaggcccccgccccgggccagccgccccgcgtcgccccgtaggaagttcatgagcacggtctccgccatgtcgtcggcgttgtgacctggtggggagagaagggagcgggtgaggtggggcgcggagggcgctgctggccagggagccccccggggaaccaagggtccaccaggacccagagagagactgggaggagagacccacggagacccagggcacagtggggccgccaggacccagagagagacggcgacggggagagcaagccatggagacagacccccaaacatggtgtgacagccaggatccagagacagggagggggagagagagccatggagacccctagggcactgtgggcaaccaggacgcagagagagacggggagggcaagagcgagccatggagaccctccgggaaccgtgaagcagccaggtgcaggctgcaggtggacacaacaaaaaatcaaagagaaacataagctcccctggcgcaacttgggcgtgccttcatgtaccacccgcctactgcatagcggaccttatgctagttgccctttcatatagggagtaaaagtgcattatgctgctaataaccttatcagcctcagttaaaaccgtaattcaaactgtacacaaaaatcagaaggcatttaaggcatttaaccgagattctcaggagagctggaggggtaggcaggctgctgtctcccccaccgcctagggaatccatggcctaattctgggaacctgttaatatgtttggttgtaggacaaaggggaattaaggttgcaagttgaattggggctgctaatcagctgactttacaatagggacagaatggtgcgttatccaggtgcgctcaaggtaatcacaaagacccttagaggggaggagggaggcagaaaagggagagatagggccatggagacctttgaacatagtgggcagccaggacccagagagagatggggaggggaagcctgagccatggagcccctctggcaccataggacagccaggacccagagaccgggagagggagatggggccatggagccccctgggcactgtggtgcagctaggtggtggctggaggtggacacagcaggaattgagaggggaacacacacaagctccctggggaacttggggatacctcatttgccacccgcctactgcatatggggggtgtgagggcagaggcaaggttagagtgatgcaaacggtgtaggactcaaactgccatccttggctttgaaaatggaggaagagccgggcacagtggctcatgcctgtaatcccagcactttgggaggctaaggtgggagaatcacctgaggccacgagtttgagaccagcctggccaacatggcaaaacccccatctctactaaaaatacaaaaattagcaggtcatggtggcaggcacctgtaaccccagctgaggcatgagaatctcttgaacctgggagggagaggttgcagtgagccgagatcactccactgcactccagcctgggctccacagcaagactctgtctcaaaagaaaaaaaagaaaagaaaatggaggaagggaccatcagccaggaatgtgggcagcctccggaagctggaaaaggcaaggaaatggacccccttgccccagagcctccaggagaaaggcagcactcttgacactttgattttagcccggtgagacttcccagacttctatctacagaactacaagataataaatctgtgttgtttaaagctgtgaaatttgaagtaatttgttacagcagccagagaaaacaactggttcttgacacagagcctctgacaacccagactgtagtttttttatggtttttttttttcattttgttttattgtgcgtgtgtgtgtgtgtgtgtgtgtgtgtttgagacagggtctcactttagtgcccaggctggaggacagtggcacgatctcagctcactgcaacctctgtctccagggcttaagtgatccccctgcctcagcctccagagtagctgggaccacaggtgtgtgccaccatgcccagctaatttttgtatttctatacagacgcagtttctccatgttggccaggctggtcttgaactcctctgagctcaagtgatccacctgcctcggcctcccaaagcggctgggattactagcatgtgtcaccacccctgtaatcactgcagtgtttttgtgttatctttgtttagaagtaacagtgagaaatatttacacactggtcaccatgaaattgaagctaaacttgttctgtgtcttgtcaagttatacttgagtctatatcagtggttctcaatctgggatgagtctgccctccttccctcccccagagacatttggcaatggctggagacatttctgtgtgtcaggttgggggtggggcactactattaaatagcatctagtgggtagaggccagggatactgctaaaatcctataacacagaggacagctccctaaaaacaaactatctggccccaaatatcaatagggctgaagttgagaggccctggtctatatggtaaaaaacctccaagaacttggctctaattgtgtttgtagtaatggttacctcccaaagacctgccaagccctgtgaccttgagattgggcatgtttgctactgcaaacgacatctcgttgaatgtttattgacttaaagttgtaaaccacattaattaggggagactggatttgctccacaccttgtcattacaaacccacttaagagctcccagttttgtaataattattacaacaattattatactacgcctttgaaaatggagtgtataaacaaagggtagaaatcaccttgcaagtcagggatttttctggaaggcttcattacttttggaagtacaattaataagtgattctatcaaattaactttaaaatccgaggcagcctctcattctttttttttctcccccagctggaatcttgctctgtcacccaggctggagtgcagtggcgtgatctcgactcactgcaacctccgcctcccgggttcaagcaattctcctgcctcagcctcccgtgtagctgggattacagccgcccaccaccacactcagctaatttttgtattcttagtagagacggggtttcaccatgttggccaggctggcctcgaacgtttgaccttgtgattccgcctgcctcagcctcccaaagtgctgggattacaggtgtgagccactgtgcccggccgaagcctttcattctttccatacactgtctgctcttgtatggtaaggattattcttcccattttcaatcacagagatctagggatttctccaaagttactcagtaaggaaagggccacatcagtgaatgaagctcagtaagccttccccagagccagtggccctacctagcatggtggcacatgacagcctcagaactacttttgccttcatatgctttcagtgtgctgattctctccaaccatcatctctcacctccatcaccgcagctggcttcccactgactggtctcctcggctttgtccctgtccctccaacccaggttcctcgccatggcctgggtgagcttttcaaagtgaaactctcttcatgtcacttttactggttccgccacagcctacagggtaaggcctgacctcttccacctctccagcctcccctgcccttgctttctgggttccagccacactggacttcttggggcagcccaaattggcttttcacaggccaataacctctccctaattcttacccgctttacctcttcactgtgagccttcagatttcaaaaccgttccttgaccccactccctccacgtcatagggttctctgtgtgtacacatagtccataacatgtccatacatggtcaataacatgtataatgtttataattttgtacctgataaccatgcaaaggtaggaacttgtgcgtaactgtattctcagccctagcctgacaatgatgatgataatagcatgtataaaatgtgtaatctatattatatcatacgggttatgtaacataactataatatagataacgttatacttctactgactcatctaattgtcataacaagtttatgagctgggtaccattcatagtcctgttttagggatggggtgaaacagaagtacagagtggttaagaactttggtatggccacagttgggatccggcatatagcagaaacttagcatctgtttgttgaaggaatggatgaaaaagacagaataaaaaagttatcttccagcactttgggaggccgaggtgggtggatcacgaggtcaggagatcgagatcatcctggctaacatggtgaaaccccgtctctactaaaaatacaaaaaattagctgggcgtggtggcaggcacctgtagccccggctactcgggaggctgagccaggagaatggcgtgaatccgggaggcagaggttgcagtaagccgagatcgcaccactgcactccagcctgggagacagagcgagactctgtctcaaaaaaaaaaaaaaaaaaaaagttatcaaagaggagaggccaaccaagaaaaggaattaagagatggagatgctttttagagaaagagctggattctgaaaggtggaccataagagatcaagcatgttagaaacatttaaaaataagtaaaggaccagagatctccagagattttcacctcccacccctttggcaatctgtggagaccaagacggtggccaagacccaaaaacctttgtgatcactgcctggcccctctgtctccccagcgtcttgaacctttaaagggccccagccccaaactgcagcatgcgcccttccgcacctccgtacagggatcctcccattaagccaccagggtctcctcgccgccttctggagcatgcgcctgaatcccctttcaggtcccgcctcctcgcctgtgcattcgccccactgcctcggagagtgccgctctgcggcccgtactacgctcacctgtcacgatgtgcgtggctcccacgcggcgcgccccttcctccagcgcccggcgccgcagcactccacagaaggtgcagcaggagcggctgcggccggagccggctgtgctgcgggccacggcgtccatcgtccagcccccaaagaggtcttcgtaggccacgaccgtgagcggcagctcccagcgcgccgcctggcgccgcacggccgccaacgccgcgtcccggtagccaccgatgccctcatcgacggccacgagctgcagtgagatgcccaggcgcggcgccagcgcgcgcagcacgtgcgccagcaccgtggagtccttgccgcccgaggcgcccacggccaccaccgcgccgggcggcagcaggcggccggcgagcaccgtgtgcagcacctcggcctcgaaggcggcgcagaagcaggcaccgcacagcgcttggcccgagagcggacggcggagggcggcgcgtgcagcatggcaggaggcgcacggcggggcgggcattgcgggaggggtcggcttctcctagacagggagagagaggaggtgggttacatatggattccggattgcagggtccctgccatcggggagattgtctggattgcacctctgcccggaatagaccagggagacgtgtgcgcgagtggagtagcttcttctagcgctggggataggatggttataaataggtccggtgtaaggaagccactgccttagggaaggcttcttggattgcacccattatgcaagaagaagagaagtagcttaagaagctggcttcatgggtaaagagagggagcgacaagcaggttatacccaggattaggttgtgtcctctccagagggatgggggtgtatattaaggcccatttgtcacaacctccagggaggccacccttgttacagtcctgatcaggacaaggtaggtatcattggcctgggccaccagggctgttaaaagcccttgggaggtgaggggtttttgactctaagggcagagggaggccaggggactgaagctctgtgcagcgggaggtggaaaacaggaaaggccaactgattgcactttgtagggtgggatacggtctccaggaatgggttctgattgcatcctatgaaaggcagggtgatcaccttctccagggaacacaggcagcctggatcacacctctcaggagaccagctggggttgcacacattttgagggtgagaaaatgggtgggcctccaagattgaactcaaccctgctctggtatcagaatgccccacaagcttctgtgctctcaccaagacatggatcggcccatctttgaccttcatctgttatctttcctacttcattcttccccacccagcctagactccaaccctccagtcaaatcctggtcctgcctgcctggtgaacccataaaaactccccaggctcagttctcctccccaagccaccatcacctccagcctggactactgtagtcacctccttgccattcagagcaggtcacgctgcttctaggatttaccacaatgtgtggaattattttatgtgactatatatttaccatctctaacttctatgagggcagagaccagtaccactcagatgtctaataggcatctcaaaacccaaattcctgattcttctaacccagcgtgcttctcctggagtacagggcagctccatccttctagctgctcaggccaggagctttggggtccaggaccctggactgctctttctctcactgcacttgtcatgctcccagtgggtggcaccaaactgcaatgccaagtccggaccttttcaaactccaggtacctaaatgaaatttagcaaatcctgtttgaatgtagtttcaaaacagccaaacacttaggaccgtctccacggcagcaccctagtctggtctgtctctctcctggacggctgcatggggctccccacaggtctcctgctcccgccttgcctcctctacaaacactccttcacataacagccagtgggatcatgccctgaatcttctcagcatcctcccctggatcccatctcactttagtataataactgctaatggccgatgaggccctacatgtgtggctccttgtttctccaacctcctctccttcagccttgatgtcgtttactctgacacctgaggaatactcctgctccagatgtttgcactggctctcccctctgccctgagtactcttcctgccactgagcccaagaagcagcccttaggactcatctgcagtgaccgtcgggaacatctgtcacaggtgagcagcaactcttggaatctttcttcccccgacttttgactcactccttctgtgctcctggatttcctgctcaattctcttttggggacgcctcttcatgtcctcaggtcctgcctagcacccatctctttccattttttaaagatttttaatttaatttaatttaattttttgagatggagtctggctctgttacccaggtggaatgcagtggcacaatctcggctcactgtaacctctgcctcccagggtcaagcgtttctcctgccttagccacccgagtaactgggactacaggcgtgtaccaccatgcctggctaatttttttttttttttttgtatttttagtagagatgcggtttcaccatgttggccaggctggtcttgaactcctgacctcaagtgatccgcccgcctcggcctcccaaagtgctgggattacaggcgtaagccactgtgcccagcttctttccattcttatgagcgcctctgaatcatgatattcagatgtccctcctggctggtcctccacatggctggggcaccttaaagatgttcagaccctaagcgcccagacaacctatttcttcctcgaaaggcagaaacctgttcttgcccatctgttccctctcttctgagagcagccaccacctttcatccagcccatctgcaggacaggacgtaacgtcaccctggactcatctctcctcaccccctaaatctacagtcacccagtcctggggggtccacgtcctgaggaagggagacgctcgcaggggacaaggctgcacaagttagcagagcctcataggccatgatgtggaattttaggtttattcaggaggagatgggagccttgggaggtttttgaacagtaaagtggtatgatctggcatgttttaaaaggattcctagactggtcaacatagcgagaccccatctctaaaaaaataaataaataaattagctgcacctggtggcacaggcctgtagtaccagctactcaggaagccaaggcaggaggatcacttgagcccaggaggtcaaggctgcagtgagccatgatcgcaccagtgcactccagcgtgggtgatagagtgagaccttgtctcaaataaaaaaagtgggattcgtttggctgctgtgtggggaggactgttggttgtcagggacaaggacagaaggctggaggtcagcacactagacaggagtgctggcagtagaggtgggaagaagtgaaattttggatctattttgaaggtggagcccacaggacttgtataagactgattggagtggggactggggcaacgacgagagaaagtgatgaagggtaactttgaggttctggcctgagcattggagggacggtggggccattttgtgaggtgagaagaccaggaattccatttggccacgtcaggtttgacatgcatgttaagcgtcttccctcaaagactttatggaccctcgtcactgagtcgagcgcctccaccagggccctcagagctgccctgatcctgactagctgtcactggtgacaggtctgtctctctgcttcaaggcagggacagggttggtctggtgccctcgctcccgccgccctgcgcagagtcggtgctcagtaagtatctgtaggatgagggaataataagtgctcccagaagagaggccgcggaccccagggatgcctctggattgcagccttgtcaaaaggacagataatgtgtggcatgggggcggggacaggcagatagtaacataggggcgggggcaagcagatggtcttatcctgtcttggggaagggagtggcccggtaagagacaggccggaccgcagcgttcaaagtgggaatcctggctacaaggcctcagggacacgggcgctgggaaatcacagaggccttacgctcgaagagaccctcaaccctcccacggcaccgcaacaaagagccggagtccacatgccgacccaccgcaggaggaaatactcacccgggcagaactcagtgctgggatgcccacactgcccaccacgc

SEQ ID NO: 1514 - DNA, 11217 bp, Homo sapiens
agcgagtccttcttttcctgactgcagctcttttcattttgccatccttttccagctccatgatggttctgcaggtttctgcggccccccggacagtggctctgacggcgttactgatggtgctgctcacatctgtggtccagggcagggccactccaggtaagagccgaactgccattcttggagggtctggctcagggaacaattcctaggggacgttatctttaagggatcaaattctgagacaggctgcgggggctcctgccctaaggcagtgtcctctcttcccagctagagaaagaggttcatcccctataggatagcttgctaccctactggcctattctctctccaaggacatgggtacagtaaacagagagaggtgcccagtggtcagtgtctttggggaaaatgggaccaagaggtcctggataaccttggacagacaaggtttgcagagagagaagttggcaagtgcaggctcctgggcgtgttcatgtctgcatccagcctggaggggactcaggcagagagccctaagctggagtgtccaggctctgaggatcactgaggattcagtgctcacgaagaatgcctcttattccccagggtggagcaggagcccacatcccttggacaattaaggagagaagggagggagggggataggttttagcccctgaaggcattctcattaaaggtacttctcccagcctccccagaacttggttagggtactagagtgggttgcgacttgtaggaagaatgagatgaggttgtgtgggtgcatgacagggattgagtgtaggttatcagacagccaaggaagcagtaaccaagtgaaaaatctcttcttcctgctgcctccctgtggctggtgtaatattatggcatctatgatccattgtttttctctcaggatactctcaggatatttctttttatatatatatatactttaagttctagggtacatgtgcacaacgtgcaggtttgttacatatgtatacatgtgccatgttggtgtgctgcacccattaactcgtcatttacattaggtatatttcctaatgctatccctcccccctccccccaccccacaacaggccccggtgtatgatgttccccttcctgtgtccatgtgttctcattgttcagttcccacctatgagtgagaacatgtggtctttggttttttgtccttgcaatagtttgctgtgaatgatgatttccagcttcctccatgtccctacaaaggacatgaactcatccttttttatggctgcacagtattccatggtgtatatgtgtgcattttcttaatccagtctatcactgatggacagttgggttggttccaagtctttgctattgtgaatagtgccgcaataaacatatgtgtgcatgtgtctttatagcagcatgatttataatcctttgggtatatatccagtaatgggatggctgggtcaaatggtatttctagttctagatctttgaggaattgccacactgtcttgagataccatctcacaccagttaaaatggcgatcattaaaaagtcaggaaacaacaggtgctggagaggatgtggagaaataggaacacttttactctgttggtgggactgtaaactagttcaaccattgtactctcaggacatttctagtccaaatttacaccaacactctgagaggaaggactgcaaagtaggtaccttagttttccactgacttccacttttcctgcttacacccttcctcctagacctctccacacccctcctaggacacacctagaaggtactgacatcatgtcacctcctcatctttcagggtagcaaggttggaatctcctgaatacagcccctcaagccctaaaacctcttatctattaccttgggttcattgtccaggaaggggaggagaacttgaacttgtagtcacagaagggtgctgagaactaaccagcaggacggctcagccctgggaactgcagaggggtgaggctggggagagaggaggctggagcagcactggtgacactgaacagtgtcaggaggaagtgacggatgcagcgcccccatcccataggcagagctgtcatgtgggatgagggacagtgttgggagccaccaaggaaacccagaggtgggggagcagagagcagaagggggcatgtgatgctgggcagtgaaagggaggacgggcaaaggctgggttgaggtttgtagggggaatgagatgaggcagtggagccatgtgacagggactgagggtagattactggagctccctgcgtagaatgaatgttcaatcaaaacctgctggagggagagctggagccataggggagtgggtaaagtgggcagggctgattccacaattccctgcatgctcccccaactccacacacatccccaacctcaaacagggcacaagaccaaagggctgaggagccaggctatagcttaaagaggctgggggagaaaagcttggctgagacaacccatagggagctagaggtttttaatatatcctattctgaataagagacgaattcattcagatcagtggtttcaaaccgtgctctgggcaactcaattgctaagggttccacaaacaggataaagtttcttatatacaaaaaaaaatgaaggtttcaaattacaccataaaacccctcattgcttatgtctacttggcaggtaaaattccatttcaaaagttaaatgtacttaaaaaattacctaagactgggtaaattaaaaaaattaaatgttgcaaagaaaaaattcaaaattcttattcttgaatgaaaaacgttctcttactggtgattgaggaggagaaacaaagactaacaaatgaaaatgggagaatccacactcagagtggggcaattgaacaggcaggggcggatggatggcagaggaggaggaatctggactcaaggagctggggggctctgggcctggaattttagggtctggggcccaaggcaccaggagaagaggcaggtcaggatatctgagtcaagacctgggatcttgccttagcaatgacactggagactaaaggtggactccatggtgcccttgagcccagccctaccccatctccactatcctctgccaccagctgtgcaacttctgctaggggtgaggttaataaactggagaagttaatttgtggagcatgaaacagatgagcagaacaatcacagcaccttaatttccccagtgtgcccaagaacagagcaggcctgaagatactcaaacagaaacaaacatgtgccgtgtcactgataattctgtgtagacacacacctgccagacactgctcatggcactccctaggaagaacagcatgtgggaaaggctgccaaaattgttcatgtaaaaattacatcaatgctgtcttcctcggtgctgcctatgcagctggcagccatctcttcctccacatcatggcctccctcagactcctcatgaaggataagatcctcaaaaagaggaccaacaagttcatgaggcaccaatcagactgaaatgtcaaaattaagcataactggcggaaacccagaggtcttaacagtagggttcgtagaaggtccaagggccagatcttgatgcccaacattgcttatgggagcaacaacaacaacaaaaaaaacatgctgcccagtggcttccagaagtttctggtccacagcctcaaggagctgaaagtgctgctgatgtgcaacaaatcttactgtgctgagatcgctcacaaaatttcctccagaactgcaaagtcatcatggaaagagtcacccagccggccatcagagtcaccaaccccagtaccagggtgcacagctaagaaaatgagtagaaagttcatgtccacgttttgtgtgtaaataaaaccataaaaactgccaaaaaaaattacatcaatgcctctaaacccaaaggactctacccccacaggtccctggttgttgtggtgattttcattgtgtaaaatactttccacatcttttgacaccaagtctttctgcagccatgtttgaaaattaactttcaggctacagagtctttcttataccaaagttgaagaaagttttaagaaatatatttctacatctcctacatgcaaaacaacaggagcaagttgaggaattctcaagaaactggtcgagaagagagagcgcttagctatggaaaagagaaagaaggaagggagggcttcctggaggaggtggcatttgaaccaggactgacatcaggatggaaatgtcagtcagggagttaagtagggggagcagctccgccctccacgtccccagctcctcccgcccctgttttttctcccagtgaccccacgtgaaacgtctccgcctcctccagccaccagcagaagggactgccttcccctcagtgctcgcccctccctagtgatcactcagtgcccctgagctcattcttttcagtaaattctctctctgcgtggtgagaaaacaggcctggagaggctctgcgacccgcttaggaccacagaactcggtactaggaaaactcctattttaaaatccagccctgggtgggaagatttgggaagaatcgttaatattgagagagagagggagaaagaggattagatgagagtggcgcctccgctcatgtccgccccctccccgcagagaattaccttttccagggacggcaggaatgctacgcgtttaatgggacacagcgcttcctggagagatacatctacaaccgggaggagttcgcgcgcttcgacagcgacgtgggggagttccgggcggtgacggagctggggcggcctgctgcggagtactggaacagccagaaggacatcctggaggagaagcgggcagtgccggacaggatgtgcagacacaactacgagctgggcgggcccatgaccctgcagcgccgaggtgagtgagggctttgggccggcggtcccagggcagccccgcgggcccgtgcccagggcgcaggagcagccgggttggcctaagggaccttagtgccgggcggaaaggggactttgggttggggattcatggggggagcccatctggagcttgtcaggggagcgagcgcggggacctggactgggctgagcatggagtgaggaggacgagagcagagagacccccgggacttcatcaggcctggcagctgactgcatgtggggtgaaaaaaggaagccacaggacagcgcacaagggtatggtgtggagatggaggtggagatggcacagcaggccacacagagaagaaacctacagggaggtagctgggtttgaggtgcttgaggggcagatgggtggtctgatgggcaggtagacagaagggtctgcagccggggaggagactgagatacatgagaccatccagggagaggggacccagggggaagagcaaaggaccggatcctgggaactggacagttgtgatttggccaagacagaaaagcctgtgaaagagaccaaaaaaacccaagtgcagtgtgaggagaggcccgcagagaagagtcttggaagctgaggggaggtgacctcagcagcacagtggacagcggtgccagtgacttgggaaggtcagaaaacagaagatggaaagtgggtttggaaaccagggagacctggggagagcaggttggccgcagcggcaggagctggaatgggagggggtgcatgaggctgagtgtggcgcatcctcctcggggctgagatggattttacttgtcttgggttccccacggctgtcacagggcagtgtctcagttcattcgtctttttccttcaggaagtctgggtgtaaagggatggagagaggtgaggtgtgtgcagtaagaggatttctcaaggatgggacaggaaggccttggagctttggcttcctcctgtgaacttgtggggtggggagcctggtgcaccaacctgagggacttgagggagtagtatcaggatgtgggattgagccctggaccttttttctagaaagaggaaaaaaatgaagggaggaggaggaggaagctggggagatcacacctttgattttcttgttcctggaaagtgaaaggaagttcacctgctatgagtgagaaggtggacacactgggtggggatgaggtgagtgacatgagcttaggaaagttgctgaggtaattggttgagagaggtgttcaaataaaaataacgcaattggcaaaaactgttactaagactttgtagaggcaccaatcagtgacatggcagcattttctttcacagtaatcaactgccagattgcagacagccctgatgccagcctaaggagtgtgggtttctcctccaggcccgcaggtccccaacctcactcctctgaagactcttctggagatcctctgtgatgcacagatctccagactcagtgcccccagactcagattccctgggtggggaggtctggggatctctgcttgtaatcagctccctagaggttcccatgtagccagataagtattgtcagaacactgaagatttttgaaaaatgaaaaagagaaggttggagatgtgtcttcagaagactactaagggtgctggctagaggagggaccagaggcagggagatgaggtaggaaactgctattatttgtcagggaaattgcaatcaaggcatgagttagaacagggaaaacacagaggcaagggagaggtggaagggggaggaaagaagtagtgacaattccagggtggatgtccacccaaatctagaagtaattgagcaaatgttttctgggcattagagaaggcaactagaacaaacaggaatccttgccttggtgaaatgtatttgaactgggtcagaaatgaggccattgggtatcaggccttaactccagcgcaccctggaggtcactgatgtggctccaggctgacctgctcctgtcaaagaatattgagcaagatgcctctcgtggaatgttctgggaccttaaaacagatacccaagtattccccctgatttcatggttcccagaagctctatggggaagaaattgtaggtaattcacaactgagatttagacataagttgaatagtgtaatggacattgagttaaccgaggtaatgaagtagtgagacacaggtgcccctgaaataaactcacattgagggaagaggctgacaatgtggatcagtctgaaaacaaggcaaaaatacaatagggagtaagggttgtgtgtcagttcaagactgtacttttacctggcccagcgccatgttagggtatttgtgttctccaggaagtagaaaggaaagaactgagtgattagggacctagaagactaatttgagacattcctcttgatgagctgttctctagggtagtcctctgaaagagctgttctctagtggatctccctgaatgaactgttctctaggagcacttgacccttttctgtgtttgttttttgttttgtgtttgtgtttgtttttgagacaggttctcactttgtctcccaggctggagtgctgtggcaccatcatggctcactgcagcctcaacctcctgggctcaagtgatcctcctgcctcagcctcccatgtagctagaactacagatacacgtaccaccatgtctggctaatttatttttctttttagagatgggttctcactatgttgcccaggccggtctcaaaaccctgggctcaagtgatcctcatgcctcaacctcccaaagtgctaagattataggcatgaccaccatgcctggccttttctgctttctgaggaggaaaaaggtactggtggcagagatccaaaagaaaagttgccagtggcagtgtggaaattcacctgagaacaacaggacaagctggggcacaaatgcaaagatgcagagggaggcaacacctggtcatctgtgagaccttcatgggacctgaagacgcagcacagaggaggaacttgaaaaaggacgggatttctactactcaagcatgtaggagctcaggatattctgtaaatatgaagattttgagtttttgtaggtgaggtaaaaaaatacataggttttttacagaataagacatgtaaagctctcttcattttctttgtattttcatgaagttattagattcacaggccaccataatgccattgtctgtatatcttaatttcaagatattatttgagtaaattttgcttcctttgtatcaagatagaactttgaaaaggtaggtaatttcacagttgatcaaatattctttgcccaaattacttttggttaaaatttctcctaaatgtgctacagagtgcaaactctgtctccctgccattccgctatatacttactaactattattttattcaagatcatgcatgctctacttgaaggtctatttctatcttttcaatgctacccttacccactagcctaatcacattattcctattttcaacatctaggaatcaattacatagtgaacatgcctaagaaataataatctgggcagatgcagtggctcaggcccgtaatcccagccctttgagaggccgagcgggtggatcacttgaggtcaggcgttggtcaagtgctcctagagaaccaggctgaccaacatggagaaaccttgtctctactaataatacaaaaattagccaggtgaagtggcaggcacctataatcccagctattcgggaggctgaggaaggagaattggttgaagcccggaggtggaggttgcagtgagccaatattgcgccactgcattccagacttggcaacagagtgacactccatctcaacaaaaagaaagaatgaaagaaagaaagagcgagattatgtctcaaaaaaaaggaaggaaggaaggaaggaaggaaggaaggaaggaaggaaggaaggaaagaaggacaatctcaaattctatttcattatttttcttccacgctcctagtccagcctagggtgaatgtttccccctccaagaaggggcccttgcagcaccacaacctgcttgtctgccacgtgacggatttctacccaggcagcattcaagtccgatggttcctgaatggacaggaggaaacagctggggtcgtgtccaccaacctgatccgtaatggagactggaccttccagatcctggtgatgctggaaatgaccccccagcagggagatgtctacacctgccaagtggagcacaccagcctggatagtcctgtcaccgtggagtggagtgagtctctgatgaccctctagaccccacctctgaagagcaggggactctctggctctggggtccactcatcttatcttctgcatctataccctggggccatgtccaaaccccatctttcttctataccagctcctgagcatagtttgaagccagggaaatggagacttcctgaccttggcttaggggttcctgaagattcatagttctcccccttgtcagagaatctagggacactgactggtctcgaaaccctcacacttaggaactgacctcacacataggaacagttctcttccttcagcattttagcctcttctcaggcattttgagaggcaacttccagaatcagcatttgccaccttgttgaggtcacacccctgttccagatatgagggtggctctttctgaatttcctcttagcaagctttttccgctgcactgtcctcatcccgatatgctgcatcaggctccagaatctcagacaggacatgagtagggatgcagctggtggaggtgacactaaacctgggtctgtccttcccagaggcacagtctgattctgcccggagtaagacattgacgggagctgggggcttcgtgctggggctcatcatctgtggagtgggcatcttcatgcacaggaggagcaagaaaggtgagaaagcctgcagggtgagcgggacttaccttcccctggcatattcacacttattccacgatgaggggtttgacagaaaagaaatgtcagaaagctctagaggccactgatatcagataatcggggaacaaacatgacctatagcgagagagggatcccaggctgggatcttaatgcagccagatgcatgaggtcccaagtactcaggctcctgcggagcgtccattgagtgatgggcaatggaatttggtgggatggaaatgtttctctaattatctgaggtggtttcaatggctgattatataacctttcgtctttcatttcagttcaacgaggatctgcataaacaggtaatattcctgctttgatttccttgtggggtgggttgcaggaggatatgagtcctttctgtgcattgtaacactgaggctcctccaggaagggaatctcaggcatgaacccctctttcaatgtcagccttcaggcaagtggggaaagagcattgcttggctccattgctgaaggaagcagagatcaactctgttatttatcagcctgagacgcatcctctcaccataatttttctctcctggacttacaggaaggaggctggcaacctgggataacttgtcttttacccccacagggttcctgagctcactgaaaagactattgtgccttaggaaaagcatttgctgtgtttcgttagcatctggctccaggacagaccttcaacttccaaattggatactgctgccaagaagttgctctgaagtcagtttctatcattctgctctttgattcaaagcactgtttctctcactgggcctccaaccatgttcccttcttcttagcaccacaaataatcaaaacccaacatgactgtttgttttcctttaaaaatatgcaccaaatcatctctcatcacttttctctgagggttttagtagacagtaggagttaataaagaagttcattttggtttaaacataggaaagaagagaaccatgaaaatggggatatgttaactattgtataatggggcctgttacacatgacactcttctgaattgactgtatttcagtgagctgcccccaaatcaagtttagtgccctcatccatttatgtctcagaccactattcttaactattcaatggtgagcagactgcaaatctgcctgataggacccatattcccacagcactaattcaacatataccttactgagagcatgttttatcattaccattaagaagttaaatgaacatcagaatttaaaatcataaatataatctaatacacttt

SEQ ID NO: 1515 - DNA, 116618 bp, Homo sapiens
gaactctaatggttaccttgttttctacttcttttccaagatcatgactgagagattgttaataaaagcattgagtggtggtaaaaatacgaagatcattactttgaatgggaagaagatgacaaagatgccctcagcattaggaaaactgcctggcctgaagactctagtccttcagaataacctaatccccaaagtgtgtccagagttatgcaacttgacccaggtgaggaacagtgttttgctgttgtggtttggtattgaagatggaaaacaggaagagagaaaaaaggggtaagagacagaacaataacacttcgatctatggagacttaggtatctggagacttaatgtggagtgttgctggagaggcatcagaaggctttctcccttagggaattccatgtggtagggagagatgtttcaatttattcatgtgctctttggcccacatctggagtcaggggactaggtctctgccacactcatctttttagaggctgtcatctggaaaggggttggaaacctggatctggtcgtctatcttgggggcttacatctggaagtagttttgaggatccaggagatgctgttcaccctggggactgtcctgaagcttttgcatttagaatgaagagacatttaggatgcagcaagggagttccttttcaatttcctagggcaggctgaaactttgaaatggagtgttggcagggaataggaaggaggggacatttatttctcctgaaatagtctttaaaggaagtttaatattttaaataaaaaatattcttttttaaagaggaatagttgacatgaatgaatcccatatgcttgtgttaaacctttctgcctaacaatgtgaaactctagctgccaaaaatcttgaggttgagagaaggcaagggatattaactttgtaattttctttttgttcactgctgaattgtcatcagcacaggaagaacctagaagcagctaaggcgttatagctcattaattttgaatttacagttccaaaaaataaatctgtattttcttactttcaccctacctcatttccttttacgtttaagaaattgagtttgtaatctgtagttgtatctttataagaaatagggtaacttttacaaagtcccccttcattagtaattgcagaaggtatacttgtagttacaagacaacaaggacttggaattttttaataggaaagaggagtttctttgcaaaagaatttgggacttgactgagtcatgaacctattctctccctctatttgaatttatttccattaaagtagtactaaccattggttaccgagaattaaatattacaaaaagcttatagcaagaagctatcttctatcccacttcccctcatcctcaatcccgatctccatatataaccacttttaactcatctattttattgatttgtctatttttggcatcatttttcttcatcttctagatacagttatattaatgtatctattgtgtattgatccacatctggaatcaggggattaggtctacaggtatcttttacatgtaatgttactacacctttatttcttccttcatcaactgcagtctcttttgactccccacttcgtaagatgacagtgtcagcctttgtaatccaccttcagctgtcctttcctctcccccctcacaaactctgaagtttttacttttataacacttacagcttttatatcctattcagttataaccataattaaatatttgttttgtgtcttgggtaactctaaacttctaaaaatatatattactaataaataaatattcacatggagtcaattaatctatgattatattttctttcttatatgccatttttgttcccttggagtttctaataacctttcctttgttcttgtgccttagttttatggtagcctcattttatttcaaactgtataatttttttctgtcaaatgtacttttccttgagagacttccctctaagaccctccatcctctgccccactctatgttgactgctatctaggtttgctagatactgtcagccaaggacattccctttgttgctctcttaaattggacccactgtttcctgtatcctgtattttcctttcttggcttgctctcttagtttttcaggagtctcgagaaatcatcctagtctgggtatgtggtagttaaattgtttgatcccttgcatatctgaaaatttctgtattcttgtctcacacttggttaatagttgtttagtaaaaagttacacattccaagatatatttccataggaaaaagccccaagagtctgattatcattacattgtcttcttcttgtggctccctttgttacttgccctctcattcttctatttaggggtaacctacgtgttgacttctgtttgttcactcttagttccttcaccagggagctgtctcagcccagtgcttacttttaaagaagaaattacaccactaagaattcaactgatttgcaactaggctgcttatagtctattctgtctttaaagtactttaaaagtcagattcaggccaatggtattatgtttagctgttcatgaactagtagtttttcttatatagggtcttggagaaattgtggaattttggaaaaaaaaacacaattttccctatgtaatgggagttctagaagcatgctagataaaatgtgctagaaaccctcaaagaatggttgtagattatcatagagttcagatatacagctccatccgtctcacagttggtagtaaagggcagatggcccggtgcagtggctcacacctgtaatcccagcagtatgggaggccaaggtgggcagattgattgggctcagtagtttgaaactggcctgggcaacatagtgagacctcatctctacaaaaaaataaaaattagccaggcacagtggcacgtgcctctggtcccagaggattgcctgagcccggaatgtgggaggttgcagtgagctgagattgcaccactgcactccagcctgggctgcagagtgattctgtctcaaaaaaaaaaaaaaaaaaggaaaggcagatgaaggtttcaaagaaagagacagcttagagaattgaaaaggagagtttagaagtgctggcacaacttaactggttcagcagttaccagctatatacaaggcacttagtttctttgggcctcaatttctgccttcatttatttaatccacaaataagcaatgaggaccatctgtgtctcaggcactcagaactggtgattcagtgatgagcaaaacaggtggaaatctctgccctcatagagtttatgttttagtcaggaatgatgtaagaaacaaataagcaaaatagggcgtgaggcggtgattagtgttaaggggaaaaataaagcagagagaaggggcagggtgtattgtgacattcagctgacctgactgatgccacagagtgtctcttgtgggctttataacttggtgatgtgtatgtcaaaattcagtgattataattcttattctaacagttttctctaaaattcccgtgtacttttaaagttaatttgaactctttcttatgtggctatagtcataccgtttatcagtaatgtttaaagctacccatctacctatgacttttgtttcattttgttttatgtctacagtgtttatcttttgaagtagccttttatcatcatatgaagtccagtttgccccaatatactgattttttggtcatatttcccacagaatgcaaagtattaacatagtcttgatttgtttttaagttcctaaaacaaaaacactacttttaaatttctgtactcataaaatgctaatagaataacaacatcaaccattcactgggagccaagcatagtatcaggagctcatcattttctacaacttgcaaggaagttattaccctcatactgttaataaaatttatggttcaggaagaggttaaatcatttgtcaaaggtcactcaaccagtaaatataaaatgaggtctccttggaggttgctttcggctctattgtattattattctatatatttagtgtgaaatttatcagggtatggtgttcaatttatagttcttaaaaactgagttgcctaaagacggctgctctgaacactacatgcattgtcctctcctcccatttgtttgcatatttttttttcttttaagagacaggtcctgctctgtcacccaagctggagtgtactggtgtgatcatagctcactgcaggctcgaactcctgtgctcaagtgatcctcctacttcagcttcccaagtagttggggctacaggcgtgtgccactacccctggctaattaaaaaaattttttttttttgtttggagaccgggtctcactttgtcacccaggctggtcttgaactcctggcttcaagcaatcctcccacctcagcctcccaaagtgctgggattacatgtgtaagccaccccacctagcccatagtgattcttgtattattattattattattgttattattattatttttgagacagagtcttgctctgtcacccaggctggagtgcagtggcgtgatctcggctcactgcaacctccgcctcccaggttcaagtgattttccttcctcagcctcccgagtggctgggattacaggcacctgccaccatgcctggctaattttttttgtatttttagtagagacggggtttcgccatgttagccaggctggtcttgaactcctgacctcagatgatctgcccacttggcctcccaaagtgctgggattacaggcatgagccaccacgcccggcccatagtgattcttttaacaaatatttaccattcattttcttgcatctatgctgttcccaaggatatagatgtgtacaaagtgtggtccctgccttcatgtttggtgattaaattaaatgtttatatatttaaagctccatggctggcatgtagaagctttaaatacagtttagctattatgattagtgttaccattatgatatgactagcaacaatgataaaatgagggggtaggggttctttagtaaagaacctactttagatcctacttccatttttctttgctaatttaactagtgaagctctggaaaatttcagtcacttctaatgacaatgaacaaaatgggttaatgtcctataatttatggtgaatgcatttggactgtggctcttgaaatatggggatgtcaacaattttcagagaagcactttatgaattttaagggcaaagatcttgtctcatccctattgctttttacttactaactcatataatgtcaacatgagtgaaatggaagtaattttcaaagtcctgcctaaccaaacacacgtaggaacaaaggttcctcacaggtaaaacaaatagccatcatctctaattgtgtgcagcattgttgacatgtatcataaagtccaacggcagtgtggcaaagttccccttaagctgctcacatgtgcagctgaccaggacaaagatatggtctgccatagctttttatttggccataaacaattgacagtaaataagaccaactctaaccagatttgagtagtttataaacttactaattgtgtccttaatctctccttttcatacttttgctgtccttaatgaccctttaacccaatcaacttcattcattcatacattaaacaactagttatgtgtgtctgcagtggagtaggcactctcctaggtggcagcagtacaaaaaggaacaaaatcattcatatgtccctaataggtttagtggggaaagttaatgaaacatacaaataagtgtattattacaattgtgaaatattacactcgtgatgtaggagaattgtgaaaagtgctgtaaaggagaattgtgttgtactatgagtctctagtcagacaagtcttgtgctatgagagtctctagtcagagaagtcagagaaggtgattgtgaaaacgtgcaactgagttaagatctaaagcaagcttgtctaacccgtggcccgcgggccacatgcggcccaggacggctttgaatgtggcccaactcaaattcataaatgtttctaaaatattatgagatgtttttgttatttatttatttatttttaagctcatcagctatcattagtattagtgtatttcatgtgtggcccaagataattcttcttccaatgtggcccagggaagccaaagaattggacatccctgataaagaaaaaattatgcagaggaagaggaaaggaatgaccatgagcagagacttcccgtaactcttcctccttgggcattctggtctcactttctaacccaagcagaacagagaagatccatgtcatttatactgtttgtcagcatcaagcctttctcttctcctgttccatccactgaaaatctcttctttctccatcaattaggtaatgcctcctatttcctaagcctggctatcaaaacagggattcattatcctgttttgttgtgtcctgtcctggtacaagggcacatagtaccttctctccaggaaccgttcatgtctcctttgcctctgctttcatgccaaggcatatattaaggtctcttgaacccctgctggaaatgcagcttctctctctgctggcaggtgtctagaaaagacacagccctcttctttccttcactagtgatgtggaaaaactgatatactctatctgtagacctgccttgactcatctgaaaagtgggcctcgtcattcttagctcctaaagttgccatcactgttatctacctaatataggatgccttatccatattgtttacatagaaaattttagccgaaccttcaaacttccaaacacttaagattttacattttaattgaatgtcattttaattgaatgttaaaattttacattttaattgaattctaataatttgaaactcttgtccttccttcttattctttccttatgaagcttttgatggcatattaaaaggcaatggcttgataatctttttatgttaatgccagtagagaatccttcttatatttcttgacattgagcttaactttgggatttaaggggccagcagtaagaggttgtgggatctccatgaaatatctagagatgagataacatgctggccatggaaacttcccctcaatttctagtgaaattataattgttttgagaaatatgactttgttaggaagttactgcaaaattaaatagtagctttgaaattggcagttattcatataaataaattccttcaggaagagctggattcagaagcagtttggcagttgtattaaacagcggttttaaggatgccacagatttctttaaaaaaaggcattgataagaattagcagattgaaccataaattgaacctccttccatacgttggccatacatatgctaattcaaaaatgtaaaatcgttattattccctcattaatttgattcgattacctttacaaaatagtttacagaacctgacatgtatattatatactatttgattataataaatgtgaatatttactcttcttaaggaagttaaagattcactcttcttaaggaagttaagtagttcaaacatatttatacatcttataggcaaataatcaaatagtttattccaaaatggtataaccatgatttagtttaggaagacagtcttccagataaagatggacatttgagaatttttttaatacttaaaaaggttttatctggccaggtgcagtggctcacgcctgtaatccaagcactttgggaggctgaggtggtggggatcacctgaggtcagaagtttgagaccagccttaccaacatggtgaaaccccatctctactaaaaatacaaaattagctgggtgtggtgatgcataactgtaatcccagctacttgggaggctgaggcaagagaatcacttgaacctgggaggtggaggttgcagtgagccgagatcatgccattgcacaccagcctgggtaataagagcaaaactctgtctcaaataaaaggccagggagtgggggagtttatctaagttagtcaaaaccaagtaattaaaatatataataagtagcatagagttttctagtgataattaatagctacaagcatggaataattaaatattaagagaggctgtctggtccaagttctaggcctacatatgatatgcactacattgaactgaatataggggctagtgagaatgagcaggctagaataaagaaagcatgcagctcattagaaggaaataaataaagctgggcaaattagaacagattaagctcaaaagatacttgattttgaaaataaaaactgatgtggagccataatgactattccatagtttgagtctttacagagatgatctaagcaggcatcattcaactaatatttattgagcaactattatattccagatattgttctttgaatgctagatgattcacacacagaccctgtcattggaaagtttcctatttaatagtagaggtaaaatatacatgtgaatcatagaatcaacataaatgcccatcagtgatatgctggataaagaaaatgtggtacatatataccatggaatactatgcagtcataaaaaatgagattatgggccaggcacagtggctcatgcctgtaatcccagcactttgggagtccaaggtgggtggatcacgaggtcagaagttcaagaccagcctggccaagatggtgaaaccccgtctctattaaaaatacaaaaaattagttgggcacagtggcaggcgcatgtaatcccagctactcgggaggctgaggcgggagaatcgcttgaactcagagggtggaggttgtagtgagctgagatcgtgccactgcactccagcctgggtgacaaagtgagactccatctcaaaaaaaataaatagaaaaataaaaatgagattatgtcctttccagggacatggatggagctgaaggccattattcttagcaaactaatgcaggaatggaaaaccaaataccacatgttgtcacttataagtggcagctaaatgataagaacgcatggacacatagaggggaataacacacactggggcctatcagagagtggaagctgggaggagagagaggagcaggaaaaatacctaatggctactaggtttggtacctgggtgacgaaatagtctgtgcaacaaacccccatgacacaagtttacctatgtaacaaacctgaacatgtatgtacccctgaacttaaaagtgaaaaaaataaaaaatatatatacacaagtcattataatataaataataataattgataatagaaagtacaccgtgctatgcaaatgcaaaaggaggatgccttcatggggaagatggtaaatctcaaggggaagcattaagcacgaaaatctgttataattattggagaaccaagatattgttagtatttaatgaaaacagaatcctgaaacacatcattactgcagaaacaataaagaatttttatccagcaaaattaacagtccttctgtggccatttttctcattccatgaaaatgtcattcagaagtggctgtgacctgggacctcaaagccgtgatcactctgcatgtacctgtgctccagacccagctctgcggctgctctgcatgcacttgcacttctgacagtggcatctctgtggcccaaacatgcccatgtgctggacctaccaccaaggggcatccccttggccacaactacccctgatagaaggaaaagagatcagcagcactgcagcaccttttactgccaaggaccccaatatatgcaaatcaatcaatgtgatataacacattaacaaaacgaaagaaaaaaacccagatcatcacaatagatgcagagaaagcatttgacaaagttcagcatccattcatgattaaagctctcaacaaaataggtatagaagcaatttaccttaacacaatataggctatatatgagactcccacaactaacatcatcatcagtggggaaaagctgcaagctttttctgtaatatctggtacaaggaaagaatacttactttctctacttttcaacatagtactggaagtcctagtcaacaattaaataaggaaaaagaaaggcaaccaaatcagaaaataaataatgttatctctgtttgcaaatgacatgatcatgtacatagaaaagtctaaagactcaataaaaaaccgttagaactaataaatgaattcagtcaagttgcaggttataaaatcaacatactaaaaatcaatcatatttctatatacaaggaataaagtatctgaaaagggaattaaaaaatcaatccatttacaatagcaataaaaataataaagtactcacaaacaaccaaacaggtcaaagatttatacatgaaaaattataagacattaataaaggaagttgaaaaagatacatgtaaatggaaagacatcccttcatagataggaagaattaatattattaaaatgtccatattactggaagtgatctacatattcaatgcaattcctatcaaaatcctaatggtattcttcacaaaaatagaaaaaacaattttaaaatgcatatggaactacaaagcaacctgaatagccaaaacaatattgagcaaagacatgaaagctagaggcattatacctcctgatttcaaaatatattacaaagccacagtaatcaaaacagtgtgtcttaggcataaaaacagacacatagaccaatgggacagaatagagagcccagaaataaatccacgtatgtatgatcaactaatgtttgaaagggtgcgaagagcacacattggggaaaggatagtgtcttcaataaatgttgggaaaattagatatccatatggaaaataattaaattggacccttatctcatatggtatacaaaaatcaacttaaaatggattaaagactttaatgtaacacttgaaactgtgaaactactaaaaggaaacatagggaaaaacttcttgacattggtctggacaatgattttttggatatggtgccaaaaacaaaagcaacaatagcaaaaatggacaaatggataatttaaaactaaaaacctgcacagcaaaggaaacaatcatcagaataaaaaggcattctacagaatgggagaaaatatttgcaaagcatatatatgatgtggttaaaatacaaaatatataaggaactcgtgcaactcaatagcaagaaacaaacaaacaaataacctgatttaaaaatgggtaaaggggccaataggaggatcatttgagaccaggagttcaagaccaacctccacaacattgcgagacttgtctcaaaaaaaaaaaaaaaaaaaaaaggtaaaggacctgaatagccatttttcaaaagaagacatgtaaatagccaataggtatatgaaaaggtactcaacttcactaatcatcaatgaaacacaaagcaaaacaaaagtgaagtattattttacacatgttagaatggctgttatcagaaagacaaaaagtaagtattcacaaggatgtggagaaaaggaaatgttcgtacattgttggtaggaatgtaagttggtacagtcattatggaaagagtatgaagattcctcaaaaaattaatagtagtatgatccagcaatcctactctgggtatatatccaaagcaaatgaaatcagtatgttgaagaggtatccgcactcacatgttcattgcagcgttattcacaatagccaagatatgggaacaaccaaaatgtccatcaatggacaaatgaataaagaaaatgtttgtgtatgtgtgtgtgtgtatatatatatgtatgtatgcacatatgtcatgtgatgcctaacagcatttcagttaacagtgaaccacatatatgacagtggtcccataagattatacggtattcttactgtaccttttctatgtttagatactttttgatacacaaatacttaccattatgctacaattgcctttagtattcagtacagtaacatgctgtattgcataggtttttagcctaagagcaatagactataccacatagcatagtaggcttatagcaggtgcatagtaggcttataccatctaggttagtgtaagtactatgatgttcacacaatgacaaaattgcctaacgatgcatttcttagaatgtgtccccatagtaaagtgacacatgactgtatatgcattggaatattacttagatttagaaaagaaaattctatcatttgcagcaacatggatgagcctggcagacattatactaagtgaaataaaccagatgcagaaagacaaatactacatgatttcatttatacatggaatataaaaatgtcagactcagaatcagagagtagaatggtggctacaagggtctagggagagggagataaggggagatgtaggtcaaagggcacaaagtttcagttatgtaagataaataagttttggagagctaatgcacaatgatgtgactatagttaatattgtatagtatacttgaaatttgctcaaggggtagatctgaagtgttctgatcatacatacgcacacagagaagaagttacaagaaacagtttgagataaatgggtggagaaagctgttaaataataggatgagattttcttttgcaggccatctattttattcagaggttgaaaacacatgcctccaggcaggtaacatatgagaaaaagggactaggaaggaactgtggctaactggtagctcatacatgcatagtcagtagtgacagtccagccagtccccagcactggtggatttttgtcacagcaggattgtgtatttaaaggttctgtggaaagaaatactattttttaaaatactgtgtctattagtcataccagtttctgagctaagagtttaggcttaattcagcaaatgggatgcattgttctctatgtactaaagtatgcaggaatatttctttaaacttttccagtctaaatgtttcttaaatttttgcccaaacatctgggaagatctcttagtttctatcagatatctccctttttgcaatttgtaaatcaaagcgattttctaaattcagtcaagtaggagaggaaaatagaattgctgttggtgactgtggctcctaactatggttagtgagttctgagggtgaaacaaagctgaccctggagttgttccttggcacttccagcaaggctgcttcaggttccttgcctgtggttgaccctgcacatggagatcctgccaatcccactcatatttacaggtatcactcctgcaggtaagcctaacatacatgtctcttcaccgtgagccaggtaatgaatatatatgtgtaatttaatcatggtttataacctatgcctaataaaagagtgcttgtgaatttagaaatgtttgaaaaaatgagttagaaattaagaaaataagcaggttttaaatttgaaaactagtaaagtgtcaatatgtatgtatgtgtgtatgtgtgtgtgtatcaggtgtttactgcatttctagcaccaggtatggctaacattttaccccacagtattttcctgggcctaaaagattaccatttaataatatctgctatttgcctggcactttattaaactgtctctaatccttaagacaaccctaagaagtaaatgctagtatccccatttttataaagaaatagaggcttaggaatttgagtgacttgcccaagatcacatattcagtacattgcatagcaaacagcctgtgctttgcctactgcacaatacagactcaagaatgtgcacatgataggacaaggatatttaaaatgagaatttcatgtattgtattccatttcattttgtgagcatgtgtatgtgtgtgagcatatgtgtctgtatacatatatatatatatttgtatcatgtgcatatgtatgatcattctgagcaatagtaaattccttttaaagatgcgcagtgtattactgaagacagtggagggtaggagttaggaatataggccgtagaatgaacctaggtcatttcaccataaatcatagcctggacttcagatcccttttctgtaagatcagggttattgcgaggtccacattagacaaaattcagcttggcacagtgtttcatatatttggcacttaatttaaatttaatttaagtattggtcagtattgtcattaataatctgtatgttttctccttaaatttcttgtcttctctcttacttattaaaaatatcactatacattgaacctagattctataatccaaaggcatcaatggacattgagatgcttgcctcatatccaagatgtaagagaaagtgcacatgcctattttaaggcaggccacagataggctataactttcaggtatgagtgggtcaatacaatcaaacaaatcagataaaatttagtaagagcatagacagacagtatttggagcaagtatacaaagacatagaaaagactatctacagggaggttggaaacatttaggatatactgggtagagaaattataggttcatcttttgggcagctgtttagatacaatctagtaggattgaataaagggaatttaagtcacaatacatccattctttacatcttttgctatgtaatgctacaggcaggcagtaatgagtactaggttcattgcaatgagatagaactgaaaaaggtacatctaaaaggatttttaagactaaaacttggtggcagattgaatttaggtggagggagagaaagatgttctaggtagctccaatgtttggccgccataggtttatgagaagtgggagaagcagatctagtttgtccagggggcattgtccagttttatactttgaatttagagtgatccactggagttatcttagaagccgaaactaacaagatccacttttttttttttttttttttttttacagggataactgtaaattcctacatttaggttaagaaatgaattcaattgcacaagtccaggatgtgggatatctgcttgacagttagcttaggggtttttattggccacagacaaaactaattatgcaccaacaatgtgccttgttgctgaaagagtacatgccatgttaggctgcataatagaagtgttgtcatccgccagagggagacccgtggtcccactaacatatgtgctatgagagctgatttcctgtctcaccataggctccatcttttcagagaggggtgctcacaaaaattagagagtggtcagtatggtcaggggtctggaaattatgtcctgagggaaatagttaagggaaaatggaaaaaatttagagggaatatgatagcaatcttcaaaaatttgaaagattatgtgagagagaaggagtgcaaatatttattatgattgctgtgagaagaattgggtagaaatttcagagagcctaaatactaaaaaattaaatatagatagctagatcttcctaacaagataaaagtgctacccattactgggtgtgctcatggggaaggtatataattgcccacctgcattctgtatgttggtctaggtgacttgtaaaatttccttctaggccgggtgcggtggctcatgcctgtaatcccagcactttgggaggctgaggcaggcggatcacttgaaaccaggagttcgagaccagcctggccaacatggcaaaaatcccatctctactaaaaatgcaaaaaaaaaaaaaaaaaaaaaaaaaaaaaaaaaaaaaaaaaaagccaggcgtggtggcacatacctactacttgggaagctgaatgagaatcacttcaacccaggaggcagaggttgcagtgagccgagatcatgccaatgcacgccagcctgggtgacagagtgagactgtctcaaaaggaaaaaaaaattcttctaattgtaagttgctataattccgtggctcatgggtctatgagtagcaatggtgtctttcaatctatagcaatcagtagcaatggtgtctttccatctataaccatatcaatttccaagggagagagaataccaatagaacttcattctacatttaattactgaagagatgcaagctttaaagcttatcaaatagttgtctgtcatatgactaaagccttccttcaggaactacacataaccgtagagaatgttactaatgaaacactgcctacattctttctgtatatctgctatttctgcagttctttgttagtaaaacaccatttgaaacaatgttgtcaaagcattccaaatatcttacatcaagtgtcatcttctcagagagtacttctctaatgactcaatctagtcctgagttactttccattgcattatcttgttgtctttttttcatatttaagactaactactaacacactattcatttgtttacttatttgttgtctgactcacttcccaacatagaagcattgtagagagggatcttgtgtgtcttgttcactcttcctctagcattcagaaatagtaccatcatagacatatcttaaacataattgaattaatgaaacatctaggttggggcttgaggtatttctcaaaggtaactctatccttgctacagtgtttctggacctttctgtataatttaagtaatctacactgaagctctgatgtatttgccatggtgacagagtataaatgctactacctagtctttaagagacatttatgaatttaaaggcaatcagtgaatcttcctttggttatcctatgctatgaagaatattcccagtcgcactcacttcatcttagttttgactttgaaatcctttacaagttgaggtttttatgtgaactctcttcctcttctccaagctacattcttggttgcagagctcagaatttcacatggtagcttcttccagtcaaaggaccatgtggttatccagataaaatgtcttttcctaggtcatctatccattttataatatcttgggagctaacttggatgagataatcaactgtggttgtcgttcaccctactacattcccctagattgcctttcaaagtgactttttccttttcctcaaacctcctaatctcctcctctcagcagatgactttgtttcatatttccgtgagaaaacagacatcatccttcaggaactctctcatcttttcatcacgaattcatctacttatctgatcctcactcaccctttcctaccttccttcctactacccttgatgaagagccctttcacttatctaaggccagcacccacttgtactttgtacctgtctcatcttctaaaggattttgattctgtgagtgtccccatatttaaggcatgagtttctaatccctacagggttatttccatcagcacataaataagctatactatcatttatcttgggggtgggggggaactccagcttcttcttcattttctagtttcccttcatagcaaaagttcttacaagaattgtctattagttgttgtctttgctttctcacattttctgcacagcccacttcaattagactttcttccccaacacttcacccctattttcaaggtcactaatcactttccaattgctaaatccagtggttattttgatgctttaattttgtttagccttcccctgggatatgtcccaaattttcctttttaaaatactttttgtttcttttgcttttgccttggattctgttacactatatatctgggaaatcctgaaacatagatttttgtaatattgaggcatttctctcagaagaaaccttcccaggagtgagggaatctggacagggcagggaaagaacctggataaagaggtggttccaggagaaatgtagtctcagcccaatcccttcagagctttggggcatgccctgcagcacagaggcaaaggggttgggctgttatgtcctggcatctgccatggtgtagcagctgtctggaaggatggagcagaggcacaaccttccaggtaaagcccttccttgcagttaagggaaattcttccaagaagggcgcaggagaaagtcctcacgggataaattcatggtagctgcggatggagcacgactcagctgtgggatgtggtgtaccagatgctttaagtggcctatctttgccttctacttcagccactcctcagtcagttcctctgctgggcttgcattctcatctcttaaaattccacatgatgccttttacttactgaaagctcacaaatttattctgtgctcttgattactccggagaaccctagaattacatttacagctcctacttgacattttcatttaaagatctaaaaggcttcttaattttaacagggataaaactaaactcttgattccttgtccctcctccaaacctgcccttgtcccagtttccccatctcaggtgctcaagttccaaagttaggtgctactcatgattcttctatttatcttacatcatacaacattctggctcttcatccaaagcatatcccaaacccatccacgtctctccaggtccaccatccactacctagctaaagccattgcctcttgcctgcaccactgcagtattgcctctgtgttctctttgtgtttcacttcttgctacccctgcagattctgctgtacagatgccaggatgatcctgttaaaacacatgtcaaataatgttacacatatgcttaaaaccctacagtcatttctcactgaacttagagtaaaatcccaaccccttaccctagtttatgaaaccatatgtaatctggcccaagtatacctttccaacctctttttcgctgagtgttcctctacctgcagtgctcagccacattagctgcatctcctggggctcctcaaccacaccaagaatgtgcctccattggggtctttattttgacaatttcttcttccttattgtcactcagatctcagtctatatatcaacttctaagacaggttctcctgatcaacaaatcactttctcctcactctttaaattgtctctagaacacttaatactgtctgttatttttgtattaatttgtttagccatttagtcattggatggttgctttcttactgtgtaagtgccttgagggcaaagatgttacatgtcttatgcatgcaatgaatattttttaatgagtgaataaatgaatggtgacccacctgctttaagagatatgtattcacttagaatatgtgcagtttagactgcatttttaagctgtttgtttatggatatatttctaagcatcaaaaaacccacaaaaaaacaaaaactaaaccaaaactgaaacccaccctgctttacagtcaagattgattataatctgtgatttccctttgacatatgatgaaatctagttactatgtatcttcatatatctgggccagacccttatattctgtaaaacacaatgacaaaaatatatctaactcttatgtaagaacttaccacataacatacaaaatgagcactgtacagtatatgccctcagaaatacacagaagagcattgatagtgtgggacattacaagctgtttcttgtttactttaaaaatacatgttaccatccctttttttaggtgataattcaccatgagtctcacacttctgcacattctgttaacagaggcactggctggctttgttttggaccaatttttccagtataattacatagcagacaagcttggaaattagaaatagtgtctccctctggaccgaagggcaggcatggttactgcccatcataaaagattcatcataaaagatttgcccatcaaaaaaaactcattgttcctgttcagtaacacagcctacttcacatctaggtatctctttgtgttctttgcattttcagtgcaaaaatagtaatattctggacacttctattgctctaagtagtaaacggtcccttgtatctttcccaggggtctcatgttttctaccagcattcatgaaactgtggcaggttcacttgttagcttgtaaactgggtaaaatcttggacctttcacaatgcctgacacattcttgcgtatctcgccagtcctcagggagattttcttgggctgtcagtactgctagactgctgtgcatgtttcactaaatttaggcaaaagaatgaaatctaccttgttttggaagagactgcaaatagtcactttgataggcaaataatggacccccaaagatgcccacacctaatcccccaatcctctgaatgtgttaggttatatgacaaagggaaattaagggtgcagccagaagtaaggtggatagtcagctaacctggagaatgggaggttaccctagattatccaggtggacccagtgtaattatgaggtttttaaatgtggaagagtcagcattagtgtgatatgatttgaaaaagacttaaccagccattgctggctttaaaggggaaagtggggcatataagccaaggaatggaggctgactctgaaagttaggaaaggcaggcaaacagatcatcccctggagtttccggaaaggaacaccagcttgattttagtcagtgagactgtttctgatttctgatctccagaaatataagataaatttgtgtcgttctaagccacaaagtttgtggtaattttttatagcagttataggaaaccaatacaattacagactctggataaaatagctacatgaatgtattttaacttcacatttacaatagaagaaggcctcaaacatggtagtagatgtattatactgttataaattaggataatggtaattcttagacaaaagcacatatgcaagtaaaacctttaccatgaattcttaggatgagaaatttcattttaatatcaatgtatatttctttgtgttaatttaaatcattgtcttacatccataacaagtactaagtgacatttaaatataaattgtgaatggcttcagttttcttcttaatttttttggttttatgtaaattcattagtttgttaaaacttccaagattccttttatttggcccttactattaaaattctaaagtatgcaattggtaattaaacctgaatagtaaattatgtttaggagtaaagtaaaagactctttgtattttggaaagtataattagattttacaacaaagaatattactatatttttgggaacaatctgtatcacttatttattggattacaacatcaaggaggaactttttaactcccgttatgtgcagttcttcctaggcctgaccaatctgttctctgtaggacagataactgtagggtagatcttttctacgctcattataccatttcaatagtttgttttctaaattttgtgatcccacagagtgacatcacccacagagcccacacagcctgcagtaccaggctgtgtacatgtaatagagtggtcttatggcctagctcatttgggagtagtatgtcaggaggacctcagatctttggctatgtttctgttttcagtaacttagctcctttgctgagtgtttaatagtttgattctataggtcacaaggttcagatactcttaaattgttcaaatgatttataaatggatcatcggttgtggttttacatatccttgggatggttagtaatataattttaatgaacttaagtgctctaattaaaaattaaattgtgctttaattaacataaagtgagcatgaagctcaaatgaactttgtttgtaaagataactttaggtataactgaaataattgtttaaaaatattttgaagttttcttaggttacatagatgtgagcaagggagcttaaattatttctttttttcatttgaagttggatgatatatgagtccattaaacctctatatgtttgcagttgacaacactaaatctgggaaacaaccttttagaagaagttccggaagagatgaaatatcttacatctctgaagaatctccatttatctggaaataggatctgtagatttgcacctggagcctgtggtaatttaatcaacaaggaacaacattatagcatcaaatttaatctctcatatttaataatatgagactgaaatgaaaaagaattttgcatgtttaatctttttttgttggagatatttacatactactcttgaaatataggaggagacaacacttttaaaaaagtattgtatcatatgtttatttacatgtagacctaagaaaataagtaagcatcagtgttaatgaattttcctctttgtagaatcagtataaagtcagattgtgaatctggggacccttttcctaagccagagataattctattgggaaatcaaatcaagtaaagctatactgtagctttgttcttttcactttttattctgtcttagatattaagtcacactttttgatcaagatgctaaacttaaatcaatttggggagaattttaaagaaaagatatgagatccaataagcatttttttctttctttttcccattaactaataatttctccattcaagatgatgctattcttatttaatattcctagagtgggcttaaggacaaatgtatgacaaagagatctacatggcttttatagctttatcaactaatgtaaggtacttcaccactttctgtgttggtccttagtagtaaaatgagagaaatattataaaatttataaatttctatgaacttttgaggcatgggtgctatatataatcattgtcatcttcacacagagtttattaatggcattactgcatgcagcaataaattaggggttatatttggcaaatagcacaagtagactctagtactgtctttttaaaggtactttaaaatcttaggtcatgtatcttggaacaatattcttttccaaaataatagatgtaacaaacaattattgaacttgaacaccttatatatgcaaagccacagaccagagttcagttacaatttaccttggaagaaaacagtttacactaaaaaagttaaggtcatgcaaatcaatagataataatattttatgacctatactgaggggacaaatttaagtgcaacctgatatacataaacaatattgaacatactaatttatactaattaaggctctataaggaattttgtatcatgttgcctttaaatttgaggtaagttaggtatatatatatctgtatctatatctgtttagatatattttatatatgtatataaaatttgtttggagtgctcttgaatgtctttagtttctatatttctttttaaaaataattatttttttaattgacagataacaattgtacatactcatggagtacatagtgatattttgatacctataatatatagtgatcagatcagggtaattggcatagccatcatctcaaacacttatcatttcttcgagttgggaacattcttgacttggggttattgaactttgaaaatcccatgtgattgacctaagttatgttctatgtcaggtcctgatgattcaaggtcagaagtagtttgatgtcagggagtttaatgctgcccagcatgggtagaataaccttgttgcattacatgaccctatttccctgaccagagcagattgatcagggctggagttgggtcccaagctaagcttgtcatattttctctttcttgggaattgtgatagagtctaaaacagtttaattggtttgagataattacatgacctgaggcagagattgcaaactggtggcccatgggctgaagctggttcataaataagttgattctattttttttgcctttaaaaatctttgaattaggtgcccatgttttcaaatcaggagagttcacaaagaagtctggatctctggctctttttaaaaatctgttttaaaaaagaaagatttagcaacactgcagttgcgttcccatatgacaattgccagagctggctgaatggtggtggccctgtctgacatggcatgggattatcattttgattcctgtggacatgtgagtttgaaagctctgtcttccctgtcaatgaacattcaaattcagaagttgtgatatggttatgagtacatagaaaaatagagcaaacatgttcaaaagagagaatggagggaggaaagagagagcgggtaagatattataaatacgaaaatgagagaagctgtaatgaagaactaaattatattttctgcagagatattcagacagtacattctcaggttctgggtgcttttagcttctgattccagtttttgatgagcctggttgcatcctcattccacaggcacagtgacttagatttgtaactttgtgataaattactcctttttgcttgagctagtttaagagggtttctgttaccaccaccaaaagagccttggccaaggcaagaaccagaaggaaaacaaaggtatgtagaaaagtagaaaagtgactaaaaattatctaacagatggctaaagtgactaaaattattttctaacagatggcttacaaaatttaatcctgcttaatctgaacaacaatcatcttacgcagcttcctcaagaagtcagcaggtaattttgtttatagcaagacttggttaacaatcgtgcccctcctctatccccaccctggtcatttgaaagcattatgcctagcataagtccctgtgagatttatacatagcaaagagggatctgaaggactgaggcaagccactaattttaagcagatgattccttaaacactttggagaaatgagaaacagcatgataatcttagtgtaaacattgggctttgaaacataaagttctaaaactgatggtctcattgatttcccaactctgaggttcttggagcttggttagccacagaattgggcacattaaatgttatttcgcatgtgtattgtaaaccattttgagcttgatggaaaaggtaatgtaaaaactaaggatttaaaactgcaatgtcattttcgtttttaaaaaccccacattttattgtcattaaccaaaaaaaaaaaaaaaaaaaaaaaaaaaaaggctgtttttccttatcctgcatatctgcacaggcagaatgcctttctggagccagctgagagccttgtccttctgtaggcaaaacacgctcttgggcttttcctctgacagatggagagagaactctgttcaggtttactttggagactccctttattgcctgttgagcagaaacagatgtgtcacagagcaagagcagcatccagggttttaaaagagaatacaaaactttgaacagtcctcaacacagtgctttctgcagcacctaacatctattccaatttacttgtctatacctctggccaatgtattattttttccaaatatatttttataaggaaagcaatattttaagtcagagcaactagaaaagaattgaatcaatctaatttctataaaagataaatatttgcagcaatgaaaatgccatgctaatagttgtctgcttgcttttttacaaattcagcttatcaatcgatgtatatattgatgatgatataattttaaaaatcccttgggagatctcatgaatgaggttcagggcatatctctgtgcaactagatttatgcctttggaccagtaatttaactactttgaactgctgccttctcatctctaaagaaagaattttgaatagatgaacctcaaagtttttgcagctataacacgttatgatttcacaatttcatacacttatctctgtttggaatacaaattacagtattcaaggaatcgtaaatctaagggaatatgttagaaagatgaaagaatgctttcactgaagaaagtaggattgcagagtgtataggtctattctgtcttatagttaactctggattgtctatattctggccatatcctactagatatcaattaattggtcatctctctaagtagaattccatttctgagcctgggaaagtttcttcactttcctatatcttaacatcttcacctgcaaaatgaggatgatgatagtattttcagaaaataaatcggattgttttgacagttaagcaaattcatacaatatatttagggttgagccttggacataaaaggtattagggttgagtaagtgctcaatggatgttagcttttattattattggttgttatttttattctagcttctttctgttccctttgttcactgatttccagagacaaaggaatgacttctcagtggatttgggcaaagcattgagcatatgtagtttggcattctcctcttgccctgccatgaagtaagcagcagcctcagcaggaaaggctgtgaatggggtggtatatttaatgcagaggagggctagcagggactcagagtgatcatgtcagctctgtgctgatgtttgatttccttctctctaaattccatatcttatttctcaatttatttagaacttaggagagggaaaaggagttttgtttttggctcatttaaactacagaatatcagttcatggacttggagtcaaatttgggcaggtaagagttttacacctaaacagctctgtcatggacagcgctgcacaggcacaggaagaggacagcatgggcatcctggtgacagaatgagtctggaagacagagagagagagcaagggactaagtcagcaggctcagttctttctccaaattcgtcagtcagtgaagttgttcttcaatctcctggggaagacagatgtcagggagaatctacaagtgtatctcctatagattttctttggaaaagtaggacatctccctgctttgtggaatcgggaacaatggcagatatttgtttctctccctgctctttactcacacaaatgaatgatggacaaatgaacaataggatctgagctcattttattgccttgaaagaacaaaaaagttaaaaccaactcccatgatatagtaaatcagagtagaatcaataaaaatgataataaaaatgattataaaaatgattaatgaagaaaattccccatccctttccccacaggacctgctccacacatttttactccatttcagtgctgagttgtccttctttgaccctttatactgcaaagaacttcacttcctattatcctgagaaatttgagctccctcaatttccttcttttcagcatctttctctccattgttctatttctttccttcctctcgctcttgcttccttgtcatctctctctgaagtcccgtgtcttttgcttttgcttcctgtgtaacacattgtaaattctcttctgtcttctccattctaccttagatcattttcaaaagtcgttactgtcctttacatagtcaaatataatggccttttttttctgctgaataaaaattacataaaactattcaatgcattttgtactattcaatgcattttgacaaatgtacgcacaccaataagatgtagaacattttcttcagcccagaaatttcctcatacacccttccagtgaattcttacctctcataagcaatcaatattctgatttctgtgttctttacaaattagttttaccaatcctagaactaaataaatggaatatggtatatacatttttgtgtctgtcttcttttgcttagcatattttttgagactcatataactgttgcatttattagtagttcattggtttgttttttgtttttgtttttgttttttattgagacagagtctggccctactcacccaggctggagtgcaatggcatgatctcggctcactgcaacctccgccttccaggttcaaatgattctcctgcctcagcctcccgagtagctggtattacaggtgcctgccaccacacccagttaattttcatatttttagtagagatggggtttcgccatgtctgccaggctggtctcgaactcctgacctcaagtgatctgcctgcctcggcctcccaaaatgttgggattgtaggcgtgagccaccatgcctggcagtttttgtttattctgagtagcatttcattgcgtgaatatgccctaaatcatttgtcttttctcctattgatgtacatttgggttatttccagtttagggctattatgaattaagctacaataaacattattgtacaaatctttttgtaaacatgtttaatttcattttcatttaaatttctaggagtaaaacagaaatttatttctcatagttctggaagttgggaagtgaagaccaaggtgctggcagatgtgatgtctggtgagggtctacttcctggttcttagagtggcacctttctcactgtgtcctcacatggtagaaggggcaaggagctctctggggccttttgtaaggacattaattacatttatgaggtttaccccatcatcatgacctaatcatctcccaaaggccccatctcataataccatcacattggagattagattttaacatatgaattttgaagagacacaaatattcagaccatagcactgtcatttctccaataccatatgatcttgattatcttgattgctgtagctgcattgtaagttttgaaatcaggtaaagtgagtcttttgattttattctttataatagtttggctattctaggtcctttcaatttccatataaattttaaaattgatttgtctttttttttttttgttttgtttaagatggggtctcactatgttttccaggctggtcttacactcctgggctcaagcaatccttccaccttggcctcccaaagttatgggtttacagccatgagccacagcacccagcccaagtcaagtcttatacaaaaaaagctgtcaaaatttgtatttgaatctattattgaatctatagatcaatattaaaaagttgatatcttagcaatattttgcttttctatacctgaatataatatatctctacttttatttaaagcccctttacattctctcattcataatttatagttttcagtgtagaggtccctcatgtcttttgttatatgtactcttaactatttcatgaaggtttttttatacattactataaatggaaatcttaaactttttattttccaattgtttgtggctacaatatggagatacaatagattttttaaatattgactttgtagtttgtgactcggcattatttctactagttttgtttgttagtttggattatctctctttaacatttaaacttttgaccatctctttaattttgaaattttcttttctcacaccttcagagattccttgctaatctggttcttcttctacttctgtgttcataactttgctgggtgcctttaatttttaatggtcagttgtttatatttctcaagaatctttctgttggcttcctctctcttctctctgcccattttcttttgttgtttttcctatcaatcccaggtattcatatggcttctactatgtacggagagatctgtagaatcctcaaaattccctttgctagcactgatgacttcctaacctccagtctcccattttcaactgcctaaaaatttagttccctcattcttacattacttcaatcttaacacacttcaaccttgagatcattacatgttttcactcttagctttgcaaacagacacacctgcattagaattttgacattgttacctactagataggtaacttggggaatttatttactgcctctaatgctttattttcctcacttttaaaataagagtagtaattccaacctcagagtcatgttgatgattattaaatttaatgcacaggcatgtagttgtgcttagtaatgttaattcccttctgcttccttattcataatatttttcttagcttactattccctcttattgccctattttataagttcttttattcagggccaaattcaaaatgtcagttctttagaaaaacttgcaatatgcttcaggaaccatatctgcaattacagactcaaatttccttaacctttttctccttagccaatggcatttgctgttctcagtttgtggctctatttaatatctcctaaaccagggcatccaaaagggcagaatttgtggctgattcatctttgaacttccacagcaattgagcagtactcatatctatttggtactaggtatatttatgtctatgtatgcttatgcctgttcctgtattgatctatatacataggtatgtccgtgttctccttgtcctctagctttctcttgggtatggccaatgtatatgtataaagaaaggaaatataattttctttttctgaaatctaggttttgattacctaacatacttttaacataagccatctgattacaaaagatctttaaaaattaaatttcagcaaaaactttttatactcatgatcacaatagttgtaaacacttgactgaagtaagctcagaagagctacaaaaaataaattgacacatggcttctgctaagttgggcctatatagtggactcttattcttgtgagtttcattcatatactttggtgtttttttttttttagattaaaaagtcttacttatatgagtataaattataaccaactagccagcattcctagagaactttgttttcttgagaatcttgttgaacttcaacttaactacaatcagctgatatgcatacctgaagagattaaattcttgaagaagcttcagaagcttttgctagccagaaacaacattggagttttgccggaggtaagcaaaacatggaaccacagtagtttgctgttggagaagaactcaacatgatgggaggtggttatagattagatttgggtatctgagtataagccaccacttgctttctctcagattaaatgtagtcagttcccaaatccctatgacagaagaaggctataatttgaattatcccacatagctagggctgccagatttagtaaatacaaatatagaatgctcactgaaatttgaattccagataagcaatgattaaattttttactataagtatgttgcaaatattgcatggaatagactaaaaaacctatttattgtttggtatttctttctttcttctttttgagacagagtcttgctctgttgcctaggctggagtgcagtggcacaatcttggctcactgcaacctccacatcccgggttcaggtgattctcctgcctcagcctcctgagtagctgggattacaggcagacaccaccatgcccggctgatttttataatttagtagagacggggcttcaccatgctggtcaggctggtctcaaactcctgatctcgtgatccgcccacctcggcctcccaaagtgctgggattataggcgtgagccaccgcacccagccttgatatttcaatttaagtgagcattatatattttatctggtaacgatgtatacagaacaaaatacaagttcattttggctttggaatatgtactggctctccttttttccttcatattcactttctgtcctgccttctgcttgggagactgacctgtgtgggcagcagtgaacttctttgtcctctggtttcctcttggatatggcagatgagaggcactagcaggaagtgacagggcaggaggatagcaagtagttgatggtattcataattatggagactgagaagtcctacagcaggctatctgcaagctgaagaccctggagtgctggtaatgtggctgagtccaactctgaaagcctcagaaccagggaagcaaacggtgtaattctcagttggaggtcaaaggcctgattactgggaggttgtggtggtggctggaggggaggggtactggtgtaaatcttagagtctaaaggctggagagcccagcgttctgaggtccaagggcagaagaagaagtgtcctagctccaggagagagaggaaattacattttttttttcatcaagtcactaactgataggatggtgcccagcaacagtgaacatgtatctttcccaccccttctactgactcacacacccatctcctctagaaacaacctcacacagacacacccaaaataaagctttaccagcattgtaggtattccttaatccagtcaagttgacacctaaaattaaccatcacactagacttcttatagttctatcccaaacaactgtttgctcttaatggaacatcatttgttccaaataactcagagaatctcagcttaaacttcactttttccaggaagcctttcctgacctcctaataccaaattttccatatatcactgtttccttaacccttcgtaacacttctcattctcatagcacaactttgtccttgcctatttgtgagtttttaaaccttcattgaatacttgtgaggggtatacacatgcaaagatttgaaaaagacagcaacaaatatcaacagcaataatagtggcagtcatggcagcaaaaacaaacaaatgaaaatgcaagagtcgacagcaacggaagtaatgctatgaagtgttttcaagtagggtggaagcccttatatcataacatgagatactgaaggaacacattggagtctgaaaatctctgcagctaaaacaatacaaaggagagtatcatggcaatggaagactatgtaggacttaagaagaggactcccttcaaggatttgctgcctagctgtagggaatggggattgcagacagcctctagctgttagctctttcagtaacttaagtaatccattcaacaaccgtatgacttaagggcttctattagcattttcattttacaaataaagaaattgaagtacaaagcaattaagaaatttgcccatagttatagtacctgccagaggtgagatttcaacctagatgtagtgtaactcacagtggccatgttatgttgccctggagtggtcagaggaaatgaagaattcaaagagctggcagtccaggatatgggggtctgctcgggaagatgtgctgaagaattggtcagtacagtgattagaaaagatggccaccttcatcatgttggagctttaaaaaaatttatgattttccttatgattttaaatattagatttaaaaaatctctctcttctgttttctgacacaggaactttgtgatcttaaaaaactaagaatcctagacatagctggaaatattattcagatatttccatcaggagtaagtagagtcaacttccattataattgaaaaataattttgtttatgctattgggaatagaaaaaatatgggcagacagtaaaacctgtagtaattgaaaccttaaattatacaaatgactcaaagatttgcttttagaatttcaaaacctgttctctcctgtttttttctttgtgttctgtgcctgctgaacttgtttgaactaagttaactctgattgctatcacaaatattttaatatatcagctatgattaaattttttggttattacacactgcttttggtcacctctggctttttgaaaatattactttctggagcataaatttttatcccttgtaattaatccaaaggtgacacttttgttagtcatttttaggccataaacaatgaaaaatgcacttttttctcatttgaaaatgaattttgacctcattttatttcaaatatggagaaaccgtttgtcttggcaactcctaacttttgagaaagaaatgtcagtttttcctattgcatttttatatccaattgaacatgcttaaacattcatggtaataatgagaagtccatctatccagaaggtattcaatgaatagttgttgacccattaattatttttcctgatttatcccctctaaattgaggtttcagtctttttttacctcctagagcaatattttatactgaaggtaattcaaatataaaaaaatgagtgtaaagtctatgttttagaaaaaagtatagtttttaaattgtggcaaaatatacacaacataaaatttaccattttaatcatttctacttgtatagtccacggtactaagtactttcacattgttgcacaaccatcagcattatccatctctagaacctgttcatcttctccagctgaaactctgtatccattcaactccaactccccattccctttgtacacctattttagaagttcctataaatactttgaaataagatctttccccccttcatggcaaccacatatctactatatatctctgaatttgactactctaggtactctaggtaccagataagtggaaccagatatttgtccttttaccactgacttatttcacttagtaaaatatgactaacattaatttatcttataccatgtgtcagagtttctttcctttttaaggctgaataatattcagttgtatgtatataccacattttgtctatccacaggtatctgcccacctgtgggaccttgggctgttttctcattttggctattactgcaatgagcatgggtatacaaatatttgttctttatctgctttcagttcctctgggaatatccttagatgaaattgttgaatcatatggtaattctatgtttaattttttaaggaatcaccacagtgtttccaaaaatgtgtagatttgaatgtttagtaaaaattggatattgttaatattgaccttgaaaatgtgacatggttttatttaccctctgtgtcttaatttaactctctatgtcctgcgatgccttctggtgccacttcttctatggtacccctggtgccactgctacttctatggtatcttctggtgccacgttttctacggtatttctatggtatgcttgagcaacataatggagtaattcatttcaagtctttcttgcttttggatggtaaacttccagagaaagaatactctttttttcctctatacctgcagtgtcttgaattttaactcaataagtgtttgttaaatgaataaatctaactgatgttcttaaacttcatttattattcacctttcaccttcgtagtctgttaattgaccgtttcttctatgaagtgattctgtacttaacaattttgataaaacataattacttaggtcccaataatttggagtaattttgacaggtctgagttggtttcatctgtgtagtacctatttcaggaatttctataaacactctcacataagatgatctgcaaactcatctgagctttggtccaaccatttcaaattattttggttcaactgattcaaaatcaaagtttcccacattaaaaatatggcacaactggtggacctagaggagaaatgaccgactctaggtcacacaatgattatcagtgaaagagagtaagtttcaaaataatggtagagaacattcaaaacaagccatgctttttgtgaaacacagtagtgtagacatgaataacatagactttggagtcatatacacatggatttaaagcattaatttcctattttctaaattcgtaatctcaaacaagttgcttcatttctcagagttgctatttcttcatctatataacgacaatattaaaaccactaacctcataaggttgttatgtcaaatagtgattatgaagcattttgtgcatagttggtttccaggaatagaaactattatatgttgtgtataaaatatataccaataatgaaatactaataagtaatatataattatagcaatcatctactctctactggtgatgataggaagcattaaccttgtgaagtacatttttaaaaaccttttttaactatgagaatattcaaacatatataaaaacagacagaaaagcaaaataaagctctgtgtacccattacttttaagtgtactcttaactcaaagatttgaaactgcattgtgcataagtgcctttgaatagtttattttactgccttataactactttttaaaataggtatttatttaagagtgttttgctattttatgatttaaataaatttggtgtgcaatttagaaaatgcaatttttttcagagcagtatttttttttttttgaaattcacatggcatttgaacatttgaaactgtatttgcactaggacttttgtatacgaatatacattaaatgtaaatttacagtaaaaaattggactattataaatatttgttcatatgtgttggatcaaaagagtttctgtgttatttagttcctaagaaaaaatctggcatgaccacatagtgaattaattgtttcagaaatggccagatatggtggctcacggctgcaatcccagcatttcgggaggctgtggcgggaggattgcttttgattccatgagttcaagatcagcctggacaacatggtgaaacccctatctctacaaaacaaacaaaccaccaaaaaaattagctgggtttagtggtacaccctgtggtcccagttacttgaggtgaaagtatcactcaagcctgggaggtagaggttgcagtaagctgagatcatactccagcctgggcaacacagtgagaccctgtcttgaaaaaaaaaaaaagaaatatcttggttcttttatgaacatgtagtcagatctgctacagagagactttagtttctttccttacctcttttttcctttcttttattttaacttaaaaaaataaaacttaaaaattttgtaagttgtacaacttctgcatgtttcttaaaatgtgaagcaaaacaaaagtatggaataaaaataaaagtttcggccgggtgcagtggctcacgcctgtaatcccagcactttgggaggccgaggcgggtggatcacgaggtcaggagatcgagaccatcctggctaacacagttaaaccccatctctactaaaaatacaaaaaaattagcagggcgtggtggcgggtgcctgcagtcccagctactcccagctaattttgtatttttagtagagacggagtttctccatgttggtcaggctggttgcgaactcctgacctgaggtgatccgcccacttcggccctctcaaagtgctaggattacaggcgtatgtacaggagaatggtgtgaacccgggaggcggagcttgcagtgagccgagattgcaccactgcactccagcctgggcgacagagtaagactccgtctcaaaaaaagaaagtttccgttccaggacctcttcatgtgtgtttttagaaaagcctgttaaaacatttttttcacacgatactatgtctggattggtttcattatatttaatttcccagtatgatttttctttctaaaaaagtaccatctggccaggcgcggtggcttacgcctgtaatcctagcactttgagaggccgaagtgggcggatcacctcaggtcaggagttcgcaaccagcctgaccaacatggagaaactccgtctctactaaaaatacaaaattagctgggcgtggtggctcatgcctgtaatctcagttactcgggaggctgaggccagagaattgcttgaacccagaaggcagaggttgcggtgagccaacatcattgcaccattgcactccagcttcggcagcaaaagcgaaactccgtctcaaaaaaaaaaaaaaaaaaaaagtactatccaagtattctccataaggcattatcaatgtatcaatagcagaaagatcagcgagagaaagcaaaactctgggggctattttgatctgatctatctatcattgcacaattttagaacattctcagttttctcacatacaattttttgatacctaattcctgtctgagacataccaaattatttattgtattagtttgcaagtgtcctctgcttcttgaatgaatgggtattaagatttaagatgttgtcttcatttatccttttgtaagtagcatttttctggtaattcattcattgtagaaaataagtaaataagtatagaaagagtaaaatgtaaggtgtctttaagtttaccttccagagactacactttattgttttcttcaagaatctcatttttatattctcattaaaaaaattcaatgtatactgcataaagaaatacgtgtcttgctttgtcattttcatttaacattatatattaagcactttccttaaatgaatattcttcaatatgtgattttttttttttttttttttttttttttttttgagacggagtctcgctctgtcgcccaggctggagtgcagtggcgcgatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctcaatatgtgatttttaatcattgggtgttcttctaccttttctttatcgtgtgttcactttttctgacatttttatttattgctggaattagaattggattttgaatgaacaagcctttgagaacaaggatgatctgaaataaaatgtcttttatttgtatctgtctttcagagaataacatatctgaagtatggcctttagtggacactggacaatttatggcaacactgtcggttgttcagttagtgcaggaaacagtgatgcttgttttattagtttcctgaggctgctatagcaaaatatcacaaactggggcttaaaggacatgtctttgttttctcttcttagaaggataccagtccttggattgtggcccactctaatccatatgacctcattttaactagttacatctgcaaagactctgtttccaaataaagtcacattctgaggttcagggtggatatgaatcttggaggacactatttaacccattatacttgatagaacattgagtttattactctatttggcatctgcaagggcaattgatataaacctccttgatgaggtttatatgactttccaattccataaacaattactgagtaccttctctgttgccaagctctcttctaatctggggaagtaaatgaagaaatatggatgttgctgtatagaaactttggaatttgtgtttgaagaaatctctaaacattgaagtggaacctggagatatcataagaacaagataaatatgtgatttttaatgatgtacagaaatttaaaatgagaaaaatcaaagaaactggcatgaattagcttgaacaaagatgcaagtcagctaggtggtaatttcattgttgagttcaaaataataaggggaaagtgacctgttgccttcataacttttgatgatggggaaagaaaaaacattattatttgctgctgaagggttttggataggctatcatcgtgggatttctgggaagaaaggattactaatatctttctttaggtcagaaaactcagtctatgaagtagttgtgattcagtcttttcaacagaaaaaaaagtaaattattgaaattttatatttcctttgaaacagtttttattttaatcttttagtcacaggtcttctttctctagctcctctttccctcaggagccccgttatttttcaaactgcaatcatttgaagaaaaagatgacctgacaaaagcaagaaaaagttttaatgatcatcaccagggagcatcatgagttttgtgtttgatgtgaagttcataacaaaatatcatatataaaatattgcagaccaaatagaaaacttcacatttaaataagctcttagaatcctccgttagcaatctatctaacaacctgtactattatgactacttttcaaattcacaaaaagttatctttctggatgaatactttgctgttatctaaaaatttgcaagttatcaaatctatttgttattgaataattccttgaagaagacagatttggtatcattattcctgtttggagctgaggatattgaggctccagagtagtttgtccgcagcagtgaccctcaaacttgaatgtgcatcagaatcccctggatgccttcttaaaacccagaaggctaggccctccttctaggatttctgagtcagtaggctggggatcccacaggtttgcatttctgttatgttctttggtaatgctgatgctgtaagtccaggaactacacttggaaaaccattggcctaaatgatggaacagtggcagaggttgaacttgcactcaagacttttggctacactgtcaggactccttctgcctctgaggaatccattctttgtcccaggttggggcagtctctgtcatgctatacaaataaggcatttctttgagctcactgggagtttgggttctgagaatttcactgtgtccttgactaaaatgatactcaaggaacattctttggacaatagaattcttgtatactctgaaaaatatttcacatagaaactaggattttggtatgtgaacacaaggaatgcctatatagttggaggctgagttttatatgttgtttaattcggttagccttacttctttttagccacactgtggatgtactcggtgcatatatgccacggacaaaacttcttaaacatttattcatcagccaatctaaaattggagagattttttagcatgtgaatttaacactaaattttattttggagaaatttggggaaggccaaatctttaccatgttactttcgtttctgagttttgtctttttaaagttcaccctttgccttgggtggttatagtttgggagtgaaactcaagtgtagctaaaacatttacaaggatacaaataaatgtgacaacttatgagaaagtgctttgctaagagtagacacttaagaaatgtgcttaaaaagatgtaaattatacccaatgctacattttccacagtcactgctttctttcagtttcaaattcatgatttaacattcatgtgaatctgtagcttccataaacacattctgtgtcagagttaagaatcttaagtatttgtatatccctaaggtttgtaggcacatactgtttttataagaaaaaaaacataaagcgggaaagcctcatacaatgttgtcatgagaaaaagtatgcttggactatttatgggaaatcatagttatagcacctattccgtttcatcaatgccccttttttccttcaagaattctttagagttatcataaataaaatttgagaatactgaaagcagtttcctcttttacagtatgagaaacacaggaggaaaaaaaaatggaagcaactttcccagaaatacaaatcatttgaatagtgaggagaaggtttgaatccatttttcccaaacaaaaattaaatttgcctagcttaacaatgtacccattgtgtgaccttggagaggtaactccattactctatgtctcacttttttcctctttaagttggggatattaataacacttgtatacatcacattgttaggaaagtgtctcacataacatttggtggtcagtaatgatagaatgaatgaataattaaatgagataatgtatatgaattcttattagtgtttggcacatgacagatattgaatgttattttcttgtcattttaaggtttggtctgagatacctgcccctcaatccaccccaaattttggggtgtctctgaaggctttcaaagccatgagatcacctgaatggttctaattcgtaactgttactgtaaccaactgatctgtacccaagggtgtacaagggtggctggtttcagcagtgcactctgctttctattccccatgttgtctttgcccctgttccaggttattttcctctgcagattcctttacattctttaggcttaccttccttgggcaacaaaacagaaccaataaactatctccctgaagggggtctcctttccctggctccttgcctttggttttctgtttatttctgtcttaccctttccctctcccttgtggctcatttggtttgtttgccagaccagattcctctggaaataggacctctcattactgaattccctttttcttagacacttcacttaactcgttgcctactacttatcctgacgtctcttcttttcttggatatttttaatttaaaaggatttctctttttatacccaatgatgaatgattttgatccacaccagtctaagcatatcttgctatggtgtccttggttccagacacatgcctgatatctagcatggtacataccctggtttactgtcactctctgtctgttacttgtctaattcaaatactaccggtatcttttgttagtacataaatattttttgtgcttaatacaaaatcaagtgaagaaaaccattttatttttggatgattctcatttccaaatgaattcatctgccttcaatagaatgatttccatatatgagcagtaacacaaatatgtgcacatacagacaagcattcctagggagaccatttagttttgcattaacagaaatatttctgtgaaattgattgaacacttggagaatgtctatttcaaatttaaacatgtccatgatcaaaaatgtccttaagtggtccagaaagtgcaatacaattgtgggaaagaaactccttgggaaagtgaaattgtggtttgccttgtatcaaaactcctatcaaaacttttgaaactcttttgcaagatggtagaaaatagcctaaaagtttaaaagtgatacacagggaaaggtccataaagctgtggtcaagaacatccctgaatatctccacaatatagtgatttccttggaactatccactttgctcaaatagccatgagaaattccagttggctgcctcatccccattgttgttctgcctcttttgattagcagcattagagatccactttattcttgttcccatatgaatagtttattttctctgtttaatgttaaggaaaagtataccctattcttgaagctctttaaatgcctctctaaaatttgaccttgattttaaaatagtataattttctttggttgtcagtgctgctttcagtggctcagtttattaggagccatacatttaaaacaacattcactgaccttttaaaaaatgggaaacaagccaatgctattctaatggaaaccccttgtgggttctgtggttttatgtaagtgatgtaagcttagctaatatagaattagtgagttccaaaacttgactaaatgctttccctgtcactacttttatgagaatgagatcatattttctgctgtttcttatatgggggtgggtgaagaagagggtgttgaattatatgttattgcttctttcaccattgtaattctaaaatttcatggggtagactttttgaaatgaaaagcagagagaaaaaattatgaaatattatccttgatgcaatggtgattttgttcaaattcttgttttaaaaattgagggcccaattaagttagggaatacaactatctttctctttttagttaacttacataatttgagttctgactttctacttctatatgtgattttattagaattaaagataggctggtcctgaatgcctataaaatgtaagtgctgcagaggaccctgtttcacatggtatagtggttggtgaacagcatttcaccaaccactatcgctagctacccttggaaattttattcttctaaccaagtacctaatgaaagtaattcaggagataaaggggatgccttgcttaccttcaaaatggagatcctcaaatttcagcaacattcacctctcatctctcttgttgagaggccagaaggacaggatcataaagtcagagagctggaacttctgtgtttttagtcttgcagtaaaagtggagttaaaatgatttcaaaatcagggccaatatttttgagaaagtaaactttaaaaaattaaaaatattataaagagagtctgattgaaatcaaatgtggctcttgtacagactgtttaagcattgattttcatttagatgatttctctctcccttacatctccaagtaatctctatggagttcggggtttttgtccctttcactgatgtattccaagcttataacagtgcttggcacagagtaggcacccaataaataattacagaaaggatgggtagatggatagattgatgggtgggtagatatggattttacataacaaacatgattgctttgctcctctgaaaaatcaaaactaatttgtcacaattaataataaagttgttttaaggcagtggatttcaaccagggaagatttagccctccctccatgtcccagggatatttgacaatgtctggagatatttttggttgtgaaaactgaggagtgatactgctggcatctagtgagtagaagccagaaatcctgctaaatgttctgtaatgcataggacagtccccccataacaaagtattacctggcccaaaatgtccatgttgagattgagaaactagtttacattcctaccaagttgatttaagggattgactatttctttgtgttctccaggctttaatcctaataaaatatatctttatcaagtagattttagagtctataagaatcagcaatatgcctgttaaaatgttgatccctgggccccatgctcatatattgtaaattattgctaataatgctttggctttaaagtttatttttttctcatatgaatatagctatattatatataaacatataatatatattatatataaacatatattatatataaacatattatatattatatatattttgattcacgtttacatgatatatctattttcactgcctactttcaacctttttatatccttatattttagatgtatcttttataagtaccatataatacttcatttaaaaaaatccatctgactattctttttttctctttgtttgagacgaggtctcactattttgcccaggctggtcttgaactcctgagcttaagctatcttcccacttcagcctcctgagtagttgggactgcaggcatgtgccactttgcccagcctgctgtgtatatttaatttgttctacttgttctgtactccttttctgttttttcttttgaaataattggatacttcttaatgacacattttaaaaaatcttacgaagttttatatcattttactattcctattttaaaatttattttattttaggttctggggtacatgtgcagaatgtgcaggtttgttacataggtaaacctgtgccatggtggtttgctgtacctatcaacccatcacctaggtattaaaacctgcctgcattagctatttgttctgattttctccccacctggcccccccaacaggccttggtgtgtattgttcccttccctgtgtccatgtattctcattgttcagctcccacatatgagtgagaacatgcggtgtttggttttctgttcctgggttaatttgctgagtatgatggcttccagcttcatccatgtccctgcaaaggacatgatctcatgcctttttatggctgcatactattccatggtgtatgtgtaccaattttttttattatactttaagttttagggtacatgtacacaacgtgcaggttagttacatatgtatacatgtgccatgttggtgtgctgcacccattaacttgtcatttaacattaggtatatctcctaatgctatacctccccgctccccccaccccacatcaggccccagtgtgtgatgttccccttcctgtgtccatgtgttctcattgttcaattcccacctatgagtaagaacatgcagtgtttggttttttgtccttgtgatagtctgctgagaatgatggtttccagcttcatccatgtccctacaaaggacatgaactcatcattttttatggctgcatagtattccatggtgtatatgtgccacattttcttaatccagtctatcattgttggacatttggcttggttccaagtctttgctatcgtgaatagtgccgcaataaacatacatgtgcatgtgtctttatagcagcatgatttataatcctttgggtatataaccagtaatgggatggctgggtcaaatggtatttctagttctagatccctgacgaatcaccacactgacttccacaagggttgaactagtttacagtcccaccaacagtgtaaaagcgttcctatttctccacatcctctccagcacctgttgtttcctgactttttaatgattgccattctaactggtgtgagatgttatctcattgtggttttgatttgcatttctctgatggtcagtgatgatgagcattttttcatgtgtcttttggcggcataaatgtcttcttttgagaaatgtctgttcatatcgttcacccactttttgatggggttgtttgtttttttcttgtaaatttgtttgagttctttgtagattctggatattagccctttgtcaaatgagtagattgcaaaaattttctcccattttgtaggttgcctgttcactctgatggtactttgttttgctgtgcagaagctctttagtttaattagatcccatttgtcaattttggcttttgttgccattgcttttggtgttttagacatggagtccttgcccatgcccatgtcctgaatggtattgcctaggttttcttctagggtttttatggttttaggtctaacatttaagtctttaatccattcttgaattaatttttgtataaggtgtaaggaagggatccagtttcagctttctacatatggctagccagttttcccagcaccatttattaaatagggaatcctttctccatttcttgtttttgtcaggtttgtcaaagatcaggtggttgtacatatgcggcattatttctgagggctctgttctgttccattggtctatatctctgttttggtaccagtaccatgctgttttggttactgtagccttgtagtatagtttgaagtcaggtagcgtgatgcctccagctttgttcttttggttttggatcgacttggcactgtgggctcttttttggttccatatgaactttaaagtagttttttccaattctgtgaagaaagtcattgttagcttgatggggatggcattgaatctataaattaccttgggcagtatggccattttcatgatattgattcttcctacccatgagcatggaatgttcttccatttgtttgtatcctcttttacttcattgagcagtggtttgtagttctccttgaagaggtccttcacgtcccttgtaagttggattcctaggtattttattctctttgaagcagttgtcaatgggagttcactcatgatttggctctctgtttgtctattattggtgtataagaatgctgtgatgtttgcacattgattttgtatcctgagactttgctgaagttgcctatcagcttaaggagattttgggctgagacaatggggttttctagatatataatcatgtcatctgcaaacagggacaatttgacttcctcttttcctaattgaataccctttatttccttctcctgcctgattgccctggccagaacttccaacactatgttgaataggagtggtgagagagggcatccctgtcttgtgccaattttcaaatggaatgcttccagtttttgcccattcagtatgatattggctgtgggtttgtcatagatagctcttattattttgagatacatcccatcaatacctaatttattgagagtttttagcatgaagcgttgttgaattttgtcaaaggccttttctgcatctattgagataatcatgtggtttttgtcattggttctgtttatgtgctggattacgtttattgatttgcgtatattgaaccagccttgcatcccagagatgaagcccatttgatcatggtggataagctttttgatgtgctgctggattcagtttgccagtattttattgaggatttttgcgtcaatgttcatcagggatattggtctaaaattctctttttttgttgtgtctctgccaggctttggtatcaggataatgctggcctcataaaatgagttagggaggattctctctttttctactgattggaatagtttcagaaggaatggtaccagctcctctttgtacctctggtagaattcggctgtgaatccatctggtcctggattttttttggttggtaagctattaattattgcctcaatttcagagcctgttattggtctattcagagattcaacttcttcctggtttagtcttgggagagtgtatgtgtcgaggaatttatccatttcttctagactttctagtttgtttgcatagaggtgtttatagtattctctgatggtagtttgtatttctgtgggatcgttggtgatatcctctttatcattttttattgtgtctgtttcattcttctctctttttttctttattagtcttgctagtggtctatcaattttgttgatcttttcaaaaaaccagctcctggattcattgattttttgaagggttttttgtgtctctatttccttcagttctgctctgatcttagttatttcttgccttctgctagcttttgaatgtgtttgctcttgcttctctagttcttttaattgtgatgtgagggtgtcaattttggatctttcctgctttgtcttgtgggcatttagtgctataaatttccctctacacagtgctttgcatgtgtcccagagattctggtatgttgtgtctttgttctcggtggtttcaaagaacatctttatttctgccttcgtttcattatgtacccagtagtcattcaggagcaggttgttccgtttccatgtagttgagtggttttgagtgagtttcttaatcctgagttctagtttgattgcactgtggtctgagggacagtttgttataatttctgttcttttacatttgctgaggagtgctttacttccaactatgtatgtaccacatttttttaatccagtctgtcattgatgggcatttgggtttgttccaagtctttgctattgtgaatagtgctgcagtaagcatatgtgtacatgtatctttataatagaatgatttatatccctttgggtattatacccagtaatgggattgctgggtcaaatggtatttctggttctagatcattgaggaatcaccacactgtcttccacagtggttgaactaatttacattcccaccaacagtgtaaaagtgttcttatttctctgcagccttgccaggatctgttgtttcttgactttttaataattgccattctgacttttgtgggatggtatctcattgtggttttaatttgcatttctctaatgatcagtgatgttgagctttttttttcatatgtttcttggccgcataaatgtcttcttttgagaagtgtgttcgtgtcctttgcccactttttgatgtttatttttcttgcaaatttgtttaagttccttgtaaattctgaatattagacctttgtcagatgggtagtttgcaaaaattttctcctattctgtaggttgcctgttcgctctggtgatagtttcttttgctgtgcatacactctttaattagatcccatttgtctatttttgcttttgttgccattgcttttggtgatttcatcataatatctttgcgcatgcctattttctgagtagtattgcctgcgttttcttctagggtttttatggtttttggttttatatttaagtcttcaatcttgagttaatttttgcataaggtgtaaggaaggggtgcagtttcagttttccacatatggctagccagttttcctagcaccatttattaaatagggaatactttccccattgcttgttttgtcaggtttgttgaagatcagatggttgtagatttgaggtcttatttctgagatgtctattctgttcccttggtctaagtgtctgttttgttaccagtaccatgctgttttggttactgtagccttgtagtatagtttgaagtcaggtagcatgatgcctacagttttgttctttttgcttaggattgtcttggctgttagagttcttttttgtttccatacaaattttaaagtagttttctctaattctgtgaagaatgtcaatggtaatttgatgggtatagcattgaatctataaattactttggacattatggccattttcacaatattgattcttcctatccacaagaatgtagtgtttttccatttgtttgttttctctcttatttccttgagcagtggtttgtgagtgtacacaataaccagctagcatcatgatgacattatcaaattcacacataacaatatttaccttaaaagtaaatgggctaaataccccaattaaaagacacagactgacaaattggataaagtgtcaagacccatcagtgtgctgtattcaagagacccatctcatgtgccaagatacacataggctcaaaataaagggatggaagaaaatttaccaagcaaatggcaagcagataaaagcagaggttgcaattgtagtttctaacaaacagactttaaaccaacaaaaatcaaaaaagaaaagggcagtatataatggtaaagggatcaacaagaagagctaactatcctaaatatatatgcacccaatacaggaggacccagatttgtaacgcaagttcttagagaactacaaggagacttagactcccacacaataatagtaggagactttaacgccccactgtcaatattagatcattgagacagaaaattaacaaggatattcaggacttgaactcaactctggatcaagtggacctgatagatatctacaaaactttccacccccaaacaacagaatatacagtcttctcagtgccacgtggtacttactctaaaattgatgaaataattggaagtaaagcactcctcagcaaattgcaaaacaactgaaataataacaaacagtctctcagaccgctgtgcaatcaaattagaactcaagattaagaaacttactcaaaaccacacaactacatggaaattgaacaacctgctcctgaatgactcctgagtaaataatgaaattaaggcagaaatcaaaatgttctttggaaacagtgagaacaaagagacaatgtaccagaatctctgggatgcagctaaagcagtgataagagggaaattatagtactaaatgcccacataagaaagctagaaagatctcaaattgacaccctaacatcacaactaaaagaactagagaagcaagagcaaacaaatccaaaagctaggagaagacaggaaataactaagatcagagcagaactgaaggagatagagacatgaaaaatccttcaaaaaaaatcaatgaatccaggagctggttttttgaaaaaattaataaaatagatagactgctagctacactaataaagaagaaaagggagaagaatcaaataggctcaatgaaaactacaaagggcatatcaccactgaccccaaagaaatagaaacaaccatcagagaatactataaatacctctttgcaaataaactagaaaatctagaagaaatggatcaattcctggacacatacaccctcccaagactaaaccaggaagaagtcaaattcttgaatagaccaataacaagttctgaaattgaggcaggaataaataacctaccaaccaaagaaaaaaaaaagcccaggatcagatggattcacagctgaatgctaccagaagtacaaagaggagttggtaccattccccattccttctgaaactattccaaataattcaaaaggagacactcctccctaactcattttgtgaggccagcatcattctgataccaaagcctggcagacacacaacaaaaaaaacttcaggccaatatctctgatgagtattgatgcaaaaatccccaataaaatactggcaaactgaattcaacagcacatcacaaagtttatccaccatggtcaagtggtcttcattcatgggatgcaaggctggttcaacatatgcaaatcaataaatataattcatcatataaatagaaccaaggacaaaaaccccatgattatctcaatagatgcagacagtcttcgataaaattcaacatcccttcatgttaaaaactctcaataaactaggtattaatggaacatatctcaaaataataagaactatttatgacaaacccacagccaatatcacatggaatggggaaaagctggaagcatttcctttggaaactggcacaagacaatcatgcattctctcaccactcgtattcaatgtagtattggaaattctggccaggtcaatcaggtaagagaaagaaataaagggttttcaaatatgaaaaaggaaatcaaattgtctctgtttgcagatgacacgatcctatatccagaaaaccccgtcgtctcaacccaagagatccttaagctgataagcaacttcagcaaagtctcaggatagaaaatcaatgtgcaaaaagttacaagcattcctatacaccaacaggagacaagcagagagccaaatcatgaatgaacttccattcacaattgctacaaagagattaaaatatgtaggaatacagctaacaaaggatgtgaaggacctcttcaaggagaaccatttgtctattattttaactgactaccctaaaaattaaaaaaaattattgtgtgctttatgaaaagtatttatttgatacttattctctcctcttagacaatttaaaactttctattacatacctccatctttttaaaaaatttttaagcaacacataataattgtacatatttgtgggggtgcagagtgagatttttatacatatatacaatgagtaatgattgaatcagagtaattagcatatccattacctcaaatattcatcatttctttgtgctggaaacattcaacaacctatctatttgaaattcatctatttgaaaacatacaataaattactaactatagtcaccctacagtgctatagaatactagaacactagaacttatttctcctctctagctgtaattttgtatttgttaactaacgttttcctcacctcttccctactcttcccagcctctaataaccactattctactctctacttctatgaactcaacatttttatctcacacatgagtgataacatgcggtatttatctttctgtgcctgacttattttacttaatataatgtcctccaggttcatccatattgcctcgaatgacaggatttcattctttttatgactaaataatattctttttgtgaatatgtatgtgtgtgtatatatatatatacacaacatatatatatacaacatatatatatacaacatatatatatacacacaccatatatatatatgaaacattttccttattccttaatcttttgctggatacttaggttgactacatattgtactactgtaaacatgggggtgcagatgtttctttgatatactgatttcctttggaaatagtagtggtagtgctagatcatatggtagttctattcatagatttttgaggaaacttcatactgtttttcataatggatgtactaatttatgttcccatttacagtgtatgagttttctttgtgttctcaccagcatttatttatttttatttgtttctatttgttacaacaaattcaaacttttggacaagagccattccaactgggatgagatatgtcttactgtggtttagatttgcattttcctggatgattagtgatgttggacctgtttttcagatacttgttggccatttgtgtgtcttcatttgagaaatgtctattcagatccttcaccaatttttaaatcaaattatttggggtttccttttgctcttgagttgggttcttttttattctgtatattaatcacttgtaggatgaatggcttggaaatgttttctgcctttctacaagttatctcttcactcagttgattgtttcctttaatatgcagaaacttttaagtttgatataatcatgtctatttttgcttttgttgtccgtggtttggagtattttttaattctctttttaaaaaaaatattctttctattttgattttgagtcttacccacaaaatctttgcccacactaattcctgaagtgtttcccttatgttttcttgtagcaattctatagtttcaggtcttacatttaagtctttaattcatcttgagttgatttttgtttatggtgggagatatgagtctagtttcaatcttctgtgtatggatattcaattttcccagcaccgttttttgaagaggctctcctttcagtgtatgttcctggcacctttgtcaaaaatcagttgactgtaaatatatggatttatttctgggttctctattctgttccattggtctaagtgtcttttttaaaccagttctatgctgttttggttactatagctttgtggtatattttgaagtcaggtagtttgatgactctaggtttgttctttttgctcagaattgctttggttcttgggggtcttctgtggttccatataaattttagaattgctttctctgtttctgtgaagagtgtcattggtattttgatagggattgcttcgaatctgtagattgctttgtgtaatataatcactttaacattatgaattctgacattagaaagcacacttcacctctctaatgtgacctttctcacaggtgtgcctccttcagcttcccatgtggcacccacagaaacattcacctatgaatggactgtccccaaagaagtaggacccactaatgcagatcctgtatgtctagctaagatgtattattctgctgtggatcccactaaagatatattcactgggcttattgggccaatgaaaatatgcaagaaaggaagtttacatgcaaattggagacagaaagatgtagacaaggagttctatttgtttcctatagtatttaatgagaatgagggtttactcctggaagataatatcagaatgtttacaactgcacctgatcaggtggataaggcagatgaagactttcaggaatctaataaaatgcactggacttttaatgttgaatgccttacagctagctgatcattacacaggcggcatgaagcaaaaatatactgtgaaccaatgcaggtggcagtctgaggattccaccttctacctgggagagaggacatactatatcgcagcagtggaagtggaatgggattattccccacaaagggagtgggaaaaggagctgcatcatttacaagagcagaatgtttcaaatgcatttttagataagggagagttttacataggctcaaagtacaagaaagttgtgtatcggcagtatactgattgcacgttccgtattccagtggagagaaaagctgaagaagaacatctgggaattctaggtctacaacttcatgcagatgttggagacaaagtcaaaattatctttaaaaacatgaccacaaggccctactcaatacatgcccatggggtacaaacggagagttctacatttattccagcattaccaggtgaaactctcacttacctatggaaaatcccagaaagatctggagctggaacagaggattctgcttgtattccatgggcttactattcaactgtggatcaagttaaggatctctacagtggattaattggccccctgattgtttgtcgaagacattacttgaaagtattcaatcccagaaagaaactggaatttacccttctgtttctagtttttgatgagaatgaatcttggtatttagatgacaacatcaaaacaaactctgatcaccccaagaaagtaaacaaagatgatgaggaattcatagaaagcaataaaatgcatgctgttaatggaagaatgtttggaaacccacaaggcctcacaatgcacatgggagatgaagccaatgggcgatgaaatagacttacacactgtacattttcacggccatagcttctaatacaagcacaggggtgtttatagttctgatgtctttgacattttccctggaacataccaaaccctagaaatgtttccaagaacacctggaatttggttactccactgccatgtgactgaccacattcatgctggaatggaaaccacttacattgttctacaaaatgaagacaccaagtctggctgaatgaaatacattggtgataagtggaaaaaagagaaaaaccaatgattcataacaatgtatgtgaaagtgtaaaatagaatgttactttggaatgactataaacattgaaagaagactggaaacatacaactttgtgcatttgtgggggaaaactattaattttttgcaaatggaaacatcaacagactatataatgatacatgactgacacttgtacactaggtaataaaattgattcctacagtctaatcatatcaccactattagggttttataaaactgcatttaaaaaaagatctatgaccagatattctcctgtgtgctcctcaaaggaacactattaaggttcattgaaatgttttcaatcattgccttcccattgatccttctaacatgctgttgacatcacacctaatattcagagggaatgggcaaggtatgagggaaggaaataaaacataaaataaataaaatagaatgacacaaatctgagttttgtgaacccctgaagggatggtctaaaggacgttatctggaactggagaaaagcagagttgagatacaattctatagattaaatcctggtaaggataaacattgccattagaagaaaagcttcaaaatagacctgtggcagatgtcacataagtagaatttctgccaagccttaactgcattcagaggataatatcaatgaactaaacttgaactaaaaattttttaaacaaaaagttataaatgaagacacatggttgtgaatacaatgacatatttctttattttcacatacactctagctgaaagagcaagagtacacatcaacaaaaaaatgggaacaaggctttggctgaaaaaaacatgcatttgacaaatcatgttaatagctagacaagaagaaagttagctttgtaaactacttcatttgattcagagaaatagagcatgagttttcttaaagtaaaaagaaaaggaacaaagaaaatgaggtttgaaattttttaccatggcaaaatattaacatctttctcaaaaacatagagaaatctggaaaaatcaagaagataaaattctggaccagttagtgacattctttcaagcatacttgtaaaatgtttccttagagtgttcttgggatgaaaatgattgtcatgtctccaacaacagtgaactgatgttgttccttggaataaaagtcaatccccaccttaaaaaaaacaaaacaacaacaacaacaacaaaaatatgaattcttccaatccatgaacatgagatgtctttccatttttgtgtttgccctctttaatttcttttagcagtattttgtaggtatcattgtggaaatctttcacctttttggataaatttatttttagctttaaaaatcttttgtagctactgtaaatgggataattttttcttgatgaattatttattactggtttatagaatcactactgatttttgtttggttgattttgtatcctgcaactttattgaatttgttaattagttcaaacaggttttttggcggaatctttagttttttgtttttttttttaaatatataagataatgtcatctgcaaatagggacaatttgacttcttgtttcttaatttcattccttactatttctttgtcttgcctaattactctcttaggaactccagtactgacatggtttggctctgtgtccccacccaaatctcatgttgaattgtaatctccaatgttgggggagggacctggtgggaggtgattggattatgggtgcagatttaccccctactgttcttgtgatagtgagttcttatgagatctggttgtttaaaaatgcacagcacttcccccttctctctcctgctgaccatgtgaagatgtgccttgcttcccctttatcttcttccatgattgtaagtttactgaggcctctccagccatgcctcatgtacagcctgtggaaccatgagtcaattaaacctcttttcttcataaactacccagtctcaggcagttctttatagcagtgtgagaatggagtaatacaagtattatactatgttgaataagagtggtaaaaaataggcatccttgtcttgctccagatttcagaggaaaagcatttttcttttccctgctgaaagcttttccatactcactatgattttactgtgggtttatcacatacggcctttactttgtttagtcatattcctttaatacctaatttgttgagagtttttatcatgacaaggtgtagaattttatcaaatccgttttctgcctctattgggatgatcatatgatttctacccttcattctgttgatatgatgtattatatatttacttattagcatatattgaaccatccttgaatccatggcctaaatccacttgatcatggtgtgtaatcattttgatatactgttggattccatttgctactatttttttaaggtttttgcatctgtgttcatcaaggttattcatttgtagtttttcttgttgttgttgtgtccttttgtggttttggtataagggaaatgctggccttgaagaatgagttaggaagaatttccttctttcttttcggaatggtttgagaaaagtggatgttagtttcttaaaagtttgatagaatttagcagtgaagttatgcagtcctgggcttttttgtttgtttattttgggagacttattactgtttcaatctcattactcattactgatctgtttaggttttctatttcttcctggttcaaccttgttaaattatatgtgtgcagaaatttatctgttttctctaggttttccaattttttggcatatagttgttcataataatctctaatgatcctttgcgttctgtgatattaatgtgtctcctttttcatttctaattttatgtattggaatcttctgtctctttttagtctaatgccatgttgattttgtttatcttttcaaacaactttttaaatttgctttttattctctattttgtttatttctgcgctaattttctttctttctttctactaattttgggtttaatttgttcttgcttttctagatccttgaggtgcattgtcagattgtttatttaaaatctttctaatttttgttgtaggtgttcattgctataaacttccctcttagtaatgcttttactatatttaataggttttggtatgcagtgtttctgttttcatttgtttcaagaaacttaaaagttttcttcttaatttctttattcacctttggtgactcaggagcacattgttacacttttatgtgtttgtacagtttccacagttcctcttgttattgattcatagttttattccattgtgatctgaaagatacttatgattttgatttttaaaaatttgttgagacttgttttatgtcctaacatatggtttatcctggagaatgttccatgtgctggaaagaagaatgtgtattctgcagctgttggatgacatgttttataaatgtctgttaggtccatttgattttgtagtgcagtttaagtctgatgtttcttcattgattttctgtctggatactctgtccagtgctgagagtggagcgttgagtccccaactattattgtactagggtctatctctccctttagttctactgatacttgctttatatatctggctgttccagtgttgggtgcatatacatttacatatgttatatcctcttactgaattaatccctttatcattatataatgaccttctttgttcctttttatattttttgacttgaagtctgtttcatctaatgtaagtatagttactcctgctcacttttgttttccatttgtatggaacatcttttcccatcccttaactttcagtctatgtgtgttgttgcaggtaagtgagttttttgtaggcagaatatagttgggtcttatgtttttatccattcagcctgtttaaatcttatagttgggaaaatttaaactgtttatattcaatattgttattgatggtgagtacttacttatctttttgcctccctccacctctgctttccattcttttgtctccctgtgtttagttctagatatgttctcctgatatattttacaaattaatactttttttttcagctttgtctacatgttgtcaaacctacccattagattatgtatttcagttttatttattgttacaatttcttgttggttctttttcaaatctactatgttactttttacacttttcatttatctcctgaaaatcttaaacttggcttttattttccagatcatgttaagtgtagttatttctatcttatattcccatggttgtcttttttgtattatatagatctcagctcagatatcaactcctcaggagagcttttcctcacaactcagtcaaagtagcctctactctatgacatcaaattttaaatttttctttatggcacttaccactgtaataaatacatgtttagatttgtttacttgcttattgtttttatgtacccaccctccatttttttagcctccatagaatgcaaatttccatgaaaacagcatctttgcctgtttattcattgctgtattttattgccaagagcagtccttggcaaataataagcatacataataagcaacaatacacattgttgaatgaatgaatgactgaatagctttatcatagcctttgtctgatttccctacacttcatctaatgttcacaagtcacaaactttgggagggtctcaaaaatcttctctgaccttgatgtcagaacttgtctccatcttgatcctacttctctcaacttccactttatttgcttgcttttatattgctttcctgttccacttatttttcagaagactttgtgttctttcttctaagaccactttaaggtaaatctctttaatagctgcattacatttctattatagttatatttccttttaaattttatcaggtagttaaaattatataaacccctaaaaattcttactgctatggctgccaagtttagaaaaaaattaaaagattatagttttaaaatcaatatttttttctatattttgagctctaattttattggccacacttttcatatcttctattataaattacaaagttcttagaggataatggaatatatattaaaatacaagccaaatcaaaaataaaaattcagctcttgactgagaaggtatctcaagagacttccaaagctccctatataaaatttcagggaatttcagaatattttatttgttgtcaggagtgagagtatgaggcaaggcaatcaattttttcattattcttaagatttttatgaagtgggatcaaataaatttatagaaaagttcctacaactttataaatgttagctttctcttgttttttctccaagtgcccatatacagaaaatcacattgtaaattgggattgtggagaaggtattgtgagataggtatagtgattagaggcagtaaatatggaaggttctagaatataatgagggttaaaaactaacttctctgtcaagaagacaactacccaaaggtgtcaggaaactaggctcagaaaatagctcattcttttgttagagccaggactgctttcctttaggaaaagctggcaaggaaattccatggcctagaagtctgaagattaaggtcagaaccttcaaagatggccaaagtccatcgtagaaggctactcttcagtctggggtatactcagaatggttagctatggtttcatctatctaggtcacagatgctttctggaaacagtaatatgccaagaaaggatatgtaaagttgctatataaaaacaaacaatggttaataatattttttgaaaactatgctggttttgtgctaaacactttaaatagtatccttttatttaattttcattatagtttcatgagctaggaactattaccatttccattttacagatgataaaactgaggctttcagaaaagattaaggtacttttctcaatttcagagctgaaactcaaacctaggttgcttcaaaaccaaaaatactcttaattactagtagtgatttatataaacatattatgcctgattatcatgtattgttcttgactgttcgttaatattgcatgttcttttaattgttgaggaagacttgactgagttgaactagccagagaagggactgatctgtgaattccttccttgctgctacatacctccctaactcctataggctcactttagaaaatagaagtcaagactcctacgaaggttcatttgagatgggaaggttggtgaatagacattttgtgcctggtaattaggaggaacaattggcaacatctgtagttcccccacaaaaggaaaattttgcctaatttttgagaggaagaaaggatattctctggcaccatatcttagagtctttgctggcattcctgtagtccaggataaaatgggaatgtcaaagaaatttcaggtgcggttttataggagggtacattaaagaaaaagcagagctgaaagtcaaggaaataattccaaacagaaggcactgggttagtaaaagacttaggcaacttagctgtgcaggggatgccatgcaactgaatcacaaagggtgacacactaggtgaccctcagaaaagctgatcgtgtcactgtggggagaccatgaggtttttgttactgtagttgcttgtttcagaatgcaaaagttttgcttcctttctctttcttatacttgtaagaagggagttagtgctaatatattaaaataatctggtggcaagatttctcaggtggtttggtgcgtatttggacctcagatttttttctatgtgcatctctgtcatgagaattatagctgattcaagtcacatgtacaactctaataaagacatgcagttaatgggttttctgtttttgtgtagtagatatattttaatttttttcattaatggaagaagtatgatgggtgaaaacatcagacagagtctggaatcagacaaacttgggttttaattctgacaatacttatggttgacgttttatgattcctgcagataacagctattgcaagagatccctgagttggctgtagaagaatgcaggtttttcttggtatatttctttacaaattagctttcccagggaaatctagtgagcaagattttggtagtaacctcttttttaggtcataatagagtgaagggcagccagagtgctgacttggttggggcagcattgtgtagtagaaaacacatgaactttcatgcactgcatatgaattccagttttgcaactttctaactgtgtgacttcgggaaaattttaattgaacttgaactttaattcctttatctaaaaaatgggataataatacaaatgatactgtctaccatgaggattgactgagctaacaaatataaatcaccaggaacatagcaagtactttgaatattacattagttctaattcctgtcttcccttgtcaccatcaaagctccagcatgttcctccacctcatacacactattacagtagtgtaggactgccaccataatgtcagaaccttagacaaattgtgctagaaggtggtattattgctttcttgccactcatttttccttaggctaccctacatatatgggagtcctctggggcaatctaacctggacaatgagagaacagatgggaagagggggttgtaaaataaactgaaaaaaaaaaaaaaaaaaaaaaaacctatgaatacctgaaaatcctaatattagcaattttgaaaaactttatggcaggaagaggaattataatttatattccttgatcaaagatatgctctgtaaagcaagaagaaaacaaaatcaaacatatagcttgtgttaaatattagcgtggaaaagggcactttacgaaattgttttatgggatacatatacaattgttactcaattattcactattttagagtgcaagttccactgaaagtgccctggggaatggcaagtagagtcagtccagtactacccgtcctcatataaaaagaacaagatttatgcctccacagaggaagctcaagactgccaaccaaacgctgttatttaacaaaggttctgcccctggtcgttttcagacacagagctggttatagattctgttgttcttttccccacctacactccggtgcctttgcccactttgctggatagtcacagtttttagttacagtttttgccccactccctgttgggctgtgatacttcttcaaagattcagagatttggagggtaaagaaagcaagaggagggcaccatgctgaaaactcagtgagtactacaggagcagcaaaataaggactgcttctagggaaggctgtagtagtctgttgttatgctgttaataaagacatacccgagactgggtaattataaaggaaagaagtttaattgcttcacagttccatatggttggggaggcctcacaatcatggcggaaggaagtaggaacaagtcatattttatatggctgcagggaagggagaacttgtgcaggggtactcctttttataaaaccatcagatctagtgagacttattcactatcacgagaacagcccgggaaagacccgcccctatgattcaatatccttccactggctccctccgacaacacatggaaattgtgggagctacaattcaagattggatttgtatggagacacagccaaaccatatcaaggggagaaactggaaagctcaacggaatgctttcagcactaatatatacaaggaagtgagatgtgaaacatccagtgttttgctagtaaatgtttaacacaatcagctccctggggcgccagagcggaaccctcgtttgtagcatctgctaattcccataatgtaaatactcccaccatggcctgtttcaagctaccaatataatgtcactaaaagccatgttggacattgatgctcagaactggctcttctgtgttggtgccagtcagcacaccagtgatagtagccttagcaccactgactgagacagggaggatatggtagagaattttaagagacgatgttccctttttggtgatagaaattcttaaaatattagctttactgctttattaactgtatgactttctgtagagatccttaaattccccaagtctcaatttccttatttattaatatatgtattcgatatacattttctgagtgtcttttgtatgccaggaacttttgtagacatctggatacagaggtgaataatacaaattccctgccctcttggagcttataatctagtagggaagactgataatacacaggtaaacaaatttaaggtagtgtcatgaagaaaacgcttagggcattgtaagcccaggaggggaaattttgtctgttttgggcactgctgtgtcctcagtgcttacgacattgtaagaatgattcagagtataaatgaaggctctggtactctaattagggcttttggaaaagactgaggggccgaaagatgaccagaaatatgtgattgatatacaagaacaaatgtggcaggtgctgttgggtagctgctgacacccccatctccagccctcctctcctgaactacttccagtgggagtggtcatgtgtcacagttctggctagggaaaaataaatggaaatcttttgggtgggatttccaggaaagcttttgtttttcctataaattggacagactttatctcttgccccttggtcttttcttgtttgtgttgcctgaatttgattgagaattagcagccatttgggactgtaaagtgcaagcacgaagacaacaacctacctgctaagcaggatggacctctggcagcagcattgcacagccttactactcctggcctgctcaacttgtgacacttgttacatgagataaatgacactctatgtgttgtctgtttttttgtgttttgtgtttttttttgcaattaatatagcaagccaggccataaaaatatagaaagaataatgaatactaaataagtcatataaaacagtagaatttaagaaacattgctcaaaaaatgttgctcttaatatcataatgactcaagtaataaagaatcattacatacttttgagcccttattctgtgctttataataggaatcataataatgtgagtgattccagagtcaaatacaaaaaacaaactgaatttaaaatcttgggactaacgttaatagctgtcagttgacacttcatcaacaattcagacacttatatttcaaaacaggaagcaacaaaatgcttggaaaaagatccaggactttataaaatattgtcctttttagagctggaggccataatcctaagcaaactaacccaggaacagaaaactaaatactgcatgttcttacttataagtaggagctaaacactgaatacacatggaccaaaatagggaacaacagacacagcggcctatttgagggtagaaagtgggaggagggagaggattaaaaaactctctatcaagtactatgattattacctgggtgatgaaataatctgtataccaacctccatgaaatacaatttacctatataacaaacctgcacatgtacccttgaacctaaaataaaagttaaatttagaaaatattatctttttggtatagaaatttcaatatagaagcaaattactgaagagtttcctgacacaaaggagcatgagtacatgtacatatgtgtgtatataattttttttttattataccttaagttttagggtacatgtgcacattgtgcagcttagttacatatgtatacatgtgccatgctggtgcgctgcacccactaactcatcatctagcattaggtatatctcccaatgctatcccctccccccctacccccaccccacaacagtccccagagtgtgatattccccttcctgtgtccatgtgatctcattgttcaattcccacctatgagtgagaacatgcagtgtttggttttttgttcttgcgatagtttactgaaaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaataatgccacaataaacatacgtgtgcatgtgtctttacagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgttttttgctgcataaatggccatactgcccaaggtaatttacagattcaatgccatccccatcaagctaccaatgcctttcttcacagaattggaaaaaactactttaaagttcatatggaaccaaaaaagagcccacatcgccaagccaatcctaagccaaaagaacaaagctggaggcatcacactacctgacttcaaactatactacaaggctacagtaaccaaacagcatggtactggtaccaaaacagagatatagtcaatggaacagaacagagccctcagaaataacgccgcgtatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcgtgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggtgtatataatttttttaaaatagtcaattctgaggctctaaggaatgtaacaaaaacagaatgtatgaaaaaaagaatttgggttttatgttcctaaggctgaatcgtgtttctcaaccatttttacattattgtttcccttcacccaggacaattgtttgactttattcctctaataacctcctcttaccccccatgaaattttagtattagttattccatgtatacatttatattgtcagagttgagcttcggaggatcataaacaattataatatctaagattttttcacctcccccataaaccgatttttacgtccttggggatgatatcaccccctcctgctccctgattaaaatgcgtaagctgaaccagcactgaacttgaaaaaatatttcttacttttttacctcatgggccagatatgtgggagagttttcaaacttctgagaaaatcttagaatcagcacagatgttgatacagctttcttgaaagtcttgaaatatttttagccctgggaagatcatatccacgttgggaagctgtgttttcagtcttttgagcaagtataggaggaatctatctcctagtattctcattcccaaatgtgtctttggaaaatttacacattggtaatcagaatcagagtgatgtaaatttaatgattcctggaaaaacttttaaaaatgtcttttcactgtagattatttggaaaatatagataagcaaacaataaaagccaaattacccatggtctgaccaaggaggtgtgaacaacatattggcttatttctttactatttttccattttaaaaatgtgtatgtgagtgtgagggcatgtatccacatgcacatggaggttttttttttaaaaaatggaatattcagacatgttaatgtgtttgtattattagtattatcatacatattaatgtattattcatacatgctttgtaatgtatcttttacattttattgtaaacatttccccatggtttagagtattttcctacatcactatttctactggctatttagccttgatatatgtatataattaaacagtcccctattttttgacaggtaggattcttcacacttcttaccacaataaaaatgcttctataaagttcagtgtggctactctttgtacataccattagttattcccttaggaaatatatctagaagtgtaaatgctatctcaaaaattatgcacacttctactgatttgataaatattgttaaattatgcttcaggaaacttctatgagtcaacatttccaagttttctaattggttattatcacttctttttcttgctttatgtaagcaattctttacatatttctttgaagatagtaattatactaattattttatagtcctgttttatcagctctatttcctctggtataaactctttatttatttttattttttgagactgagtttcactcttgttgcccaggctagagtgcaatggcaagatctcagctcaccgcaacctccacctcctgggttcaagcaattatcctgcctcagcctcccgagtagctgggactacagtcatgcaccaccacactcggctaattttgtatttttagtagagacagcgtttctccatgttgctcaggctggtctcgaattcctgacctcgtgatcagcccgcctcagcctcccaaagtgctggaattacaggcatgagccactgttcctggccataaactctttcatctattagcctgaatggtgttggcattcagtgattatcagctccttgaataattttttaaatttcagcttatttttgaattctgggcacaggagattccctgaaagacttatgactgttttttcagttcactttacagagaggaaaaatgtctgacaggagattgctttggtcagtgagtgtgtggaagcaagtataatgcattctgattcttctctggtgttgccagctactcacggctccattttatttctctctgttcaaagcacatctcctaactaggctatagttgcgtaggatgtaggggaagagggtgagggataggaggaatagtgtggctatggggtagagtaggtagtctagtccacagagctgcttggtcctgagagagtatagtaatccctctgtctattgttccctgatcccattattctctgaaggactctactacctctgtgttttgaattgccttaattatttttggtaaaagctcttccttgggcttccatattcatcctgggtcaatgcttccttcctcatttgatactatctacatgtggtttctgttcctgtaagaatttatcttcctgtatttaagtggctatttatgtattattttaaaagttatcctcttatcatttctaagttttggcatgggaaggagggacactatgtatgcctatttttaccgtcttaaaactgaaagtacttgtatcaatttactaatacacttgcagtatattgtcaggtagagattaatggaagcaaagtaattgtcttaatccatctgggctgctataacaaaataccttagactgagtaatttataaacaacaggaattgtttataaatttgggatgttcaagatcaagatgccagcagatttggtgtctgttcggggcttgcactctgcttcaaagatagtaccttctagctatgtccttatgtggtagaagggtagacaagattccttgggaatcttttataagggctcaaccctcacaaactaatgatctcccgaaggccctacctcgatactatcatactggggattgtttcaacataacgaatttttgggggacacaaacattcagaccatagcaataatgaaaaaaaaagaagaaaaaacaaaagctgatcctaacaaggactttttattgaaagagagcaagaaacatgacttgcctactttagacaatgaactacatgttagtgtagtaccttatttttctacaatgccttgaagttatttaaacatccctcatttgatcttcacaattcaatgagatggatattattacttctatttataagatgagaaacaggctgaggtactctaaataatatgttcatagaggctgtgtggaagaaatgaattaaatcctttccccagcctgtaagtccagtgctttgtctagtctactattaagtacagataaagttatatgaaaagctaaaaaacagtattcttttggttaaaatagtgacttaaaggaaggtgaagaaaagcattcaagaaccccttaaaacatatagtctaatacagaagaacaaaaatatactaagtgaaattaaaggcgctatgcctttgagaggctttatttaaaaccacactgggccttgtatggaaaccaagccataagcttcaactgacattctttctgcagtctccatcatgaatctgaccactcaagttttaatttcctgtcagataagataaatggaagacaagatctcacaattaggtttcaaactataaacagccttcatgaaatctttgaatatatttcgtctagttcactgctatgagttgttgcttggtctgaatacattttaaaatggaattccttagtttaaattgtagactattccagggcagaagttgggagctttcacatctgtggtattccctaaggaaagtgccttttgtagagtctggttactgctcattccagcttttctttgtaactagtgctgcaaggtttacaagtatggttgaaagaacatcactaggtatacggctctcctatccagtggagaggtgctaactgtataactggcttttaaaacctgaaaagactgtttttaaggaataaatgactaaggattgggagtcttagattgagagaagagagaagtagagtttgacattttgcaaaggataattcactaaaaatacccatgaaggttatttggagcaatttagaaatattggagggacttatctatctgccaaaggtagagcaggagaattctatgacatgttgaaattgctgtgcatgttttcttttggttctttggttggaacataaatggagtttaattaaagttacacagggaggagtagggaaaatctcatggggactcaaacaggagatacggtaaggctgggcagagctcagaggtactggagttagcatgtgattctcagttcaaggaggagctggaatcctcagctgcatgaacatttaagtcatcatacctgttacacttaaatgcagcatatcttagccatgttccaaatgcttcttctgcttataccttttttctactcctttataacttcaacgtgcacatagcccactgtaaactctccagtccctgacataatacctgttctatttcagcttccagaactaaatgtcaaattatttccatatttcttggtttgaattcctgaagagtgtatgattaggccaacccttttgcggctaggtgattgaatcagagtttgtggccaggctatattggctttctttggctcaagagtcaagctcttgttcagttagttcagttcccaagcagtagaattatatggtgtaaaatctgcatatgacagggtctctgggtgggtggttgcacttcgaaaggggggcatcaacagagtaggaaacgtttggtggtcctattgtatgttgaatggtattcttgactaatttttaactatcttgaaaaggactaagttctgagtaagacgtgacaccaccggagttttttttttttgagcaggggagtgatataattggacatgctttaaaggactactttagatgctctctggagatgatcactattcacattttggcgtatttccttcttctccagtgtaacaatatttcttttactgaatcttttcttttctttcatgtatgattacttaacattttgtaggtatctctattacagaatttatttcatggcatcctctatttcagctgcaattgctgtcacatttccattgcctctttccttagtagtttctttggcttatggtttcaggcaccatccctcatatatatatatatatatattttttttttttcttttttttgagacagtctcactctgtcaccaggctggagtgcagtggtgcaatctcagttcactacaacctccgcctcctgggttcaagcgattcccctgcctcagcctcctgagtagctgggactacaggcatgtgccaccatgcccatttagttttttattttattttttgtattttagtagagatggggtttcaccatgttggccaggatgttctcaatctcctgaccttgtgatctgcctgcctaggcctcccaaagtgctggaattacaggcatgagccactgtgcccggcctctaggatatattttaaatagatgtattagggtctgccagagaaacagaaccaacaggatatctctctctctttctcaacatatttattataataaattggcttacatgattatgggtttgagcagtctcacttcactaactgctgtatacaagctgaaggcccaggaaagccagtggtatccttccagttcaatcatgaaggcctcagaagcaggagagctgatggcataagcctcagtcccagtacaggagaaaactgatgtcctagttcagtcagacagagtgaattctccctccctccacctttttgttctagtcatgccctcaacagattggataatgcccagtcacaatggggagggcaatctgcttcattcagttcatcaattgcttaatttcatctagaaacaccctcaaggcacaccaagaaataatgttaagccaaatatctggatacgccatggcccagtgaagttgacacataaaattaatcattacagtaaataagtttaaatatatttgaaatattattatatgttctgtttaatttatttactaatgtttagttaactgtgtggtcattttattaaaaataggtaattatagtcttttttggggggaggaatcagatctgaattactttatttgtaattacaatatcctttaatcaaggactgattgattagcacataaagaatgtacagtttagaaccatagatggcaattttaaatggatcatctcaaaattatgctgcacatgtttatgtgtatttgaacatcaagtcattcaggaatagtattaattctaaaaagggtaaatgttatcagagttttaagagaaattttggtattctctattaatttatttgtgaagatattctaggaaagatctgacaatcaattactgtactttttcatctcatctgattcttagatatgatctcaggcaaatattcaatagactattcattctattttactttatttgtatcaaatatgataagcatcaactatatatatattgaaatatgtttaagaagaattatagttctacataattatatacattcactttaatataataagcaaaaatgactcttgctgccaatagtattaggctcctatataggtatgaatgaacactgttctgaaacactgctgcacatggtactcaacaaatgataacaaatctatttggaatgtggaaaattttcttttcaaaagcagaaagtgaacaaggggaaatggaaatgaatagtatcagctattctggagaaataaaagtctgtaggttctagcagtagaattgtagggttaaaaacctgtatttctttctctttttatctcagtctctttccagacctcctaggttttattctctaatactaaatgttttctgcttttcttttttttttttttttgagacagagtcttgctgtgttgcccaggctggagtacagtggcatgatctcggctcacggtacgctccgcctcccgggttcatgccattcccctgcctcagcctccctagtagctgggactactggggcccgccaccacacccggctaattttttgtgtttttagtagagacggggtttcaccgtgttagccaggatggtctcgatctcctgaccttgtgatccgcctgccttggcctcccaaagtgctgggattacaggcgtgagccactgcgcccggcctgttttctgcttttcaactccaattcttgtgctttatgtttatcggatttctgcgatggataaaatatgatgatatatgatagatgacagagtagtagttggaaagagtccaggcctagaggcctatttcatttctgtttgcaacagctgaaaacttgtgtgctacaattgatatggcccctcctctttctgggccacttaaaacaacagctttgataacttgttctgagttaccttttattctatgtaattaacttagatgactttcttcctaatagaaggaagagcttcaggggcaatccaataaaaaggaaaattttcctaaattttcagacagtacaattactatgtaaaattgaggcaaatattttgttagctttttgcttttatcttctgtttccctttgtcatgtactagacaacattaggctggtgctcacaagttttcagactcctggtaaagatgatgaaagtccctgaaaaatgtttgcaaaatggtatcctctgatgtaagtctttacatttcaaggaacattcagaaatttcagggtgtatgtgattcaagacatgagaggtttggcagctcagtcctttcacattatttgaagggaccttaggaactggcttctagcaacaaatctttccttaactggtgtccctaggaagcaggactacctgagaggtgaccctgggacaagattggcagggggccatggcagtttcattcctggatgtttatgtgtacacaattttcactaccctgaatgctttttcttctcctgtatgatttcgccttgacttttaaggttcagatgaaatattttccccatgtaaacttggcagagttcttgtaattcacctaggttttatattctgcatctgtaaatagaagctaataatatccttttcactgaggattaaatgagacatgggattgaacccaggtctagctaactccaaagtcattgcacttaaacagtgtattaggccattcttgcattgctataaataaatacctgaacctgggtaatttataaagaaaagcggttttattgacttgcagttcagcaggttgtacaggaagcatagtggcttctgcttctggagaggcctcagaaagctttcaattgtggtggaaagcaaagggggagcgggttgtctcacatggcaggagcagaagcaagagagagagagcaagagggaaagtgcaacatacttttaaagaaccagtgtcatgagaactcaccatcatgagaacagcaccaagggagatggtgctaaactgttcatgagaaacatctccatgatccagtcacctcccaccaagtcccacctccaacattggagattacaattctacatgagattggggcagagacacagattcataacatataaaatataatgctcaagatattttaagcaactacccactttattttttcctagtctaccatttatatagcaaacattctttctaaagatacctttattatctgcattggtcttttgaccctaggcattcactaccttttattgataaatattattttttggtatggataatcaagcatttattgaaaaatatttattgaaccacatttatgtattaaacgtatgctagatcaggagatacaaagaataagaaatcgttcttatgaagggactgaaagacaatgtgacatggtcttgtaaaaagttacattgaattgtaaattgggatattacaatgaaacgtcgtatgtgtaggtctacagcttgaaactagggttttctgtttccaacagaatgttaagcttttgaaagcaggaaccagtcttctatttcattcaacttttcattatttttagcctagtgtcctgttcttagtaggtgttgggatttatccatatatttattgatttgctttagtaaaatagaagctctctattacatattagttacttgtagctgtataacacattaccccaaaatttagctgcttaaagcatcagagatttgttatttcacacaggttctgaggattaggaatctgagagtatctgaactggttggttctagctcagggtctctcatgagttgtaatcaagttgtcagctggaattgcagtcatctgaaggcttgactggagctggaggatctgcttccaagatggcttactcacatggcttttggcagaaaaccccagatgcttagcatgtgggcttctcaacagagctacctgaatattcttacatcatggcagctggcttcccccagagtaagtgactcacaaagaagagagaataagcaggaattgcaataccttttatggtctaatctctgaagttgtgcacatcacttctgctttattctattcattagaagtgagtcactaagtccagtacgcactcaaggggaggagaattaggctctacctcttaaaggagcagtaacaaataatttgtggatatatcttaaagttaccacagtacactaacagcacaaaatgtactctatcattattttctttttgagctctgtaggctgagggcaaaacttcagaaaataggaagatgaaggcagggaaaataaagagggactgggagaatgcacagggtagtttagagggaatgagggtctggcatagggcaaagaatctacacaacctgggaatgttatgttctgatgtcttaggtattcataagaagggggctaaagagaatgacagtgagagatggaagtggggaaagaatgaagaagaacaaaataactgagagaaaacaaggataattgtgtagaaagtgaaagggcaagagaagaaaataaaataaaatacctctaggaaaaaatctctggaatcagtcaaaagctgttgcccagttgtgaagcaaataagcccattggaactgtccaaaggggctattttctaaaatctttattgtatagtatctgagtataactgtttgagacatttttatggtgatttaggtgccaatgctgaaaagaatgaattaagattcaagagtagaacaatttataattattttaaagaaaatatatggagaaaaaaagataagaattggtagaagtttttttgtataaaagatttagaaataaagttgttatcagagacaataattatataactgaagagtcattgctgggcacattatgaacacatttaggctatgaaaagtgaaatataaatgtgtgatgaaaccaaggcaaggtggaattaaaattccatccttcctcattcccctcctaattacttagtggggagagagaaagtattgaagtcatttcatctttttcacatacagatatagagaaatttcattataatcttgtggcatgtttagatatcagagatacaacatgtggaactgacataacatacatgcaaactaagtggtcagatagatttactgctttagttgtgtaggtcaattacacaaagacaatttatatgaccaggatattatttagaaggaaaagagataagacccatgcaaataaactggcaagacctagttaagtatcaagagagacattgtagagtttagacaatgcagagttaataggaagaggagtatcttagaaacatcaataggagaaagaagcaattgatgaatggaattaggcatatgatttaacttggcagcaatggtccccatgagaagggagtgtccaaaataagtaaagttcaagggatgtaactagactgttaaaaagcagagtacagactttaaagatagtcagtggaggcccaaaatggggatttttgtcttactcttaagcattaactcacctaagagggaacaatgatgatgatcttttacataaaatatggaaaaataaaagactatcagctttgatattgacaggcacatttttcttcacatcagggggcctatttttggtctattttccaacatttaaatgaagaaagggttttctagtatttcttttggttataaacatagttttctgaattggaaaatttaggaaaatataaaagtgcataaaaataaattacaactatacaacccattgacaactgttaatattttagcacatttctatgttttgttttaatatttatgatttaaaagatttttttaaaaacagttttgcatactgcttactttactcagtatcatatcaggacaattttgtcattaaaaatctcttgtaaacatcattaaatttattaccttttaatttttgaataaattttaaggggcataagatagttaatcctaatatttactaaaacattataatacaaaatagaaaataaatgatacatgtttaaattattaatggttgaaactgttgactacgtactgtgataataacaggtaatactaattatttactctgccacaggaactgttctaagtactttgtatggattacatcatttaacaatcatattagccactatgaggaacctataattattattcccgttttacttaaagaggtttagtaatgtggctcaagttctcacagctagtaagtatggagctgaaatccaaacaaggcaatttgactcccaagtccatctttctaaatctatacattttgcattatatgtttaagccttgcattaggaactggagatagaatgataaggaaaccatagagggtctgctcttgctgagctgtagcgtgtagagaaacagttattaccaaataattaacattttaaatgtataattacaaactgaaatcagcacactaaatgaaaggaacatagatcgacaatagacaacaggagcctgactaagtgagtaaactagggaaggcttcctggaggaggtgacacaagctgacagctgaagaacgaacaacaatcagtgaggtaaaggggaaagatacattccagacagaaggaatagcatgcagaaaggccctagagtgagagggaacatgaatgttcagaaaactggaagaaattcagtgtgactggggctcacagattgtatgggagcaggctgtggcccaggaatgtagggcatgctgaggattttgaactttaaggacaatggaaatctcagagttttatgtaggtggtgacataatcagatttattttgaaaggatctttccatctgaagaatgacagacatactggagggaggctagagggaatgtggggtggatttctggtagacttttgctgaagtcgaataagaaatgaagataactcggtctaaggtagtggcaggaaaggtggaaagacctgaacatatttaagagatatttaacaggtaaatttgaaaatggtgatggagttagtatgttttctatgggctgagatagacaatactagaagaccaaaatttaggagggcagatcatgagttcaatcttggaaacagtgagtttgacatgtgaatattttgagtatgcagttgcgtactgagtgtggaaccagagtctttgccatagagatttaatcaatttgatgaatatgggtaaaaaaaaaaagaagaagataaagtgcaaagagaatgtagtgggctctggggagcactatttcatgactgggcaaagaattatgagttatcaaggaaaatttagttagaagagcatgttaactaggttggaattgttggcaacaactgagggtatactggaagttggtgatgatgaatttatggtgattcttgtctcccctgaggtgtgactctgcaaacagcaccacagaggcaaggaagcctggtggcaagaatgacccagaaaggttttgtaagatatgtgaaacgagaaggttgagtgtcagaggattcaggcatgagatagcataatttaccattcattttttttaaacatagaaaagggtttcttaaaaaaaaattgaggcttggcacgtgtctcacatacctgcaacctcagcactttcggaggtcgaattgggtgaatcgcttgagctcaggagttcgagacctgggcaatatggtgaaaccccatctctgccaaaaatacaaaaaattagctgggcatggtggcacatgcctgtagtcccagctacttgggaggctgaggtgggaggatagcttgagcccaggaggtggaggctacagtgagctgagatcgtaccactgcactccagcctgggtgacagagtaaaaccccacccactcatccccccaccccgaatttaaataattctgagaaataccttttatgcataaacatttgtctcttttaaatatttcttttggagaaattcctataagaattactcaaagagtaagaataactttcagccttttaaatgacattgccaatttgtttccagattcctctaatcttgtttgcatgggggcagtggctgttctaatttttattctttgtgttttgacaggctaaaagaatgtatccttcaaattcttctttcttactctctttcagctgctgtgtcatgagtaattttctttggttaaggtgcatatctcatgcacatgtgagaaggtcttcatgttgctttggaacaacaaagaaaaccttctggttattgaatctttgggtcataagcactttccctctcaaccactaaagatcttactccattttgttgtgatgttttatgatatggacaaaactgaggccaaattgttccaagaagagggaaatgcaaaggccccaaggtggagaatgcttgggaagaaagccagtgttaccacagtggagagagacaagagagaagtggagaaagagtgagagagcaggtactgggagatgaggccaaagagatagtgcagaatccaaatcataaccaagtcctgaaggcagggtgaggagtgtgcatttcattttgagtgagatgagaaaccactgggtggttgtaagagggggagtgaagtggtatgatttgcattgtaaagcaattgcatggttagggttggcacacacaggcagggtggaagtagaggcctcttcgggctactggttctcaggtagttcaagggcagaaatggggtctaaagcaggtatggggtggggactgtgcggtgacacaaataagccctcccagatcagttatttctatgctgatgtctaaatggaaaagcctgaagaggactctcccttcggctttaaggcctagggtacaaaaggcagggcagggcctgggcttgggggccttcatctgcttctccctgactagaatgaggaaggtctcagtgtctgtctgtctgtctgtctgtctctctctctctctatctgtgtgtgtgtgtgtgtgtttatagcctgggagtttagttatctatttctttccaggcttggctcttagcctcttttcttcacctccctctaaggatcttctcttgggagaagtattcagcagatactgaaggattatgactctaggtcactttctgactattttccctccctttcatgcagggtgtgtgagacatgggttcccagcacagatattttttctttcttatgttcaaatgatatcatcagcctaatttctccacaattctgattagatatcaaatttatcatacagtttcttgaatttcccattggtcacaaatagtattaatatcctttagagttactaattaaatctaatttttggatgccttagcccccacacttgaatcttttcccccctccttgaaacttgaccttaagcctatttagaaatcccagttctcactaaagagtaacgctatgaattttgagatgctttgaagaatgcacagggatttgtcataccctacttattggttctatttttgagtccatgtgaaatctcagcttcctccctcacccccagtttactttataaatgctcctgctaatctagcccccttctgatctccctcattgctttgggctagtctgaagcaacagaaggacttgctaaatttgtatattcttcctgagtcctggggctttgtgggaacaattataaaaatttaccaagtctggagaagaaggccttcgcaaatcttgagtgcgcagggagaagcgaatgtgtctggcgtttctgagaagatatttgtttattcataaatcatttattgaacatcagctctgtactaggcattgaattttgagcttgcattagtcacgtaagtcatagtgtttaaagagaccaaagcctgatagatgaagatagacttttcaacaatgattgtctcagagtatttataggtaatatgattaatttatataccaggcccaatgaggagacaaggaaacattcgatagaggctggagaagcttagaggggtgacattttagttttgaagagatgacccagttgtaggatgagttaaaagggtatggcatgagtcataactgtgagataagatacaggcctgtcatgagatctctaagtatctctgaaagcttaaaagggtaaagatggggcttactaggatatatggttggagagtcagccaaggagagccaagtatgacatatgagggctttggatttatcctatggacaaaagagagctttgaaaggttctaagcaaggttgttatatgaccaaattttcctttcagaaaaccatttcttcagcaaaattttgcgctgagatgaattcaagtaccattgcaacaactcacataagacaaaggcctccaatgaaggtggggtgggtagtgggtgtggccaggagtaggagaagattgtgtgggggtggtgaggaggtggatgggatggaggatggaaagagaggtttccaaaagttttaagaaggtagaattgacaggacatggtgagagacttgaagtgggtgatgagaaaaaggaaaaagcataatttaggggaaatatgaatttaggcttagaatttagaactttaggtgccaatggaacttccagttggagtggttcattggacagccaaatatttgagaccattactcaagaaggcagttgacacagacatcttagcctcaaagttccttgaatccttcactttaaggagcttcctcagtcttcacttcagcaaaccatatctacagtcaagtctagatcctgacatcaccttcacatgctctaaatttgaagaattaaggtctggtatggcaatgtgaccactggttccttgtatgttcaagctatcttattgctttatatccatatcttttcacttaatgactcaatgacatgaagtcactcaatgagtcattaagtcaaagtcattgagacttcatgtcttgccacatcttcttttctcctagtccatcagagttggtcttgttattccttcctgtaaccagtctagactgaaaaggagcagtcctgccctttaatatttagtacacacaacatgctcattcttttactttctgacatacttatgttgcagactctttatgttggatctgggaagctgaatgctaaagggaagcacattattgtacagacaggggccaccactaatatgtagattacagtggttccctcagcacttctgtataatatatttctgtccaggttcctttactgaaaactgtgggacatttcaaaccttcactgctttcttcctgtcttcattcatactgataccctgcctccaaactcaactgacatacggtcttattctctgcttcaaacagttgaagggactatgtctgactccttcaaccatccagtgtcttcagacttattcaggggttcacttaaatgccttttcctctggtcacaaaggagaagataattaaaagatgttaatattctaagatcattctgtgtccttcacttgcttatttctgttttacttattccttctttctcctttacattgatctctctgtattggttttttcttagaggactgtgagtttagtataaattatggaatgatatcctttaggacaaaaaaggaaagaatggtggttacatagaatgaagcacaaggaataacccttctcatttcagcacactgagtactgacttagagctgccattgggttcaactctaggttgtacccatgagattgttaacataggaactgaattaagaaagttagaatgtctgttttgagaccaggactcaaggtgataccaacatagacttgagctttgtattttatttaaacatctgcctatgttgtgtaagatttcctgtacttttgaaacctaatgacatgatatcccagatgtttaaaatcaattatttttaattcattgcatgcttgctacgtttcaaattctggtctcaaattatggaaatatctctaattttcctataaatgttgtgagatgcagtggtgtggagccacttcacccaggctcacaagagctaattttgcacatcccttcccaaactctgtgttcagtgacttgaatcagctatagcaggaggatttacactgtggaatcaacactcactgcaaattgaggctttttatttcttcatttcaaggacctggtttaccagcatactacttaagataggtcatatgtccccattttacagctgaaatttaggttcagagaaataactccctaaattaggttaactgtgaaagctacatgggtttttgggaggcaaggcaagatattctgtaagagagtaagacattgtcttttctcttcttttctcttcttattctcttcttaatcttttctttttctactgaagttgtagactgcaattggatttagactttctccatagaagtttatatatccttgtgaactgtatatcttccgtcttctgtttttttttttttttcccctcactctgttgcccaggctggagtgcagtggcacaatctcggctcagtgcaacctccacctctgggttcaaaggattctcttgcctcagcctcccgagtagctgggattatgggcatgtaccaccacacctggctaatttttgtatttttagtaatattttcttggtccctaataagttataatgtgaacattttgatgttcttttatttcttttactttcctcattaaacataaatggatcataagacagtctttgagatctagaggttggtgtatgttaggatgttattttttgttatgcttggttttctaataaatatatttgcaaaatgttcccaacactcaatttattaatgcttattctattactaaccagttctataaccctaaacaagttttcttagttgttcaggatggggatatgaccagtgacccctaaggtcatggccattcatgccaccattaaaattcttatgcttctgataagtagagtatgccccagtgtgcccctaaattactttatttaggacttaaatccacattagtatttactgtggatttttagtcctaaataaagtaatttcagtttaattttattaaaaatgtagctttagaggtagtttcattattttgttgtgcaataaggtttttattttgtttgaaaagtttcaggatctgaagctgagggaattctactgtgagggaaacccactgttcctgcagcagccagtgatttctacacagcaggagaacgtctggagtctacaggtgaagacttacctcattaacttaagtcttcaaactaaagccacaatttaaattttaaagcgttttcttttaaaacattcttgccaagccagcaaatgattaatgtaatcctagtccattggcaatgtggatcctatacataatctttttgacttgcttatagaatccagtgaaatcctaagtcactctgattcccagagtgacttaattcagagaaatggaaatattttgtaggatgaataaaagagagaaatttattttcactttagccttttcagtgttatttaaagatgtattgatttgttcttagtgtagtctttacctctttcactccctttttactcgtctctatccctagtggatgaatgaatatgatccagaaactgtgttcacttcagcaaaacaagttaatggtattaaaagaaggaacaggaaagcatattacagaactctttggtaatagacaagtcagagatcacaggtcctcccacatttggctatgattctccatcaagaatttagatttctgagatccatttgggtctgtagctaatgtgcaggattgtcataagacttttaggatttgtatgggatcaactttcctggctgcaggaaacatccagtcttgtccagtggcttactttgtttttttttttttaattaaattattgtatgaataatacctgtttattgcagaaaacaataacatacagatgagcaatggagaaaatcaaaatttcttatactgacttttaaaaagtttcttactacaaaagtaatacaagctcccgtagagaaattagggcaaaaaaaagccaatagaagttaataaaaatactaagaaatcaaattaatgctctatgacatttattcttttagaactttttatgcattcaaaatatttttgtaattaaagatgagttcaaactctatacactatatagagttgtttttccactcaattattgtgaatagctttccaatcagtaaaacaaaacaaaataaaaccagaccatgacatcttttttgatgaatacatggtattctgtatatgatgatatcataatatttttaactacttccccactgttggatgtttaaattattaataattttctggctttttagcctttataaacaaagatacaaggctgggcacagtgtctcatgcctgaggccccagcaatttgagaggtcatggcaggatgattgcttgagcccaggagtttgagaccagcctggccaacagagtgagaccccatctctacaaaattttaaaaaccttagccaggcatggcagtgtgtgcctgtggtctcagctactcaggaggcttgagcccagtaggttgagtctgcaatgagttgggttcatgctactgcactccagcctgggtgacagagcaggatcctgtctcaaacccccccccccccaagtcaaaaagcaacaacaacaaaaagcaaagggacagtgaccattctcatagtacatttttagttcctgtgcatattatccctaaaaatgtaactgctgggccaaagaactgacatcttgtaaagtttgatttatttttttcagattccctttcacagaatattttcacaaacagcattatttcttactcttctgtaacagaaaaacatctcatttgaaatttaatagtaaataatttgagtaacagttgtatttaattttttattcccttataacttattttttctcctttcatcaatcatttcagtataataatagcagctaacacttattttatgcctattatggacaaggtactgttctaagcacttaacaggaataaactaatttagtcctctactaaccctaaaaagataggtatcattattgaccactttttatagatatagaaatggagattcagggaggtcaaataacttatctgaggtcacagagctactaagtgttgggacaatgacgccaacttaagcagttgggttccagactcccagctgcaatattggttcagaaaggggatatagggagctgagggaaatggagacagggtcatcctgggttggaggaggttctggtttgtggaggaggctgaattagcagttaacccaatctggtagctgtcttacagagagccttcaaggacaagaaccttgtctgtgagggtggtgaatgagagagaaattgttctaattttcagaactgttgggtccaggagcacaaaagttaattttttttttcttttattattatacttaaagttttagggtacatgtgcacattgtgcaggttagttacatatgcacacatgtgccatgctggtgcgctgcacccactaactcgtcatctagcattaggtatatctcccaatgctatccctcccccctccccccaccccacaacagtccccagagtgtgatattccccttcctgtgtccatgtgatctcattgttcaattcccacctatgagtgagaatatgcggtgtttggttttttgttcttgcgatagtttactgaaaatgatgatttccaatttcatccatgtccctacaaaggacatgaactcatccttttttatgaatgcatagtattccatggtgtatatgtgccacattttctttatccagtctatcattgttggacatttgggttggttccaagtctttgctattgtgaatagtgctgcaataaacatacgtgtgcatgtgtctttacagcagcatgatttatagtcctttgggtacatactcagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctattcatgtcctttgccgaatttttgatggggttgtttgtttttttcttgtaaatttgtttgagttctttgtagattctggatattagccctttgttagatgagtaggttgcaaaaattttctcccattttctaggttgcctgttcactctgatagtagtttcttttgctgtgcagaagctctttagtttaattagatcccatttgtcaattttggcttttgttgccattgcttttggtgttttagacatgaagtccttgcccaagcctatgtcctgaatggtattgcctaggttttcttctagggttttttacggttttagatctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggccatgcgggctcttttttggttccatatgaactttaaagtagttttttccaattctgtgaagaaaggcattggtagcttgatggggatggcattgaatctgtaaattaccttgggtagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagttatacaatcatgtcgtctgcaaacagggacaatttgacttcctcttttcctaattgaataccctttatttccttctcctgcctaattgccctggccagaacttccaacactatgttgaataggagtggtgagagagggcacccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaaaggttgttgaattttgtcaaaggccttttctgcatctattgagataatcgtggtttttgtctttggctctgtttatatgctggattacatttattgatttgcgtatattgaaccagccttgcatcccagggatgaagcccacttgatcatgggggataagctttttgatgtgctgctggattcggtttgccagtattttattgaggatttttgcatcaatgttcatcaaggatattggtctaaaattctcttttttggttgtgtctctgccaggctttggtatcagaatgatgctggcctcataaaatgagttagggaggattctctattgttttattgattggaatagtttcagaaggaatggtaccagttcctccttgtacctctggtagaattcggctgtgaatccatctggtcctggactctttttggttagtaagctattgattattgccacaatttcagatcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtgatgatatcccctttatcattttttattgcgtctatttgattcttctttttttctttattagtcttgctagtggtctatctattttgttgatcctttcaaaaaaccagctcctggattcattaattttttgaagggttttttgtgtctgtatttccttcagttctgctctgattttagttatttcttgccttctgctagcttttgaatgtgtttgctcttgcttttctagttcttttaattgtgatgttagggtgtcaattttggatctttcctgctttgtcttgtgggcatttattgctataaatttccctctacacagtgctttgcatgtgtcccagagattctggtatgttgtgtctttgttctcattggtttcaaagaacatctttatttctgccttcattttgttatgtacccagtagtcattcaagagcaggttgttcagtttccatgtagttgagcggttttgagtgagattcttaatcctgagttctagtttgattgcactgtggtctgagagatagtttgttataatttctgttcttttacatttgctgaggagagctttacttccaagtgtgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtcttgttgatctgtctaatgttgacagtggggtgttaaagtctcccattattaatgtgtaggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttattggtttaaagtctgttttatcagagactaggattgcaacccctgcctttttctgttttccatttgcttggaagatcttcctgcatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcatgatgatgttagctggttattttgctcattagttgatgcagtttcttcctagtcctgatggtctttacattttggcatgattttgcagcggctggtaccagttgttcctttccatgtttagcgcttccttcaggagctcttttagggcaggccttgtagtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctcccgagagatctgctgttagtctgatgggcttccctttgagggtaacccgacctttctctctggctgcccttaacattttttccttcatttcaagtttggtgaatctgacaattatgtgtcttggagttgctcttctcgaggagtatctttgttgtgttctctgtatttcctgaatctgaacgttggcctgccttgctagattggggaagttctcctggataatatcctgcagagtgttttccaacttggttccattctccccatcactttcaggtacaccaagcagacgtagatttggtcttttcacatagtcccatatttcttggagggtttgctcatttctttttattcttttttctctaaacttcccttcttgcttcatttcattcatttcatcttccatcgctgataccctttcttccagttgatcgcatcagctcctgaggcttctgcattcttcccgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttctctcagcttgtcaaagttgttctccgtccagctttgttccattgctggtgaggcactgcgttcctttggaggaggagaggcgctctgcgttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggagtaccctgcggtgtgaggtgtcagtgtgcccctgctggggggtgcctcccagttaggctactcgggggtcaggggtcagggacccacttgaggaggcagtccgcccattctcagatctccagccgcgtgctgggagaaccactgctctcttcaaagctgtcagacagggacatttaagtctgcagaggttactgctgtctttttgtttgtctgtgccctgcccccagaggtggagcctacagaggcaggcaggcctcctggagctgtggtgggctccacccagttcgagcttccccggctgctttgtttacctaatcaagcctggccaatggcgggcgcccctcccccagcctcgctgccgcctcgcagtttgatctcagactgctgtgctagcaatcagcgagactccgtgggcgtaggaccctccgagccaggtgcgggatattatctcgtggtgcgccgttttttaagcccgtcggaaaagcgcagtattagggtgggagtgacccgattttccagatgccgtccgacacccctttctttgactaggaaagggaactccctgaccccttgcgcttcccgagtgaggcaatgcctcaccctgcttcggctcgcgcacggtgcgcgcacccactgaccggcgcccactgtctggcactccctagtgagatgaacccggtacctcagatggaaatgcagaaatcacccgtcttctgtgtcgctcacggtgggagctgtagactggagctgttcctattcggccatcttggctcctcccgtctccaaaagttaatttttacaatgtgtttagtggaagtagctatctatgcctgtaatatgtaaatgatgtgtgtagttttaagagtatccctaagaattcttctcagaaaagtgacttaaattgatttgtacttaaagtaagagttatttctactgggcatttagtcaatgttactgattaaagtacttgctgtgtcaaagaattctaggaactatgatatgggttatgccttggtaaagattttagaaactttacctcacctcagagatttatgaagtaaaatttattgctaataactatattatagaaaaatattagcgggaatatactgcattagtagatgccaggctaaatggtttaccgtttttatgtaatttaattctccaaactctttgtgatagtattggaaaaaaatcccaactttacagatgaggtgttcaagaccagggaagttaagggttcatccaaatatgaccacacagcaaataagtcatagagccagaatttacacctatgcatgtatttgtctcagactttgaatttttgctcttgatgctacgttttagtgcttatcatacacatagtaacacctgagtatacaatagttccaaaatgtatcactcctaaggattcatatttgtttttacattttatgtttttcatattatataatttttatgtgtataatttaataactcaaaaattataaggaaaatgtaggacatataaaatcaatttcatttatgatgaattataattaacttacaaatattctaagaaaatagcatataagctatctaaaaggagcaatttgagtattttgaaatatttttatagaccactttggtctataaaagatttcttgacttttaaataacactggaattagaccatcattaaattgtatactctcaaaaattgcactgaatgcatctctaagagatgtcctaaaagatactattggtcatgccaatagtattttattttatatatactcacatttccaagtaagaactttatattttaatggtgtatgctatccttccaaaataacacattggcaataagtaaaagaaaaatataaataatagttgatgtaagagctgtcagatatactgagtgcaacaaacatgtttgggtccagaaatcataaatggaaaaagtgatctatatgaacctatttttaggtccctggtatttcagcaaatgcttctgtcatctgctattttgggtagtgaatccttatccatgagttttctacagctttataataagacttggccattgaattcgtgtagctaaaagcccacctataaaatcagtatttatttaagaatcacaagctatgatctgcttaagtagttggagaaagggtgaaaataaacatctgatttaggcacccttgtaatattagtgtgaaagcatgacctcagtcatgcaaccacccaggagaatgagcttaagtgggtaggaggttgtgctgttgaacgatcagacaaataaagaatccatgctcagggctgtttactgtataaaggcagctttctcgggtgcttgtttattgggagggataggataataggaaatggacacagcaatttataagattttgctgttattttttaagtttttaaataatttaatttctttaaaattaaattaatttcatgcatggggagaatgcatgaaagattatgtgtgtatatatgtattttcaaaaattcctatccaagctttatgtggactatttcaatactactgggaaatctttcacttttgttgggaaaaaaaagtaccaaataaatcatccccaaacactgttaaaatttcaagcagtgtttgtgtaacatttatacaggacttccatgctactgacaaaaacaatggagaaaatttaatggattcaggcaaatgtttatttattttctttgcttggtcagtgaagatttaattttatgcattatgtaatatatttttattaagatgatagccctaatgaaaggcaacttccattttcttacttcctccctttattatttagtattttattattattattgcaagtcaattttctgaacatatctaggtagataggtttaactgagattaaattcacatatttggttcctagaaatcattgcttttttgatggcactattcaggttctcagtgcagcaaggaatttagaccagtgcttctcaaatttcaatatgcgtatagattacctgaggaactagttaaattgcagattttgattcagtaggtctggagtgtgtctgacattctgcatatctaataagctcccatgtgatgcagtctgtgaaccacagttcaagtagttaggatttagaccttagtgaacatgacaaaattcatttttgaatccagtctgaatgtttgtacagtttttgcttattgtaatgagaggtgccagatttaaacctaaactgtatctaactttataaaatgtgtaatgcaaatgtattacgacttggattcctatatgtaagagatgtagaaatacgacaatgtaagaaacttattgttcttatattgatgaaaaccaaacttatttgcaatgccagtcatttacaacacaattcattagatacactgcagaatcttaatttaacagaatctagataataagccatacactttatctaatgaaatggaaatcaatgtaatgtaaaatagttttgaaaacaatctgaggaactgtattttttttttcaatttaggaaataacatcaagatttgtaatgaatcagctagcagaaaataaccctttcctaatggatgacatagaacggtacccacaagtcaggagcatgatctctcagggaaaaacatgtgcaatatgtggacagtactttataaccgtatggctggaatgtgttcgatttgttcctccaccaaaggtaaatgatgctttttatgcgaatatgagcataatactgattcctatcctttgttcttatctaaatcagttaatactaactagatttgtacctatgattggcttataggatagtatactgtaaattttggatagacaaatttggataagtgtcggtaataatcatcatcacccattctatttacattcatagactcccaaatttatcaaaatacatggattctagcaaaatttcatgaaagttgaaagtttttaatcagtaaatcccttttgttcatgaatattaataataaaaccagaactaaattcttctcagaagaagaattggtcagtagtctgtcatggaattcttggtgtagaaaaggtgaatgtgctggctagtttatatcatgatggtgttctagaacactaaatacgcatgaatgtgcacctgcaacattatgttacccaggagttgtgaatcccagggcagttcacatagcccataaggcgtgttctagaccagagctcagcaaactcctttttctctaagcggccagatagtaaatattttaggccttatagacagtgtgatctgtgtgactactacttgactctcctttgtagcatgaatgcagctctagataatatgtacatgagtgtagctgtgttctaataaaactttacttgtgaatttaaatttcatataatgttaacatatcatgaaatattattttattttgatttttttttcaaccatttaaaaatgtgaaaacctttcttagcttacaagtcttatgaaaacaggaggtgggtcaaatttggcctggggaccatagttttcccacacttgttctagactgtctaatgtttgcttttaataccagaattcctttctgctcttggtgagcccttggccttccttgggctagcatagtataatattgggggataattttaaataaattaataaaaacagctgcagtttctgccattctgaaaattgtcatctagtgaaggagacaaacaaataagtaaacacaaatgtaacataaattgtgactaacatgacataaaagaatggtatattagtttgctagggctgacctaacgaagtactacaaactaggtggcttaaaacaagagaaatttaggctgggtgcggtggctcacacctgtaatcccagcactttgtgaagtcgaggtgggtggatcacctgaggtcaggagtttgagaccagtctggccaatatgataaaatcacatctctactaaaaatacaaaaattacctgggtgtggtgatgggcgcctgtaatcccagcttcttgggagactgagacaggagaatcacttgaatctgggaggcagaggttgtagttaaccgagattgcaccactgcactccagcctaggcaacagagcgagactctgtctaaaacaaaaacaaaaacaaaaacaaaaacacaacaaacaaacaaacaaaagaaaacaagagaaatgtattgtctcacagttgtagaggctagaagtttaaaatcaggtgtcatttaatttgatcatcttggtaaaggccctatttccaaacaaggtgacttttgggggcactggatgttaggacttcaacatatgaattttggcagaaacacaattcagcccataaccaatgggtttcacaaggaagagtatcagggaagcccttctttaaatctgggataagggaagtcttcacagaggaaatgatattttaaatgacacctcaaaggtaaagaaggtcaggtagaattgtggaagagtgtttccaggaaactgttccagtaggaacagtgtgtattaatgggaaatcactttttgattcgaggaactgaaaaatggttcagtgtgattagaaagtattaattgactaggagagttgagataggcaggagtgagatcacaaaataccacgtagtttacattaggaatttggcttctatttaatatgtgatgagacacatttgaggaattttaagtaaaagagtggtatatcctaatttacattttaacaatataacatctgcatagagaatgaattagagggcaaggaagtgagattaggcagtaggctatttgcactagaccagctgagagatgatgatcgcagtggcaatggagggaaattatggattgaagatgcatcttggagaaagaagtgataagacttagatttccaggtttttttggcctacagaactgtgtaaagcagattttttttttattactaaaatagggaagactaagggagaagtaggcttgttggggagagatagaagttctgtttttgcacatggttaagtatgagactcctgcaaaatctgggagcctgagcaacctggaagctatagactcctatctagtctgttaggcatgctgggaagtctaggactcattgttagctgtgagtgtgtgtgtgggtgggtgggaagattttggtagggaactagatatgtgacctctaacatcatctctatctctaaagagtttgattctaaatcctgttgttcaagtgatttagggtatcattatgctccagtagtctttgtgccaataaaggatctgagttgtgaatatgcttatacctatctttttttttttttctttccgagacaaagtctggctctgtcacccagcctaaagtgcagtggtggtgatcttggttcactgcaacctccatctcctgtgttcaagcaattctcctgcctcggcctctcaagtagctgggattacaggtggccaccaccacacctggcttttttttgtgtgtgtatttttagtagagatggggttttaccatgttggccaggcttgtctcgaactcctgatctcaggtgatctgcctgccttggcctcccaaagtgctgggattacaagcgtaagccactgcgcccagcctcagtgtatcttatcactagccactcaccaaatttaccaaagaatcttttaaaaaatacagattatcctaccctagaactactaaatcagagtctgtagcagtaggatcctgagcatccacatttttatgaagatttctagccgggcacggtggctcacgcctgtaatcccagcactttcggaggctgaggcgggcagatcacgaggtcaggagatcgagaccatcctggctaacacagtgaaaccccgtctctactaaaaaaaatacaaaaaattagccgggtgtggtggcgggcacctatagtcccagctacttgggatgctgaggcaggaaaatggtgtgaacccaggaggagcagcttgcagtgagccgagatcgtgccactgcactccagcctgggcaacagagaaagactccatctcaaaaaaaaaaaaaaaaaaaagatttctagttgattttcatgtgcagtcagggctgagaatctctgctctccctgtttagggctgtcccagtaccacagggaaatggttgtgtcttacacaccttactaagcaaggcctatgtggtttctcacacataacaaaaagttgaatataaaaaaagttgaatgaatattcattggttgaatatatgaattaatgaattgttagtgacaaaggtgtagtacagctaatagtgaaaaaagaaaaggaggtgttggtgaaggagtaaatccactgtggagcactggaagatgacaaacaccttaatatggcctctatgctggggagaattcttactatggctgccttcaggcacactgtagagtttgctctgtcagtctgcttcttggaccctatgctgaaagtctttcactttactccactgtaagcagaacaaaggctcctgcatacaagtatgctatgttcccaaggatctccagagcctggattaggcctttcgcctttcacagcccatggcctccccagggacaatcgatgagtgcatgtgaatgctgataatgtattcttactagcattattagttgtttcataagcttacatttctaactcctggatgagatcatcactacttaggttcagagatacattatctttctcaaaactgtaattgtgaaactttctttcatgaacttcactatatgtgttgttcatcatgaggttcaacaaggacaactttttttccaccaactttttagtttgagaaattggaaaacaacacataacttgaatgaataatacaatgaacatttgtataccctttacctagagttgccgatttttaatatttttttccattggccttatctgttactgttttttgcctttcaggatgcatcttgtccaaaacaaatttgatattgacacaagccaagaatgtagcctacctagaaagattgtattattacttttcagggcaaaaatagaagaatagattcgaattataaaaaatatgaatgaatgaatgaatggataaataaagctatccttcataccaagtagagagattttatcaagagttacagtggataacacaatatatgagccagaaaatatgtaggttattttagctatactaacccacgcttaggacatggaggctcacgttactggcctgtttactttccaagaagcagagtacagattttacaacagctgctttacgtagttcatttataatcctgtagaatgaaatccaggaacagtcatcagagttcacatcacctgatgtcaggtatttacacatcacctgatgccaggtattcacgtcacctgatatcaggtatttactctgaactagctctgtggatcctgacagacagcctgatagacaggatccacagagctagtccagagtaaaagacctaaatcagctgtggttgtggtgtagagctactacaatttttctcacaatgtcctttaccagagtttttgacactgccaagtattgtaaaatgttgcatgtgaattgggagactaaaaggaaggctagaagtgttttcctcttgatccagtcatgtacaaattatgtcttactagacataaccatgtgtgcttaagacaaaaaaataaaagtggaagaatctaatcagagaaatcattctcatctcagttacatgtatattgggctttagtgtagtggttgcctataaaagttctctatgaataagaaacagtgatttaagttgttcagtttttcaataccttgatgctcttgctatggaaatgtctttgtcaaagttgagttggtgtttatatcagaaagctttgaagtcttcatggcatttagcaaaatttgtagtaatcgatttacttggtgttggtgtctgtctctaccactgaatactaagctcaaggaatttaagaaccattttggttttgttcacctttatagagagagagcttcggacaatacctgataaaattttatttctacagaatgataaatcagatctggatttgaataccagctcctcctttaattagtttgtcaacatattacatctctatgtatcataagaaaaatctggcaaaggtgctgccaaggaaggctaatgttaaaatttttaaaagcccagaatctagaactaaacagatagccaaagagaacattaaaatagtggttgagcaggaatttgaaagttaaaaccagctggaccttaaatacaaagagaaaagacagctcatcggtgggaaaatgaggatagaaatgtatgttggtcctcaagatgggagtaaatatgtaatcttgatcacatatgtagctatctgtgaattgttcacattatcatctggaatggattgttatattcaagagacatttaatgagtacagcgtgtcagattactcggaaacagttttcaaaacatcctgctttccactggtgatgttctgaacaccttagacaagttgccatgtttaattgtgctctgacagattccctctcaaaaccatctgatgtgctgctactcttatttcatgtctctctttcagaaactacaacctaatacaagcaacaacagccagaatttatttggtactgagtgtgcatctggtgctctgctaaatatgtcacctggaatacctcaattaatgtccaaaataaccccatgacaccagtaagaaatccaaggcaaggagaaaccaagtaattttgccaatttcagaaagctgccaagtagaggatatgggcagggaactcatacatgttattcctgatccttaaccagagagtctgggctatgtttcctatgcttttccaacctagttattccccatttacttcagctgaacttaagacatttatgttaaagatccttcttctgtcctcatttatttatccactgaaacttatttatttttttctaactgtgtgtcagattatttgccagggctgggaatacagaaccctgatccttgagaaactcacatgttcccaggagaagtgggataataaggattggaatctgacaagttaggtttgatgtccagccctaccacttgccacctgtgtcctgttacttccctcttcaaggctaagcttcctcatcctgtcaaatggcaataataataatacccatcacacagaactgtggctagggatcatgaggtaatgcataaacagtgcttagtacagtgggtgttcaacaaaggtagcatatagtaggtgcttaataagtatttttttttatgtgtgtgttttgtaaaccaaggctttcagacaagaaagagagaatgattgcattcttgtgataagcagatgtgaagctgcacaggatgctgtgagaagaaggcatctccagtaaatgggatagtccctggtttaaccctggtgcctaccacagtgattgtgtttggcgaatccataataaatgttaagttactttaagaggcatttcttagaaatgtgctttgaaggctagggaggcatttagaatagataaagaactagtggataagcatttcaggctaggcagttgcctgtgcagagttaatattgtgcaaatataaattgcacaatgtgtacagtgaagtcacggaaggtgaggtatgagagatgaagttggagaaaacagcagtgtgggttacagtgactcttttatgtgaagtttgagcttaatttcaaaagctagtgtataagttgctagggctgtataacaaagtatcacagactgggtggcttacacaacaggaattgatttattaacaattctggaggctagaagtctgagagcaaggtgccaggaggggttggcttctcctgcagcctctcttttcggcctctacatggctggctctttcctgtgtcttcacatggtcttcctttggtacatgtctgtgtccaaatttcctcttctcataaggatgtcagtcatattggattagagctcactttatttgacttcattttaacctaagtaacactttaaagaccctatctccaaatacagtgacattcggagatactggggtttaagacatatggatttttgggtgacacagtttagcccgtaacagctacttagagttgttgaagtagtggggtatgatgacatttttgcttgacaaagagaggctagacctggtgatgtggatttaaaaattgtttatataagtgagacactcgaagccctgggaatgaagattacctaaggagatctactcagtagggtgagaagaccagaaggacagaaccttggagggcaatattattaaaaggtggcaaaagcaggagtcagcaaatgagaatgaaaagaaacattcagggacagaagggcaaaacagggagagtggcacaaattcttcagctataaaacacagatgcacaataaacagggctttcttgctttttcttccactgaacttagcttttatttgggccccattctactggaaagtttacctagttaattcaaggcttatgtggtaattttaggatttcctaagtcatttcagattttatcttgatcacttagaatttccttcccttcctttctgcctatattatctaattcttggagtttttaagtagtgtcatggtattaggaggtaggagccatatgttctgccaatgtcctgtttcatgtgggcatcctctggtgtgtgatcttcctatctagatcgaagctccgtggtagtgtctacttcccattggtcatgcttcttcttccatgtaccctgtgtcttcttgttctgatgttgaagtcccttttgtttgctggttctctttcaaccacttctacactattctctgggcataagaaaattttggctgctctcttactctaatatgggctcaagaatgagctgactaaagacaccaagttgacagatccagggctgaggagaagaaacagcactgaaaaatcaaaagaggaaggtggtgtcctttgtgtcattaagtggcagggctggaagcaggttgcatcgataagaagcctgatggggccaggcgtggtggctcatgcctgtaatcccagcattctgcgaggccgaggcgggcggatcacctgaggtcaggaatttgagaccagcctgaccaacatggtgaaacctcgtctctactaaaaacacaaaaaaattagccagacatggtggtgggcacctgtaatcccagctactcgggagactgaggaggcaggagaagcacttgaagccagcaggcagaggttgtagtgagccgagatcacgccattgcacttgcactgcagcctggcaacaagagtgaaactatgtctcaataaataaataaataaataaataaataaataaaaaagcctggtaagaatacggaagtgaagccagcaagtcttgactaatctccaagcaatgtagctgtaaaaggtaggagtgctatagaatattctttggacgtgaggaaggcttgaagaaaaattttgaaaatgggaagatatgtgcatggttgtaggctgtggaaagagctagtaaggaggatgtaaaattagtctgtcttgtacaccaattcaggaagagtttaatgctgtgattaggtactgctactttaaaaaattagtagaatttttaatagaattttgttactgcatgatgaaccttatctattccatcatgttaagggaatgagtaagccaagaagaggagatatgaaaggttttaaacaactagaagatgggtaatggtagtgcttttccacttacaaaatgctttttacatatttttttctttcaacatctttactgagttcttactatatgcaaggtactatgctaagctctctggatccaaagatgaataagatgcagttcatgctattgaggagatcacagactattaaaatgtaacgttagaagcattgtcataaagcattatatacccatactatggagtcatagacagaaccaacaacgactttggtggaggctaaaaggtaaatttcccagggggtgacatttaagtaatagagtttctggccctcatattaactttgtgacttggttttcattgtctctattcacagttgaggtaactaagactaagcaaagttaagtagtttgttcacaaatttcaaatctatcaaataatagaattaggactttagcttacctgacacctcctgataccaccttctgtctcttttttcctgcactagaacatgcacaatttcattttgaatcataagagaaagtgcaaataaatttattgattgatgatgataccattactcccaatagctatctttgtatatttgaaacactgtcatgtgaaagagagatgaggctttccttctgttgacttgcagagtaagaaaatagaaccactgaccattcaggtcagatagatagaactttcttacaggattttaaacacagacacacacacacacagacacacacacacacacacacacacacacacacaggttaacatcaatcatcactgaggaaacaagcttggaagcaagagtaggaaaataaggagatttgatatctatataatttcactttaaaaattaaaagagaatacatttttatgaattaaatatgtcagggcattataaaaacagcaacataatggcataagaatatagcatggattaaaaacataatggttaaaagagaaacccattagctaggatctacaccctttgaatgttctagctaatggcagaaaatgttcaaatattgaaagaagacaatttcagattgaaaaagcacattgagttccaagcagaacaaacaagaacaaatccatacatagacacattttggtaaaactatataccaccaaagttgaactattgagagctaaagatgaaatgttaagaaaagagagatcacctacaaagcagcagcaatgaactgacatcagatttctcagtgacagtaatagatgccagaaaaaacaatggcatactattttcaaagcactaagggaaaataactcaaaatgtagacttatatgtgtagatacattgataggcaaaagccatgggagtgtcagaaaattataagaagaaaaaatttttaaaggaaaattgttttgctttataaaaaccatggattctagcgttattaaaatcattaagctaataatatctagtaagtatatgatagtaaaaaagtatatcacaatggaattagaataagtgtatacagcttgttaatcatgctaaataaatttaaggatgcttaaaatatttaaagattgataaagaaaattgagatttgaatatatattactagatgttagcagttaaaaaaaatttaaatgccgttcataagttccttgtttccagagttgaaacagagtgaaaacatgcacagaatacttggggatgataatcagattaaccacactggtaaggaattgcttttatatatctctagatttttatgttaagtagacagcaattatacaaatatatatatatatatatatattttttttttattttttttgcttggaagcctctctttctgttaaattttttttaatttgttaattatctcttcagaaactaaacttagagactgctgacctttagagcaaatactttatcaggaagggagaacatatttgataatgccaaagtctagttgcccctgttgtgctttacacaatgttctgcttcttatggggtttacactcaaaggagggagacactggatgataaatgggtctttattctcaacataaaacacagaacaatcaaatatcaagttgtaattgcttctattcaggtgaatgtaaaattatgtcatgcttgctttaatgaaataatgagatgaggattggaaaatagtcaaaacaattttattcagtctcaaatatcaatcttgatcataattaatccagatgcttttgtctttttctaaatgctatagttctgccatcaaagttgaattagtccttagcaattacaaaatgatcaataatttcaatgtagttgatatttcaatattagctactaatgatataaatctttgaaacagcaacacaaattatcctttttagttactactaactttgtctgtatttgaacaatgacttagacctaacctaaatagtctcataaaattctttccaaacacttgagtgatcctgtgcccaagatatgcatttaatagttttcatttcttatagtttcgttagttgaacttaacatttccccagattcctttaaagttgaatagtttagggagggaatggtttggaacatgaactctcaaccctgtattaaatgatgtaatgtaattaaaactaccctcaaaagagattagactgcgtaggtctccctataaatgagtgaaaacgttcatttactttatgaaaataaatgaaaatttgtaactttaattccttttttatgacaagctgccagtaatgaaacataagattacatttaataattttactcattacttataaagtaaaatcttactttgtagtaaaaagttattactgttaagataccactgacattcatttatgaaactgatcatttcaaccagtcaactgtgaaaatgaatgtaggttttaaaacatttatgccgtggttagtcaatttaatgtacattaggtactaagaggatcagaaagcatcacatttctaattctaaacagccatgaaagtcataagtatttatttagaaatattaaaatggatatatatttcttattgttttattccaaaaataacaaaacaattagagtataaacatgagctcatacactgtgtcttgattacttttactcctgtgagaactcctcgaatactcttaccctttcggagaactctcccttttgttctcaaactgctggatacagtcacagtagtattctgtatctataattttttttcttctaaataatcttacattttattgagctttagtttagttttctgaagctgtgtatcatcaaaatgttgaaaattccttgtgaaattcagaggatattgattatgcagggggtgctgtgggagagcaggaccactgtgtggggaagggaatgctgcttagctgggtggctggctggaacatgatgggattttctttgtcgtttctgttcttatcacagtccaaattgccctaagggtggaatgaccatataatgtgtcgtctaagccaagatgcttttgagagtaaaagtggattttattaatagctgtaaaaacaacaggaaaccaggactgtccttggcaaatcccaatgtatggttacccttgctaaatggagtagttaacttcagagcagtactcatgtcacttatcactgtggcatggcagtgataaattatatttagtcattccataaatttttgagggcctgctttaagcagggaactgaatgctaagtacaatgcgaataagtaggagacctagtctgttccaaatggtttaaaatttgagtttaaatgctaaagaggtaaaagatattagcaataaaatctagatattaaatgagtgatagagaccaattgctttaggattcaaagtggaagatgagatcactgtaggttgtctggtttgggaagtgcctagaaacacaggacttgtatatagccttgaaataggtggaattcagatacatggagaagaaagtaaacagaatgttttaggagaagagaatggtaaggaggagaataaatcatgttcatagggcagtgaatcagttaggttggtttgtggataggagtggcaggaggagacattattaaaaagttgaggtcacatgccatgaacctgtcaaaggattagattaagtaaggggtttgaacttgatcttgtttggaaatgaaaccctactgaacatgtgggggaaaaccggtgagatatatatgtgttcgtgtgtgtgtgttttagaaagagtcacttggcaatagtgtgctggcttagttgaagtttgaagagaagagaagctgaagataagaggctagttagagtggtttcctactgtgggtgtaaggtgtggtggtggaaaagcaaggaaagtatcataaggaaggaaggacaatataaattgttgattgattgagcatgggaaacctctgaggggtgtgaaggagaaagagtccagaagggagctggtttgggaggcaagaccccaagttgtatcttagacatgttgagtttcaagtgatgcctggataattcaagtgaatacgtttaaccctcagttggagacagactggcatggaaaagaaatatacttcttcagtatgttatttgaaaacatgtgcactttccaacaactgttcattcttctaaaccattctgtagttgctattaagctataatagaaaccctcattaatgaaagagcctgggaatcatacaatgactaacactaagctataatttagtgaacttagattctaatcttgtctctaccttgaaatatgaggcctaaggtaagtcatctaccttactatatcaggactaatttcctcatttggacaatgaagggattagaccagtctcttctagcatgaaaatgcattgattccataagcagggagggctgccattgttatgcttttcaagtcctgctaatttggaacatgataacagtattagttttccattgaagctgttaacaaatttcccaaagcttggtgacttgacagaaattttttttttttttttacagtcaagtagatcagaaattcaacatgggtctcactgggcaaaaatcaagattttgcaggctgggtttccatctggaggctcctggggggaaccattttctggcccttgacagcttctagaggctccccatatccattggctcatggttcctttcttccatcttcaaagtcagtattggctgatctaggccttctcatatcacctcacttggaccttctcttttatctccttcttccactttaacaactcttgtgattacatggcgcccacctaggtagtccagggtaacttccttatctcaaggtccttaatttaacccaacttgcaatgtcccttttgctatgtgaggtgacatgcatattcatgaatttcaggaattaggatgtggacatctttggggggacattattttgcctactgagatacattttcctgagaaaacaggaaaccatcttatgctctttttctattccttgtgcttcatataatattgaaatcttatccaaactttttactgtgccatataaatatatattgcaataatttttaatttctcaaagtttaaaatatggcagtgatggttaccaattatgttgaatgatttttaaaaatttctcaattctaccattcaacaaacataaaacttagcaaagagtaatatttgaatttaaagtggaaaactactttttaaaaaacacgtagagaatataatcatgtgtttgtttgctttagaaaataatgcaaatattaatggtgaaaaagtaaactgtattatagcattttactttttaaagctttttgctaaaatgatattttttcaaaataaaagcatatataatcacagaccaactccttttcctattcactgaccttggcttgacagaaaggatatttcattgagtgctttgatctctatctataaacaatgacaaaagcagtatttgtctttgacaaaatcatgaggttttgttaattgaggtttgtgaagagaggtcctctataacagggagtgtcttattcctttgtaacatgctcatttcaaatggacatatgtcgtaccagtagaaacagttgcaataatgccacaaatagaaatacaaatttaaaagggcagcaagtgttaaggtggtacgagaatttcatgttatgcaaacattactagagatgatgaatctagatggaaaagtgtaataccaagaaattatgctgagttgtttttctaagttaaatttctagaaaacaattcatagccctgaaaaatattgtataagaaatagaaattattaagttggagaataatcaccttcaaagtttcatgttcactataaaactaacaacgggcatttaatagacttctaaaaatctcaccaaaatattcattttattataattaactaaacaatgtttcccccaagaaggggaaagagggacacagacactttgcattcctgcttgcaataagagccaacctaaactctgcccatgcgatgtcctaatgacacaagggaaatggctaaaaccacactggaaatagaaaatgcctttaatactttctattataaacttttcacctcatgaagaaactggacaaagcaaatcagatgtcgaacttgtttccttagtttatatttgtttctttctctaacttcctcctcttggttcttggctctattaattgttcaggtttcttaaagaggagctgaggaaaatgtatgtagcatgttttattttcaatagttctttaattctagctgagatatgttacagaagtaggcaggattaactggttgggtgagacggttgtctagtatatggaaaaggaaaagaccatatttagcctgtcttttgccatttgttctccaaccacaatttcatcacttaatcattataatctagttagggaatcaatattatatcttatatagtagatttaaaatattatatgtgtctgtcattcaaaaatacttatgaaatctttttatttctggactaatgtattgttgatatcccatgatttaacattttatggtctatttatagtttatactgtattgtttccccaatacaatgtgcacattcttgaatttatgctctcatagttcaccctccccgaaatgtccttttggtttctccccaggcagacacattctagtcaaccttcaaaacccagctcacctttttcttatattgtgaaatcttgcttaatatgcagcctatggtgtctcctgtctctgcactcatatagaacctatccttgggctgagccatatgtttctatttgtgtgtgtgtgtatgattattgtctttccaactagatgctaagattcttagaggcagggattgtttgctgtatatctttgtagcctgacactttgcctaatgtgcagattttaggtaacttataatttgtcaggactcgtggttgcaaattaaagaaacccaactcatataccaacttaagcaatgaagaaggtccagggatgaatctggctgaagattttgtcatgtctaaattaggtttccaaatttatcattaggaatctgtcctttatttattatctctgcattcctttgttttggctttgttttccagtggctgctgcctaaattgtgtcttttgggagtaaagggagagcttccttctcccaatagatgcagagaatgtcctggggctgatgttcattggcttccttgaactgtcttgccttatgtgcttaccccagactaatcaccattgtcagagggaagcaattgagtcattgcctgggccgcagttacatggtcatatattgagccagggagtgagaaaagttgctctctcactcccccagcatatgcactgagattggaggagtggtagttgcccaaaggaaaaacagggcttttgtgccagcacaatgggaaatggatcccagacaggaaaaaccaagacgtccactgaggagttcagaacctgtttgctgattgatgaattaatatctttgtaggaaaaaagtcaggtttgtagatattctataccatttttcaccttcatccaaaatattttacagttaggatagtgctgtgtatcctctaagtgcttcacagccactgttggaggtctgtgtgaaggggatgtgacttatgactttggctccctgctgatacatcaccagggttagaaggctgttactctctcaagggtggatcaataactgtgcttacctgtctgaacctttcaataggatctcagagttcttttgtggaagagtgaacagaacagcaatcaaatctctcattgtgggttgtgatggtgttggccaaatggtttcatggtaaaactaagcagcgttatcaaccaattaaatatttcccagttaccagttgtggaaatcttttggattctctcactgagagctgtgttgatttcaggacatgattataaaacatagaaatggtaagcttttgaggttaccattatttcaaacataaatggtcaatatatgtgcactaaattggctaacaggattttgactgcttattttgtacaaattattttgaagtacaaaaatttaattcatgtattaggcaacttgcctgagacccagccagtgaagatcttaatgaatagtacagacagtgaacaaagaattttaggaagattaatttccatggcaactgcatgctgggcaggtaaaaccaagatacccattaagaagttcagtacgtatttgctgattgatcaatttaatacccctgaaggacaaaagtcaggttcatgtagattctgtatcattttttcaccttcatttcaaacactttatggttagactacataatgatatgtttgaataaaagcacacataatctttcatcatttggattttgtttagcatttgagtatgattttcttagctagttaagtttgtgtttttatgtgtgagaaaagagcaaatcaagcataaatagaatagtgcgtctttagaagtcaatgttctgaaacctctgagaaagcaaatatttattttaatgaaaaatacttattgaacactgcctaaattttatttttaatctttactttttaggactggaagataagcaagaatctgaagctggtgcctctccaagtattaatttgttcttacaaatgttttactcaacgtgaccctaacctctttggaattgctcaggtgtagaacaggtgaggtgctcattcatagcctcactccacttgccctgtcagctctgcatacacagattatgccctacttaagataccatgcctgttctctttgtcaacacattaaataaaggaagaaaaataattccattataacgttcccaatctaagcactacaatctgccttcagcttgcttagattctaggtgtgctttttttggcttaaaaaagtacaaaaaaaaattgaaaaat

SEQ ID NO: 1516 - DNA, 2057696 bp, Homo sapiens
gaggcgtgacctagttgacaggctctgaggtgctgctgtggcggcgtccgcggggctgaggcgggtgggagccggagccgagcgcgggctgagggaggagggcggcgactggagagcggcgagcggcgagcagcgcaggacgcagagcctctttcactttttccctgctgagtgccccctcccacccctcccactccacacacaccctgtttgcccgtgagcctggggaacttgcagcttaaagccagccacccccacggcaacatgtaccccagcaacaagaagaaaaaggtgtggagagaggagaaaggtaaccggcccgtcgagtcctgggggtgcgggcggtgggggttagggtgggggcgggggtcaggctgtgtgtgccgcggcgccctccgcccgagctcccgcctcgcgccctcccggccggtgccgcctccctccggtgtccgtgtgtacacacgcgcacactcgcgcgcactccggcgtgcacgcgccgcccctgggcacctgcagctcgcgcacgtgtgggcgcacgcccctctctgttgccctcggcaccccgtcaccttctcccgaggcggtgctgcgttcgcctcgcttgcggcggggacccccaggcggcagccccgggcgcggcacaagttcctctgcaccgcagctgggacttgggcactgccggcctgggtgtcccgcggacaggtgcccgtcggcgggcgctcaggctgcagctgccgctgtgcctccgcgctccgtgcaccctcatttctttccttctcgcccctgtccccccagcccccgaatggcaaagcgtacccaccatcgggtgtttaccccttgtctaggtttccttccttcgctgccgcagcgtgacttttgaaacctggaactctaggggagccctaaaacgagcgtgttgtccgtgaggataagtgccttcagagaagtctgaatgggctgttctcccaacagtgtgtttctctgtattccatccccattcatgggctgaagttgctcagagtaagattttgtgactaatgtcactctgtatgaacccatctctgaattttgtgcgtataaggtttatctaaatcagctagattgacagtggcactgattctttaagaaacacaagtgtacgatccagcgtctcccaccaagatctcccgcttatcccatcacagtttggtaatattctaacttgagtgtctctggcgtttttcaccctccttttcacacctctttccttttcattctttagctatttacagaaatgtagcaaaaacttcttgcactcctattgctaaaataaactaaaacctgtatagcaagggtgaggtctattgagggtagtgcgcatttctcctggtacctcatctttacaaaaggatataggggtgactaggtatcaagttgatttccttgttaatagttcgttaaaacctgtagatttttattgcaagtcccggcctttatgaacacgaaggcaaaacagtggaggtaagaaagggaattaatgtggaaaaagaatccactatataggatcggcttccacaatgcacgaacaaaggcgtgaggagggaattttttttttcaaatttactgcaggaagatttaataatagaaccgaacaacacaattaaaatgatctttaaaaatgttgaaagtttagtcatttaattatgttttaataattatgggtttatagagagctaacacttctggtgttataaatcaaatgctgtcgagagtaatagcctgatagataaagtagtgtaaaataattttgctttgtttttttcagtagtagttactttagtttcaacacactttcaacaaggatttgccttgtgagcactgaaaaatcatttatgcccatgtttattgatgatgctgaaatgttcgctttgtataattgatgataatgagggcaaaacagtggaagacatagacattgttttcagtaacatgaatcattgatgaaattatagtgagtacttaagaactatttttctgtcataatagaaaaacagtgttcctcaagtaataacgttataatgtttccttcatttaacatctacacagttggactgtgaccagcaggcattttagaatcttttttaatgtcttgatttcttttcttctaataatggagaatatataaccaattttttttcctaaggaagcaaatgcaccattaaataaggcaattaacaagtaattatccaaaactaagttatttttgcatgaagtttaatgttaaaggaaaacgttactgcgatacgaagactttaatgcatatctcagtgtttctttttttcaggatgtctatgtttggaatatttaaatataaaatatatattatacccccaaggaagagctaaggatttctagtaccatagttagtattagagaagctgatgggatgcatgacctttttcctttcagcccactgggaagctgatggtatagtatttttgcagctgtcctttaaagctaaaggaaggcttacctacctcattgaaatgtcaaggcattctataaacatatttttaactcagtataccatttaataaataggtctgcctacttaattgcttggttcacagagaaaggactcattgtaaaggtgaagcattctttaaataaaagttttatgaaatgacaaagaaaatgcatatatatttgtggcctccagtatgtttcattgtttaaacaagtaattaaggagttctgaagaccacatatgtttaaataaacatgtttgatctagtattttgagtcctaattcagaaccactaatgtgcattttcaagtattgcaacttatttcattgttttgttttaaattgatctcgtttttaagtgttcacacttcaacttttaaataactggaacaacagaggccaggttgcatttctgtatgtaccttttgacattcacaaaaactgtcagttgcttcataatgtcttttaacctgctcagtaatattgtaataattttttatttgtgatctgagcttttttagcactgctttggcatactgctaatcatctcccttttctgcctttatgtgataattctaaatttaccattcccttcaagtttcctgttctctcaagaccctatcccccatactaaagagatgacattgcctttttaattcacagagaagggctaggcgcggtggctcacacctgtaatcccagcactttgggaggctgaggcgggtggatcatgaggtcaggagattgagaccatcctggggaacacggtgaaaccccgtctttactaaaaatacaaaaaattagccggtcgtggtggcacacgcctgtaatcccagctactcgggaggctgaggcaggagaaacgcttgaatccaggtgggagaggttggagtgagctaagatcgcgccactgcactacagcctgaatgacagagcaagactccgtctcaaaaaaaaaaaaaaaaaaattcacagagaaaataaatgccatgtaatatgaacagccctaacatcctcttgcatagtctcattggtctgttcctttacatgtccttttgactttgttctatcttagaggaaggacttttcttccttgtgtgtaagatgaatctttctgctgtgctctttatcccatatcttctttgagttcttgcaccatcatgtattctttcttgggtatgtttaatttcttggtgtcttcaggttcctctccattgcctgtaacagtgctcggatctcttccaccttagagtcacttttctttcatagggcttcacgtgaacttggagttgctgttctcactttccttcttttgctcagtccttcattgtcttctggatttccgttatattctaatgaaactaatgttcctgaagtcattcagtagtaacagtcatgatagtattcatgtaagaatagttaatatttaagccccatttgtatgctcagtactattcttagtagcttacatggattatctcatttaattctcacaacaaccctatgaggtaggaaactatatgaggcgaaatattgtgaggttaagagctttgaataccagttgcctgggtttgagtcctacttatactgcttaactagctgtggtactttaggtaagttatttgacgttgtttatagtttccttatctataagttgggaataatacctgcctacttacctcgaagggaaactgaaacataaagaggttaagtaacctacagatttgcaccatttagattacaactcaaacagctctgttaaccacttttcctctttattccatgctgttggtaaccacattgataaaagcaggttaatggctaagtaattttcactttttctgaccttcctgtagcagtctgtggtatttcccttagtgcacctgtagtcccagctactcaggaggctgaggcaggagaatcgcttgaacccaggaggcggaggttgcagtgagctgatatcgcgctactgcactccagcctggtgacagagcaagactctgtctcaagaaaaaaacaactctgttttctgaatgtttccttgtaccaggaacttgcacccatggtgacaactacgatttatttcattgttttcctatttgtgcccacttcctaaatactgtgttttgaggtttgatgcttccttccgttccctcttctttttcctttaggactagaattttaggttatattttctaaagtctctaggctagaccactctttaaatttccagattcttgatttcaacttcttcaatgtcctataggtaccttaaactcaatttttgtgaatatgtcacctctgattaagataccttttttttttgtctcctaatgtggctgaagttctagttataggagtgggaaaaatattggttccccattttctgttcacttgtgcttacattaatacttctgtagtttatttctgtgaaatagtcttttaaagtggttattttttgaaggttagattaccttaaactagatactaactatccctgcatccatttatctaaactgcagtaccttgtgatacactgaaagagaattgcagagtatgagaaataactgtctctctctctcactctctacatcgtggagaccattggtatggtatgggagacatgaaagctgacatacagagtgaagaagccagtgtcagtttatacattgaatattggtaaatatttcttccttgtttaggtgaaaaacgaatgtaaatagaattatttgcatgttttcctgtgtcctagtgggttgttttatacaccctctgggaaatgcataatcaactttcaatattagtagtctataggataaaggttaaactgctcactatggcatacaagtccctgtacagttttgttttacttttgtttccggctacttttcacttctgtggccattcctcttctcataccatatcttgcagcttcatttagttatagtattcatacctcctttgtttacattgttttgttagtctgaaatgttctttttacctcttcatgcaaaattcttcctgtcctttgtgaagcagcatacatattacctttttcggggagttttcctgagaatgtagtgtagtacagtggaataaataacatagggtgtagtctttgattaatggagatgtttgtctgaattttaattttggctcacttcctgaaacctctcttgctttgggcaaactactttgctgtgcttcatttccctatctgcaaaattggcataataatactatcaattttatgagttattaggaagattattttaatgagatatacatgtgaagtacctggccatagtgagttctttataaatgacatccactctaattctaagatgcaatttgtaaaatattttcattttatcgtcaagatatatatatttaaagcaattcttatatcatctacacaaagctgtaagtaaattgatagtgcagttgaggaaatatcttggtggttgcctttttttgtgctcttactatttgtacatacctgtcttagcattttatttatatagatactattttgtatcttactgtgttagactgttcttgcagttgctgtaaagaaatgcctaagactgagtaatttattaaaaaaaagacgtttaatagactcatggttctgcaggcaacacaaggatagcattggcatctgttaggtcttctgggaggcctcagggagcttttacttacagggcaagatgaagcggagggagcttttacttacggggcaagatgaagtaggagcaggcacttcacgtggcaagaacagtagcacgagagggttggggggaagtgccacacactttcaaacaaccagatctcacgaaaactcactatcttgaggctagcaccaggccatgagggatctgctcccatgacccaattacctcccactagacaccatgtcacacattggggattacatttcaacataagatttcaggggatatatatccaaaccatatcacttatccagcatatcacctggcccatagtaaactgtagatgttgcttgaaagtgtaaatgagtttacttatttcttggactatcataagagagtcttcatcaggctttgatttttttctcccctggtaatatgaaatttaacattttttaacatttaaatatggagtcactggatttgcattgtgttcttcaggactgtatcaactcttttgttagcttaacttggttaatacttaaagtataaaaataattcccatgtttaaacgttaaatacaaatggagattctgcttttattttgcaagaacgtttattgaagatgaccttagaagagagacgcaaagaatacctaagagactatattcccctgaacagcattctatcatggaaggaggagatgaagggcaagggccaaaatgatggtaagtttctcggaacattttttaggtagatatttttcccattttaggacaattgttgacagaaatgaataactggcgttcaataaagagattactattttgctatttgaaattattgtttggttgtgatttaattgtttttagtaacctacggtgttttttaaacttaggaaagtatattaacataatttgtgttctgaaatataccacatttataatatggtactttttttacaggtccttttttattttttctattctgtaacagttcttggagcaaatgctattagagatttgctgctttggtggtgtggccctttgagtttgctttaagttcatttataatcgattatcttatgttatttttaggattggggatacagctgaaagagagagtatattaggaaaaatagaaaaaccaaagaacatttctcattattttagagaatatattttgtatgatgtgttattatgtctgtatgtaaagtatttgtatgacagaatttactctcaaagtctttatgatttggtgggaatctagattatgttagaatataaaggaagttttaaggattaaaaaggtacgtgaaaaagtttctaaaaacaacataatagatttaatggatgtttaatatgcttgtctttgaattaacactcgttggtattaatgatctggatgtgaagtttagacaaacggtgcttcttaaggtgcttaacagttgagaaagactttatgaaatggacttgaaacatgctaatttcaaaggttgtggtcttagatcgatggaactacaccgggtactatgggcccagaataaagactagcatggaattcctatggataaaatctgaagggaaagattaggccttggtgtctgtgaagagaacacattgacctgaggatttgggttttagacacaactttgtttttctagaaaggcaaagcatgtgggattagcagtgaaaagctgtgggttcttttagaccttacgtagcctggaaacgtgtgaccttgggcaagcggggtagcagctctaccccacgttctaatggggtcattggacaagctgattgggatgtgcacatctgacctgtctgcccagtgtcttctgtaaatgcaagttgttttaagaatggtctgattccaaactgataagattggccttaagaagcccctgcctgatcacgtgagcatcatggaacccaaagatgatttgctgcccaccaccccgtctcagaacagaagggtgggaagccagagccacctgcattgccctagccagtccccacagtgtaacagggtctccttggcagctgtattctggagtctggttgttgctctgtaaagacctttaataaaatcttgtacaaaggttaaaaaaaaaaaaggtctggttaagacatcattgaaagagaggagagtgctgtgtaatgaaaagaatacagggctagaaatcaggagaacagaattctggtcctctgtcttacctaaggctatgtgcctcttcatgtttgagtctcagtaatttctttttttgtttataagcaactggtattgaatatttcagcagcagcactatcttcttcttttttttaaatggctacaggtcgagtatcccttatccaaaatgcacaggaccagaagtgtttggggttttggattgtttggattatacttgctggttcagcattcctaatccaaaatccaaaatgttccagtgagcatttcctttgagcattatgttggtgctcaaaaagtttcagattttggagcatttgggattttgaatttttgcattaggactactcaacctgtagtaaatgttccccaaattagaaaagaatacattgaatagaataacacctaacatagttatcctctaacaagatattgcatgtttaatcctgcctcccaatatgagctttataagtggttacaactgctctgtgtgtttcttattttcccccttatgctgttttaaacttgaaagtcctccatggggaacaaggtgatgtgatcaaaattatatttctatttttcctgaaatgttacttgcttctctctgttgtgacccagactctggtgaatggcctcttcctttttcatgaagtggaatggctcattttacaagtaatatttgtaaatatttatatacaatacacatttttcatatgactttttcttgtgttacctattcagtgctcagttattaaaaaatattagtcaagagagttttagtgttttaacagtttaaaaatcctttaaaaatataaatttacaaaaaataataaaggaaaactatacatatggttatatttgaaacgttttaagtcattgcttatacatgtataagtaggtattgatatttattaaatatgggattttaaactaagtattaaaagaattctataattccttgtcacttagtttctaattataggaaatgaacaatatttatcgggttagaacagtatatcagttttaaatttaatatcttatcattacttacgtttttatagaggaccatttttgcctaaatattcctgagtacttgaatagttcttgagctattgcttttaatttttttcttgctttgttcagatttattttactttaaccaaatgcttcttgttattataatacaatagaaagttaaataaaaaagaggggagcagccaaatatatttgtaacaatttggattttaagccttcttgaaacaaaaggaaacaaaatattgccaaggaacacaaaatcagtgtttatatggaaagggggaagcaagttttattttgacttacccctttggtaatattggaaagccatggattggaagaggaaagaatgggagatgattaccaaaaaataaaaataaaaaaacccaaaaaacaaaaaccccatccagaaaaacccattaaatacataatttgcttgctgtttatgttcatatttattaactgttgttagctaatttctagacttacatatttctaattcttcctctgtgttaccaattatgtaataattcaatatcatttgtcagttgctatgttgtggggattttaaaattcttgtctctcctattgtactgtctctagcacctggaatggtgccttatgggttggtggggcttaatcgtaagttaaataagaatgcctgaagagttaataatctacaagggacaattctttctccaaacttttttttttttttgagactgagtctcacttactttgtgccccgggctggagtgcagtggcgcgatgtgggctcactacaacctccacctcctggcttcaagcaattctcctgctgagctcctgagtagctgggattatagatgcgtgccaccacgcctgactaatttttgtattttttgtggagatgggctttcactgtgttggccaggctggtcttgaactcctgacctcaagtgatctgcccatgttggcctcctaaggtgctgggattacagacgtgagccactgcacctgcctctttttccaaacttttaatgagcatttataaatatatgtaaagctagaatacagtcatgtgccacaaaatgatgttttggtcattgacatcctgcatatatgatggtggtcccataagattataatactgtatttttactatgccttttctgtgtttacgtaggtttaaatacacaatgacttaccattgtgttatagttgcctacagtattctgtacagtaacatgctgtatgggttttagcctaggagcaattggctgtaccatataatctaggtgtgtatagactgtgtaccatctagatttttgtagtataccttacaatgtttgcacagcaatgaaatcacctaacaacgcctttctcagaacgtattccattgttaagcaatgcctgactgtagcaatgcatccattacccagtttcaacagttattacacggccaattttatttcatctataccagtgctccctataccttccccccagactattttgaatgaaatcacatatgtcatataaattttatctataaatgagtatctgtgtatatgcatatgtatgtatctctaaaagatggcatatttttgttgttttactaaaatactattattacctctcacatttaaaatttaacttaaaatttaattttgatataattaaatatccacttagtattcatgtttttcccattgtctcataaaggattttttcttttacaattgatttgcttgaatcaagatctaatcaaggtccatatattgcatttaattgatttgttccttaagtcacttttaatctatagttacctttctctgtccttttttccttcctcccttataatttatttgttgaatacactaggctgtcctgcagaattttttatattttgaattttgcttactgcatctctgtggtatcattgaacatgttcctctgtcccctttatttcttatgagttggtagttaaatccagaggtttgttcagagtggggtttaaatttttttgaaataatgctttatagattattgtacatctttttgcatcatatcacagggcacataatgcgtcattgtctccctcagtagtgataagattgatccctgggttcatgtattgtcagctgaatattgtcactaaactgtctggtgtaaagttctctgacaaccttttacctaatggttttagcagccattcgtgattattgcttagatccattacgttattaggggttgcaaaatagtggtatgtgaattttatcattccttatttatttgtcagacttctataaagaggaactttctgttattaagtcttttattatgcagtacggtttataaaggaaagcagaataaatgccatatttcccttatttactgattttcagattgagttcattccctaaaatcctccacaggtgaccaaagagtcctttttttaaaatttttgactatcattttcaatttgccccttccttctctcctcttctctgtctcttcctccctcttcctccctctcaacatgtatattaaatgagaatgtcccagtggttaacagtctacaaaggaggcatatacgtgtgtgtttgtgcatgcgcgtgcatgtatttatagctcccatataaaatacatagaattactaaacaataggcccaggatatggtagaaagacaaaggtagatatataaatgggtggatgggtagatatgatagaaagatggcattacttctttgttgagacaagagttctagttcttgggtttaatagttatgccttctgttaatctcctttcctactactgtgttaaggctccactagaataccacctagagaagcaatgttattgttacactttttggatggagtagtgttggcagagactctgccaggcttatgctaattttctctgactggttagtatcagggaaagcagctatggctataagtttagattgtctttttgagtaattacttttaatgtttatacagaacagcaataggggaaaaataaaataataatgaggatgagttaggtgaaaattataaaattatcttatactcaagtataaaatatttttaaaaattggtcatttaaagagccatctatgataataccatactgaatgggcaaaagctggaagcattccccttgaaaacgaacacaagacaaagatggcctctctcaccactcctattcaagatagtgttgggagttctgggcagggtaatcaggcaagagaatgaggtaaagcgtattcagctagaaagagaggaagtcaaactatttttgtttgtagatgacatgatcctacacgtagaaaaccccatcatctcagcccagtagcttttcaagctgataagcaacttcagcaaagtctcaggatacaaaataaatgcatacaaatctctagcattgctatacaccaaaaacaggcaggccgggaggcaagtcacaaatgagctctcattcacagttgccacaaaaagaataaaatacttaggaatgtggctaacaagggaagtgaaggatctcttcaaggagacctacaaaccactgctcaaggaaatcagagaggacacaaacagagaaacgttccgtgctcatagataggaagaatcaatattacaaaaatggtcatactgcccaaagcagggtatagattcagtactattcctattaaactactatcaacattcttcacagaattagaaaaaactactttaaaattcatatggaaccaaaaaagagcccaaatagccaagacagtcctaagcaaaaagaacaaagctagaggcatcacgctacctgacttcaaactatactacaaggccaaagtaaccaaaatggcatgggactggtacaagaacagacatagaccagtggaacagaatagaaaacccagaaataagtctgcacacctacaaccatgtgatctccgacaaacctggagatcacaaacaagcaatggagaaaggattctctatttaataaatggtgctgggaaaactgcctagtcatatgcagaaaattgaaactggaccccttccttacaccttatacacagattaactcaagatggattaaagattttaatgtaaaaccccaaactaaaaatcctggaagacaacatacgcagtaccattcaggatctaggcatgggcaaagatttcatgtgaagatgccaaaaacaattgcaacaaaagcaaaaattgacaaatgggatttaattacactagagtttctgcacagccaaagaaactctcagcatgaacagagaacctacagaatgggagaaaatttttataatctatccatctgacaaaggtcttatatccagcatctataaggaacttaaatttacaagaaaaaaccaaacaaccccattaaaaatagacaaaggacatgaacaggcacttctcaaaagaagacatacatgtggccaacaaacatatgacaaaaagctcaacattactcatcactaatgagtaatgatgcaaatgcaaatcaaaaccacaatgtgataccaactcacaccagtctgaatggctatcattaaaaagtcaaagaacaacagatgctggcgaggttatagaggaacactgatacactgttggtgggaatgtaaattagctcaaccattgtggaagacagtatgacaatgccttaaagacatagaggtaaaaataccgtttgacccagcaatcctattactgggtgtatacacccaaatgaatataaatcattctattataaagataataaaagaaggcgtatgttcattacagcactgttcacaatggcaaagacatagactcaacctaaatgcccaccaatgatagactggataaagaaaatgtggtacatatacaccatgcaatactatgcagccataaaaaggaacaacatcatgtcctttgcagggacccggatggagctggaagccattatgctcgacaaactctaacgcagtaacagaaaaccaaataccacatgttctcacttttatgtgggagcagaatgatgagaacacatggacacattgtggggagtaacacacactgggcctgtcagaaggtaaggatgggaggagtgagagcatcaggaagaatagctaatggatgctgggctcaatacttaggtgatgggttgatctgtgtagctggccactacggcacacgtttatttgtctaacaaagctgtgtgtcttgcacatgcacccctgaacttaaatgaaagttggaaattaaaaaaaaatttggtcatttagaaagactttatatttcatatttttatacatgtttatctgtattacatactataataaaggaagctagagaaaaagtgctattaagatcataagagaaaatctacttactgtttattaagtggaagtgggtcatcacaaaagtcttcatcttcattgtcttaacattgaataggcttaggaggatggggggctggttggtcctgctgtctcaggggtggcaaaggcagaaaaggtagagggaaggtagagggggaggcaggcatgcgtgatgcagcttcacagaaatacattgtaatttctgtctgacttttttgccttttcatttctctaaaaatgtatggtaccaatgctttaatcttttttccagtgcttagtttcagtgcctatgtcatagaaggttctatgtcataaatcaaaaacagtcttgaataataggaacccttctgccagattgtctaatgtcagtttgttttctggcactgcatctggtatgtcttctttctcattgtctggcactggtttggaagcactcatctccatcaagttttcttctgttaattcctctggtgacctggtgtttgttagctcttgaatttctccaggatctgcatcttgaaacccttcaccccctaccctttttgccatattcccagtctctttcatgatttccttgattgactgtgtcataaattctgtgaagccatgtgcaacatctggacaaagttttctccagcatgaatattgttttgggcttgatggttttcatggctttttctataacagcagtggaattttcagtggtgtaattcttccaaactttcatgatgttctatcagggttctctttcatagcattcacagtcttttccatagaatactgtgtgtagtgctgcttaaaggtccttatgaccccctgatatagaagctgaattatagatactgtgtttgggggcaagtagaccactttgatatttgtggtgttgaactcatggggttctgggtggccaggggcattgtacaacctcaaaataactttaaaaggcagtcccttactggcaaggtgcttcctgataggagcacagcgtctcattatctaggcctttcttgtacaaccaaaagactggcagctggtgtttatctttttccttcaaggtttggaggttagcagccttataaatgagggcaactttgatcataaacctgactgtatttgcgtaaaacagcctgtcccttcctgttttaaatcctggtgcttgcatctcttccttaataatgaatgtcttttgtggcatttcccccccttcagaatagagcacttttgtctgcgttaaaaagcctgttcaagtagatattctttctcttcgatttttttttttttgtaagacggagtcttgcttctgtcacccaggctggagtgcagtggcccgatctcggctcactgcaagctctgcctcccgggttcatgccattctcctgcctcagcctcccgactagctgggactccaggcgcccgccaccacacctggctaagtttttgtattttttagtagagacagggtttcaccgtgttagccaggatggtcttgatctcctgacctcgtgatctgcctacctcggcctcccaaagtgctgagattacaggcctgagccaccgcgcctggcctcccctatgattttcttaatggcatctgggaatttgccttctgcctcttggtcaacagtagctttttctactattattgcgacttttctttttttttaaaggcagagtctcgctctgtcgcccaggctggggtacagtggcatgatcttagctcactgcaaccttcgcctcccaagttcaagtgattcttgtacctcagctacccagttagctggggttataggcatgtacccccgcccagctaaattttgtatttttagtagagatggggtttcgccacgttggccaggctggtctggaactcctggcctcaagtgatccaccctcctctgcgtcccaaagtgctgggattacaggtgtgagccaccgtactcagggtgtgacatattttaagacagacttctttataacacatatcaaaccatcctttgctggcattaaattcttcagctttagatcctcatcttccttaatgctttaagttgtcatataatgactttgctttttctcaggtcctattagtctataggtatgctcattcttctagcaatcctgcactcacataaaagctgcatttttagtatgagattatcagtatgagattaaaagatattatgcaaaaactgcaaggttttcggacctgcgggcatagctgtagtgatgcaaattttctttcctttttttaataatgactcttaggctggattcatgtatcttaaatggtgagggattgcagctgcagacctaaatatcaagcacttcagctttttcttttaacgtcatgacttttctctgcttcttgggagtacttccagcattattaatggcactttgtgtgggtctgtgatgttattcaggtttatggtattgcactaaacatgataaaaaatatgtgacaactgcaagagatccacttttttactgtgatatgcaatttattggagagacagactgtttacgcagaggtgttcagcctcacacagcattttaagtggatacttgaaatacttgaggtcaccgcaatagcaatagaaggtggctaagaaatattacagtagtacagtatgtactgtggttaattttgtgcagttgtgatttagtactgcctctttacctttgtttacctttctcttgactgaatggcgccatgtatgatctataagtgtgtgcataagttttgataaattttcatttttgtaatagatttgggtatattttatggtagtaaatgatgaaatagactagtgtctacatgtattttaagcattcatgacatactttttcttaattttcatatttctagactatgtggtttgtctgccagtttttttttcaaattgttgcaagtctctaaaaaatgttccaatatatttattgaaagaatcaatgtataagtggacctgtgctgttcaaacctgtgttgttcaagggtcaactgtactttctttttttttttttttttgagacgaagtctctctctgtcgcccaggctggagtgcagtggtgccatcttggctcactgcaagctccgcctcccaggttcatgccatactcctgcctcagcctcccgagtagctaggactacaggtgcccgccaccatgcccggctaattttttgtatttttagtagagacggggtttcaccgtgttagccaggatgatctctatctcctgacctcgtgatctgcccacctcggcctcccaaagtgctgggattacaggcgttagccaccgtgcccagctggctcaactgtactttcctaagattattttgacaacacatcaatttcattgtgtattgcagtgtgtaccattaagtattatgtaaattgtccttatattaagctttttttttttttttttttttttgagacggagtttcgctcttgttgcccaggctggagtgccatggcacttgaccttgtctcactgcaacctccgcctcctgggttccagcagttctcctgcctcagcctcccgagtcgctggggttacaggcgcctgccatcacgcccagctaattttttatattttagtagagatgggtttcacgatgttggccaggctggtctcgacctcaggtgatccacctgcctcaggctcccaaggaagcttgtttttaaaaatattgtaaaaacaaaacccccaaatctttcattttttgatatatataaacatgactttgtgttgacacaagatggaaaattctttctttatatttcttaagtctgtaacttcatcacatagtctactagttttctttttaacatattaaatgaattatgttagtaaataaggattttccttaaatacattttggtcagcgtgaacagatattttgacatgggttacagattggtggtagccagagacgacaacttttcctttcttgctcccccctcccccccacccccaataatttttgcataggagagagtcttcttaatgtcttctttcagatgtattcatttagtttatttttaagttgacagagaaattgtatttcataatgtttttgtcttttctgaaatatttagttactgaattttcatcaacgtgtttaaaacaagaatttaagtatagcttattgatttatctaagcctttgatttggaaccaggttgaggattgccgatgaaataagtaagaaaatatcgtgccagggcaatgaaaacctatgaagatttttgagcaggagagctacagaaacttcaatacgatgagaataaattggcaacagttcatacaataatttagagggtatgcagtttccaccccttaatatcgtttttgcttctccagagttaattcacttgccattttttcctcctgcagatatatctgttcttctttcatagcttttctgtgttcacttatcataccagttcctcatttaattttctctgtttccttcaataaccgaatacatctgttctttcttgattaatctttacttgcttttctttctgtttttttgttttgttttgtttttttagatagggtcttgctgttgcccaggctggagtgcaatggtgcaatcatggctcactggaaccttgacctcctgggctcaatcaattctcctacctcagcctcctgagtagttgggactacaggtgcacacaaccatgcccagcaaatttttttttttttttttttgtagaggtggggttttaccatgttgcacaggctagtctcgaactcctgggctcaagcaattggccattcaaagtgctggtattacaagtgtgagccactgtgcccagccccttttcttgagttctcttgtttcccaatctactcttgtaaatttaagctttttaattatggtaaaatatacataacatagaatttgccatttttactatttttaaatgttcagtttagtgacattgagtacattcacagtgctgtgcgacaatcaccagtatccattttcacaattttttcatattcccagatagaaactttgagctgggtacagtggcttgctcctgtaatcccagctactcaggaggctgaagcaggaggatagcttgaggctagaagtttgagaccagccttggcaacatagtgagacttcatctctaaaatgaacattcaaaaaaaactggtggtgtgcacttgttgtcccacctattcaggaggctgaagtaggaggattgcttgaacccaggagtttgaggctgcgatgagctgtgatttgcactactgtactccagcctgggcaacagagtagacctcctctcttaaaatgaaatgaaagaaactttgtaaactttgtacccattaaacaatatctacactatacagtcttccttctcacctgtcccctcttattcttgactgtctctataaatttgccagttgtagatacaatcatgtaagtggaatcataacatgtttatctttcatgtctagcttatttcacttagcataatgctttctggattcctccatgttgtagtatgtgtaagaattttattatttttaaggccgaatattattacactgtatgtgtatagcacattctgtttatccatttaactgttggatatttgggttgtttccacctttatcaactgtgaataatgctgctatgaatattggtttagaagtatctttttaagtccctgttttcaattattttgggtattaactaagagtggaattgctagatcacatggtaattctacttaactttttgaggagacacaaaacttttctgtagtggctatagtattttacattccaaccgccagtgctattcccaccaccaatgcacaggggttccagtttctccatgttcttggccattatttattttctgttttggttttggttgtttgtgcttttgatgagcatctttatagatgcttattggccatgtgtatttctttggagaagtatctattcaaatcctttgtccattgttgagttggatttccttgttgtaggaattcctttgtatgttctggatattaattccttatcagatatattatttgcaggtgttttctcacactttgtgggtcgtcttttcactctcttaatagtgtcctttgattgaaaagtttttaattttgatgaagtccagtttatctgttttttctctggttgattgcttttggtgtatattctagaagacattgttaaatccaatgtttcataaattttctcttgttttcttctaagggtctcattgatttagcttttgcttggtctttgatccattttgtattaagttttgtatatggtataaagatcctttttgcatgttgatacccagttttccagtatttgctgttgaaaagacttgtcttttcaagacatttgaatggtcttggcactcgtgttgaaaatcaatttgaaaaaaacattctattgatttgtaaatctcttgtaatccagaaccacattattttgattaatgtagctttgtagtaagttttgaaatcaggaagtgtgagtcttccaactttttctttttgaagattgcatagctgtttggtgtcccttgagattccaaatgaattttaggattttttttccccacaaaaaatactgttgggatgccgattatattgaatctgtagatcattttgggtagtgttgtcatcttcacaatatttagagttccaatccatgaacatgcgatgtctttctacttacttatgttttctttaacttcttttagcactgttttgtagttttcagtgaataatctttcacatccttggttaagtatattactaattattttattctttgtgatgctattgtaaattgaattgttttcttaattttcttatcaatgttcattgcaagtgtacagaaatgaaactgattttcatgtattgattttgtatcctgcagctttgatgtattcaagctaacaatttttcgggttttctgcatttacgatcatgtcatctgtgaacagagatagttttacatcttcctttctagtttgaatgtcttttatttctttttcttgcctgattactctggctaaaacttccaatattatgttggctagaataagtgaaagtggacatcattattttgtttctgatcttaaggaaaatgctttcagtctttcaccactgagtattgagtattgtgttacctgtggatttttcatatgtctccattatgttcaagttattcataggttattgagggtttttatcatgggagggtgttgaattttgtaaaatgcattttctatataagtttagatgatcatgtagttcacatccttcattcttcatgttggagtattacattgattatattgaaccatccttgtattctgggagtaaatcacacttggtcacgttgtgtattccttttaagatgctgctgaattcagtttgctagtattgaggatttttttcattgtgattcataaaggatattggtctggttttcttgtatctttttctgcctttgttatcagggtaatgctggctataaggatgaattaggaagtattctcttttctttaaatttctggaagagtttgagaggattggtgttaattcttccttagatgtttcagtagaattcatcagtcaagctatgtggtcttggactttttggttgttgttggaagcttttggttacttattcagtctccttactaattataggtctattgaagttttctatttctttgtcagtttgggtagattgtgtgcttctgtgaatatattcattttatctaggtgatccaactttttggcatatcatttttcattgtattctcataattatttctgtagaatcaatagtaatgtcctcactttaatttctgatcatagtaatttgtgtactctttcttattttcttaatcaatacagctaaaggtttgtcaatattgttgatctttttaaagaactaaaattttgttttgttgatttcctttattttttttttctgttttatttatcaccactcttatttttagtatttccttccttctggtagctttgggtttagtttgttcttaagttccttaggtgtaaagttacgctgttgaaatgagatcttcttatttaatgtatgcatttatagctctaaattttctcttagcactgttttcactgcatgctctaagttttgatatgttgtctctatctcaatgaattttctgattcctttccccatttttcaggagtatgttgcctaatttccacatatcttttagttttccttctgttattgatttttatctcttaagttatttcttctttcagctaaattctgcttttgaaccctcccatgaatttttcattttggttattctttttagctccagagtttctggttggttcttttctcttcgttggtctcattcagtttatacattgttttcctaattttcttctaaagatgattgttttaaagtcttctgttaatgtcactcatctcatctgggtcaccggaattgtcattgagcagtgggcttgctgcccagtgtgcatagaagcaaatattatggcaccagcctttgataaaagaaaaagctttattgcaaggttgactagcaaggagagaggaggcagtgctcgaatctgtctccttaagctagggtctggggacaggttttataggcagagtgactatgaggggagacaggaaaatacaatgaggcatgatctcattgggctgttcaggaggtagtgcagggaccttgacccttaaattaactctgcagcaaaacagggcactccttgcttcttaatttgctctgccctgggttcagttactgaggttctgtaactgaccagagggttcctgttgcctgctgcccagatagagcctatttatcaagacaagggaattgcaatagagacagagtgtaatacacgtagagctggctaaataggagactggagttttactattactcaaattagcctctccataaatttggagcgtagtgtttgtttgttttgagatggagttttgctctgttgcccaggttggagtgccgtggcgcaatcttggcttactgcaacctctgcctcctgggttcaagcgtttctcctgtctcagccttctgaggagctgggaccaggcacgtgccaccatgcccggctaattttttgtatattgttttagtagagatggggtttcactgtgttagccaagatggtcttgatctcctgactttgtgatccgcccacctcagcctcccaaagtgctgggattacagttgtgagccactgcgcctagctgggtagtgtttttttgaaagtagtttggtgggcagggagctagggaatgggtgctgctgattggttcgggatgaaatataggggtgtggaaaatggtcctcatgtgctgagtctgccacaggaccattgaatcatgagtcttggatctgggtggagccatcttgttgtgagaaatgcaaaagtctgaaaagacatttgcaatccgaaaaggccaatcttaggttctacaatagtgatgttacttataggagtaattggggaagttgcaaatcttgtatcctccgaataatggctggtaattgtttaactatacctacatcttagcagaattcatgcctctgtcatccttctaacctggtggatggccttttattagttttacaagtggtttaggtttggggaggctattatcatttaaactgtaaactaaatttctttcaaaattagctcgggccatgcctaggaatgaccaagggcagtttggaggttaaactagaggtaaatttggctcctggatacaccaatcaggcatgctggattaatctgcacatgctcaggctttgtgatttgcaatctgggatgtagattgcagtttgtgattacagaaagcccattgtcagccgggcgcggtggctcatgcctgtaatcccagcactttgggaggccgaggcaggcgtatcacctgaggttgggagttcaagaccagcctgaccaatacggagaaaccccgtccctactaaaaatacagaaattagccagtcgtggtggcacatgcctgtaatcccagctactcgagaggctgaggcaggggaatcacttgaacctgggaggtggtggctgcagtgagccgagatcgcacccttgcactccagcctgggcaacaagagtgaaactccatctcaaaaaaaataaaattaaatttaaaaagtccataagtccattgtctgggcttgtttgtcatcttaattgttcctttgaatgggccattgttttctcttttgttgaaaatcagacatttgactattatgtggtaactctgggaatcagatttctcccttcttctgggtttgttgtttttcgttttatttattgattgattgagtacttgttgaaggctgtagtagtccatttgtcctgagactttccaaacaatttttgcaaagactagtccttgttgtgtgtgattattgaattctgttcctttagtgtgtgttcagcttaagttacagagatttcctcaggagttctcccagtttttgcagttagctctgtgatgggttactctttcatctcttaagtaggcttcttttgaacatagggatcatcttcttaggtattttctgagcatgaatcttgcttggtcatgtacgtgactttctaaattcccctgtatacacaactgcttttgaatattcttttttttttttttttttttgagatggagtcttgctctgttgcccaggctggagtgcagtggcgccatctcggctcactgcaagctccgcctcccaggttcacaccattctcctgcctcagcctcccgagtagctgggactacaggcgcccaccaccatgcccagctaattttttgtatttttagtagagacgcggtttcaccgtgttagccaggatgctctcgatctcttgacctcgtgatccgcctaccttcgcctcccaaagtgctgggattacaggcgtgagccaccacgcccagagcttttgaatattcttatttcccaaagagcctcaccttatcttctctttagggccttacctagtcttttgtattgtcccaggggtctgtgagtctgtagcggccttggaactttaagagcagggcctgctgctctttttcacctgagttttgtgttaggctaaatagaaatgaaagtcttactcaggcctttaggtatcccccagaagggttagaactacaaagctacagaactttcctgctctttgactgttttccagcacttcaacaaagtttgttcaggcagtttctctttgttttttgatgtttctctgtggggaacaaaacctcagagcttcctatttcactattttccttgaacttaataatttataatgtgaaaagcaactgtgttaagtttggctagaactaggtgatataacaaaccctcaagttaagtggcttaacccaataaagtttatttctagtttacctgacagtccagagtgggtatacatgattagtatcagtgaagaggtggtagaggtataggagtgtttgtgtgttggggctgggggacattctgcttcacgtagtctttcagagacagagttgaatgtctttaacatgttgccctggagaaccttagggggaaggggaaagggaaggactgagttggaggctgttatgagctagacttggaagtacaatggtacacctgttttgacttacatgtcttgggctagatctcagtcatacggccatatttaattgaaagagaggctgagaaatgtaaagtagttatatgttataggaagaggatggaactggaaagtgattttggcgaatagctagtaatttaacccatatcaattgcacacagaacttcctcgagcttccatgttctgttgaagcagctgtaagatacacattttatattccattgaggaggaatgaaaagagaaagcattgccaattaaactattacacagtgctttcttagaataaagtattatttctttcaataaatgcaaatataaaactcagtaaatataaaaattattttacatttactcagttttatcatgtatcatctttgaacatacgttgaaagtataagtgaaataaattgattaaattattcctaaaatgtctttgtactcagagcccaattcttttttttttttttttaattatactttaagttctgggatacgtgtgcagaacatgcagttttgttacagaggtatacatgtgccatggtttgctgcacccatcaacccgtcatctacattaggtatttctcctaatgctatctttcccgtagccctcccccacccaccgacaggccctgatgtgtgatgttcccctccctgtgtccacgtgttctcatttttcaacttccacttatgagtgagaacatgtggtggttggttttctgttcctgtgttagtttgccgagattgatggtttccagcttcatccatgtcccggcaaaagagatgaactcattcttttttatggctgcatcatattccatactgtatatgtgccacattttctttatccactctgtcgttgatgggcatttgggttggttccaatattgtgactagtgctgcaataaacctatgtgtgcatgtgtctttatagtagaatgacttataatcctttggtatatacccagtaatgggattgctgggccaaatgatatttctggttctagatccttgaggaatcgccacactgtcttccacaatgtaaaagtcttcctatttctccatgtcctctccagcatctgttgtttcctgactttttaatgatcaccattctaactggcgtgagatagtatctcattgtggttttgatttgcatttctctagtgaccagtgatgatgagctttttttcatatgtatgttggctgcataaatgtcttctttggagaagtgtctgttcatatccttcgccctttttgatggggttgtttctttcttgtaaatttgtttaagttccttgtagattctggatattagccctttgtcagatggatagattgaaataattgtttcccattctgtaggttgtctgttcactctgatgatagttgcttttactgtgcagaagttctttagtttaattagatcccatctgtcaattttggcttttgttgccattgctttttatgttttagttatgaagcctttgcccatgcctatgtcctgaatggtattcttctaggttttattctagggtttttatggttttaggtcttacatttaagtctttaatctatcttgagttaatttctgtataaggtgtaaggaaggggtccagtttcagttttctgcatatggcttgccagttttcccaacactgtttattaaatagggaatcctttccccattgcttgtttagtcaggtttgtcaaagatcagatggctgtagatgtgtggcattatttctgagccctctgttctgtattattggtctatatatctgttttagcaccagtatcatgctgttttggttactgtagccttctagtatagtttgaagtcaggtagtatgatgcctccagctttgttctttttgcttaggattgtcttggctatgcgggctgttttttgattccatatgaaatttaaagtagttttttccaattctgtgaagaaagtcagtggtagcttgatggggatggtattgaatctataaattactttgggtagtatggccattttcacgatactgattcttcctatccatgagcgtggaatgtttttccatttgtttgtgtcctctcttatttccttgagcagtggtttgtagttttccctgaagaggtccttcacatcccttgtaagttgtattcctaggtattttattctctttgtagcagttgtgaatggaagttcactcatgatttggctattattggtgtataggaatgcttgtgatttttgcacattgattttgtattctgagactttgctgaagttgcttatcagctttaggaaatttgggggctgagatgatggggttttctaaatgtacaatcatgtcatctgcaaacagagacaatttgacttcctctcttcctatttgaataccctttatttctttcttttgcgtgattgccctggccagaactttcaatactatgttgaataggagtggtgagagagggcatccttgtcttgtgctggttttcaaaatgcttccagcttttgcccattcagtatgatattggctgtgggtttgtcataaatagctcttactattttgagatacattccatcagtacctagcttattgagagtttttagcatgaagtggtgttaaattttctgtatctattaagataatcatgtggtttttgttgttggttctgtttatgtgatggattatgtttattgatttgcatatgttgaaccagccttgcatcacagggatgaagctaacttgatcgtggtggataagctttttgatatgctgctgaattcggttcgccagtactttattgaggattatcacattgatgttcatcagggatattgcctgaaattttctttttttgttgtgtctctgccaggttttggtatcaggatgatgactgtcctcataaaatgagttagggagagtccctctttttctgttgtttggaatagtttctgaaggaatggtaccagctcctctttgtgactctggtagaattcaattgttaattgtctggtcctgggctttttttggttagtaggctattaattactgcctcagtttctgaacttgttatggtttattcagggatttgacttctttctggtttggtcttgggacagtgtatgtgtctaggaatttctccatttcttctagattttctagtttatttgcatagaggtgtttatagtattctgtgatagtagtttgtatttctgtgggatcactggtgatctcccctttatcatttttattgtctgtttgattcttctctcttttcttctttatttgtctgggtagcgttctatctattttgttagtcttcaaaacaccagctcctggattcattgatgttttgacgggtttttcgtgtctgtatctccttcagttctgctctgatcttagttatttctagtcttctgctagcttttgaatttgtttgctcttgcttctctagttctttgattttagatctttcccactttctcctgtgggcatttagtgctataaatttccctctaaacactgctttagctgtgtcccaggtattttggtatgttgtgtctttgttctcattggtttcaaagaagtcatttatttctgccttaattttgttatttacccagtagtcattcaggagcaggttgtttagtttccatgtagttgtgtggttttgagtgaatttcttaatcctgagtgttagtttgattgcactgtggtctgagagactgcttgttatgatttccattcttttgcatttgctgaggagtgttttactttcaattatgcggtcaattttagaataagtgggatgtggtgctgagaagaatgtatattccgtttatttggggtgtagagttctgtagatgtctattaggtccacttggtccagagctgagttcaagccctgaatatccttgttaattttatgtgttgttgatctgtctaatattgacagtggggtgttaaagtctcccactattactgtgtgggagtctaagtctctttataggtctctaagaacttgctttatgaatctgggtgcacctgtattgggttcatatatatttagcatagttagctcttcttgttgcattgatccctttaccattatgtaatgcccttctttgtcttttttgatctttgttggtttaaagtctgttttatcagagactaggattgcaacccctgttttatttttttgctttccatttgctcgttaaatcttcctccatccttttgagtctatgtgtgtctttgcatgtgagatgggtctcctgaatacagcacactgatgagtcttgactctttatccaatttgccagtctgtgtcttttaatcggggcatttagcctgtttacatttaaggttaatattgttatgtgtaaatttgatcctgtcattatgatggtagctggttattttgcctgttaattgatgcagttgcttcatagtgttgatggtctttacaatttggtatgtttttgcagtggttggtaccggtttttccttttccatatttagtgcttccttcaggagttcttgtaaggcaggcctgatggtgataaagtctctcagcatgtgcttgtctgtaaaggattttatttctccttcacttatgaagcttagtttggctggatatgaaattccaggttgaaaattcttttctttaagaacgttgaatattggcccccactctcttctggcttgtagggtttctgcagagagatctgctgttagtctgatgggcttccctttgtgggtaacctgacctttctctctggctccccttaacattttttcattcattacaaccttggtaaatctgacaattatgtgtcttgggacacataataagagcacctgggggaaggggcggctgtgagtgcagctttagcagaagtaaatattcctgcctgctgactctaaagacagcagtggatctcccagcacagcgctcacgctctgctaagggacagactgcctcctcaagtgggtccctgacccttgtgcctcctgactaggtgacacctcccagcaggggtcgacagacacctcatacaggagagtccttttccaagttgttccattctcccttcactttcaggtacaccaatcaaacgtaggtttggtcttttcacatagtcccatattttttggaggctttgttcattccttttcattctttttttctctcatcttgtcatcactctttatttcattaagttgatcttcaatctctgatatcctttcttccgcttgatcgattcggctattgatacttgtatatgcttcacgaagttctcgtgctgtgtttttcagctccatcaggtcatttctgtttttctctaaactggttattctagttagcaattcctctaaccttttttcaagtttcttagcttccttgcattgggttagagcatgcttctttagcttggaggagtttgttattacccaccttctgaagcctacttctgtcaatttgtcaaactcattctctgtcccattttgttcccttgctgacgaggagttgtgatccttgggaggagaagaggcattctggttttcggaattttcagcctttttgcattggtttttcctcatcttcgtgatgtggacgtcctttttgttgatgttgatgctgttcctttctgtttgttaattttccttctaacagtcaggccccactgctgcaggtcagctggagtttcttggaggtccactgcacacccggtttgcctgggtatcaccagcagaggctgcagaacagcaaagattgctgcctgttccttcctctggaagctttgtcccagaagggcacctgccagatgccagccggagctctcctgtatgaggtgtctgtcgaccccggctgggaggtgtcacctagtcaagaggtaaaagggtcagggacccacttgaggaggcagtctgtcccttagcagagtgtgagggctgtgctgggagatccgctgctctctttagagccagcaggcaggaatgtttacttctgctgaagctgcgctcacagccgccccttcccccaggtactctatcccagggagttgggagttttacctgtaagctcctgactggggctgatgcctttctttcagagatgccctgcccagagaggaggaatctagagaggcagtatggctacagcggctctgcggagctgcagtggactccgcctagtttgaagttcctggcgctttgtttacactgtaaggggaaagctgcctcctcaagcctcagtaatggcagctactctccctccccacccgcccaccaagcttgagcatcccaggtccacttcatactgctgtgctggcagcaagaattacaagccagtggatcttagcttgctggaccccgtgggggtgggatctgctgagctagaccacttggttccctggcttcagccccctttccaggggaatgaacagtacggtcttgctggcgttccaggcgccactggggtatgaaaaaaaactcctgcagctagctcggtgtctgcccaaacagccacccagttttgtgcttgaaacccagggccctggtggtgtaggcaaccaagggaatctgctggtctgcaggttgcgaagaccatgggaaaagcgtagtatccaggctggaatgcaccattcctcatggcacagtccctcatggcttcccttggctagggaagggagttctccgaccccttgtgctttctgggtgaggtgatgccccaccctgcttctgctcgccctccctctgtcaaccagtcccagtgagatgagccaggtacctcagttggaaatgcagaaatcaaccgtcattgatctcgctgggggctgcagaccggagctgttcctattcggctgtcttgctccagagcccaattcttctcaatcatttttttcttacccagagttgtctgtttttccacagagtatcttttctgtgcagttaggaaagttgatgatatagcatacttcatccactgtactttgatctgggattttcttcttaaccattgatactggtttctgtaagtgttaatgctggcactttcttcatgttaccggatgatgttaatgaaaggttttcagacagttgctagctcatattctttcttcaactgttcgttaaatggattgttgcctggaatgttgagaggttgcaattgtccagttatatcactggaaaaaacaactaagttcttatacaggcagagagaactgtcattgtcaccacctcttcagtagcaactataaatgtctttaattgtaagccatctgccaatttcagagaagttaacatgttaggggaaaaaacgcatcatagaattgaacatatatagtatgttgaatttgttttgaaattcaggtttttgtgtcttgtaatatttgaggctttcctccttcccccatcatgcctagcctagtcaaaatactttttattgaatttattaaaataattacagtttatcatgatccatagtttagaaaaagaaaggatatgggggcaagatgggtaacttcagtgactttaagggctgaaagcaacaatttggagcatcgtgtcaaagttgtgggaatctgattttagaacaatataagaaaaaatttaaaaaattttaattacttctgaatgaagtggactctgacagtgaatttgctgtcattgaaagtattcagagaggttctagatacaaatcacccagacacagtaaaagcaatttcttcactgggtggtaattgaagaatatgttgtttaatgtgtttttctgactattgatattcctattctaaaataatttacctttgtactaagtggccttctcttttcagatactcaacaatgtaatttatcgatactttctgttattgattggaacaccattgagtttctttcttaatgtaagacaggcaactaaatgcaaattactgttctgtttctaattaagtgatgaaatacactaagccaggtcattctttgaaacactgattgacacagtgggaggagggagctaagaaatagtactttttttccttgcagattttacttgcaaagtattgtaacctgattttccttcaggtcacctagattggagtacagtgatgcgatcttagctcactgcagcctccaactccagggcttaaaccatccttccactcctagctcagcctctggagtagctaggactacggaaacttgctaccacttgtggctatttttttattttttgtagagacaggatcttgctatgatgcccaggctggtctcaaatgcctaggctcaaaccatccatctgcttcagcctcccagtgtgctggggttataggcatgagttactgtgcccagcctatactcttctaatttttgattctttcagggtttagttggtgaaagagccattatgaattttattttttaatttaatttctttttttttgagatggagtcttgtggtgatgcccaggctgacgtgcagtggcgtgatttcggctagctgcaacctctgcctcccgggttcaagcgattctcctgacttagccccactgagtagctaggactacaggcacacaccaccatgaccagctaatttttgtatttttagcagagacagagttttccagtgttggccaggctggtctcgaactcctgacctcagaggatctgcctgccttggcctcccaaagtgctgggattacaggtatgagccagaattttatttttaatcaaaaaaaggttttaaggaaatggctcaccttccttccctccctccctccctccaaaggacttgtggtcagactctttggaattgccagtacttaatcagctgaatgaagaattttctgatctttctgtttagtagttcaaatggtcattaccaggattctttgtatacttttggggagcaaattaaatagatgaaagacagccaacttttaggatgagagataggcatagatatatcgttttcttatcttcttccacatactcaaatttagatatcaggttatccatgatttgctttttagttcaccagacatagtgaagttaacactcctaatttagttttggctatatataacttgctaacagctctagcctgggattttaaagacagcttaactatgttcatggaatgctatgactggctaaatatgactctttaatgtttcataaaacatgtctttttcctaaatagggttgtaacattctcttaaatatttcatgcatgtctttctctctctgtgagacagatctctctagatttctctggttttatttctgacatgctatatgaagtactttttatttaaaagtaagtacaatatgtagtatctcagtgtgcatatggcttggatgcttactttgacgatgaaaaattgcttaaatatgctgacatctgaattgtatctgtaaattaatgttagcaacttgagactcagtaattgtttcttaaaatggattctaattagttacaagtaaaaagtaactttcccttaaatgttggttgtattaattacaaatactttaaaaagatatattaaaatgataaatctaatttttttcctggacattgatttatgttgtgtgatgacataacagtactggaaatcagtagaggtgacactgctgtacatttgtagctatttatattttgttgtatttttataaaacaaagaaatacatcagatcatagtcattataaagcattaaaaagatatgaaaacatacagttaaaaaatgatagcttctccttccctaaacacccaattcctaatgaataaatactgttaaaaattaggtgattatcttcccacactttatgcatttttagtttatttaatgcaccattgtgtcagacattgttctaaggattaacaaatagaagagagtttatatgaagaggcaaaaacactatgaagtaaataataatattgggaattgaggcctagagaggttaactaattgtatggttaacctagacagtctggcattaagatctgtgctcttagtcatgttgcgtcttatgcttttacaaatatactattaatatatgtactcatatatagtattttgttagcttttagtgtaaaaatttattattgtacatggtgctttgaggcttgtttttttctcacttaaaactattttttgatgatctcattattttttaaatggctgtgtatgttttactataacttatttaaatttatttactataaattattttgtctttaatgaactattagtttttttccaaaattgcaagcaaggttgcagtgaatatgtttgttacccttgtgtgtatgtgtgaggattttttgtgagattcctacaaatgatgttgggtctgaggcagtgcatatttaacacttaagtaaaacttccaaatgacccttcaaaatggccgaaaaggtttatacccacatcagttttatatgagtacctgttttctcataactttgccaacaaaaggtacaaataatccctgaaatatttgccagtggggggtaaagactagtaacgccttgctgttactatttgcatttcttaacattttttatttcttagccatctgaattttttgggtcaattacctgttcataacctttgcccatttttttctattgcattgcctgtttttgtattttaactttgtaaatgttaacagtatttttaagtttgttgttgagcactatataagttggctgtggaaccactatagtgattgagaatgcagacttgcaccagacaggctaaattctagctctgccacttctttgggaatatgcctaatctttgtacatcagtttcttcattggtaaagtgggattagtggtggtacacctcaagagattattgtgaggattaaataaattattaattacaaacagcatataactttctgatctttagtaagtgctagcttttataattattattgctctaatgatttatgctatcttgttattagcacaattttcaatttttagtcacctgttttaaaaaactgtctttttactaaattaagactctcttcattctaatatttataagaagaaagtagagtttaaatttcttcagaagcttggtttttcttttttttttttttttaacttttggtatattttctatatggaatttctttttgtgtggtaggcggtaagttgtcttagtttttttccccccagatatctatctagttatcttcactgattaaaaattctgtgttagtcatgtattaaagttttcatgtatgtagaaatctttttctagattctttatttcattattccccttgcgatctgtttattaactcttgtgtcagtatgccactgttacagttacaatagtttctttatatattttgataattttggaaaaatcccctctcatccttctgttttagatttgtcatagctgttttgatacacttttccagactgattgtagattctattctattcatagaatattcatagcattctattcatagaatattcatagcattctattcatattctattaaaacatcctgttgggttttgaaagggctaatatctttacagtgttgagtgttcttatgcaaggatatatctttcccaaaaaattaatgaacgtgatacatgcacatggagaaagaatcaaacagtacagaagagcataaaatgaaatacaagtctttctttcaagctcacaccccaaatccataaccaccattagtattcatgtatggatgtgtatgtgcttcatggccttattcaatcaagcaccctagtcttgatttactgctatattccagaaaacctttcaatttatataaatgtgtgtgtagaatttacctttccttttatcacacagaatgatgctctagtattcttcactcttttgtatcttttacttttttccactttgtaatgtatcatggaaatcctttcataagaaattctattgatctacctcacctatttttattttatttatttatttatttatttatttgagatggagtctcgctctgtcgcccaggctggagtgcagtggcgctatcttggctcactgcaagctccgcctccagggttcacgccattctcctgcctcagcctcccgactagttgggactacaggcgcccgccaccacaccaggctaatttctttttgtatttttagtagagacggggtttcaccatgttagccaggatggctacgatctcctgaccttgtgatccgcccgcctcagcctcccaaagtgctgggattacaggcgtgagccaccgcgtccagcccctacttcacctatttttaaaggcttcattgtctgtcattgtatggaagtactgtggttttatttaatcaccccctattcataagcattttgattataataattttcattttgctagtgtaactaatacagtatgttcttagagatttatttttgtattcttgtgtttatgtctgtaagaataatttccagccatggaattgctagggtatgcaatttcaaattgacagacgtttttagtttccactttaaaaatgttgaaccaacgttatattcccacttttagtgtatgcaaatgcatatttctcagcaccaacactggattatatcaactgcattatttttgccagtatgaatgttttgctatttttaaaatcatgagtgagattaaacctgttttaacattcgtcagccgtttattataacaaataacatttattgagcacttacatgggctaggcactgttctaagtgggttgcatattcatttaatgaattgtttcctcacatcatttgctcatttaaaaaaatgttttttcttagtgaactaagagttcattgtacattaagaaaattacctttaatcatatgtattgcagattttttccattttacttattgtcttgatgtgtatgtatacattttatacacagttttacatttttatgtgcttagattatgttttatgatttttttcttcttggtcttaatcggttttggttaagcttattgcttaaccatgaatatgatcatttttaccatataatttcctaattggttattgctcagttataggtaagtgttgattttcaaatactggtgttgaactctgttattcatcagtcttttaaggcatactcttggactttataggtagatgataaaagcttctgcaagtatttttatagctttgtacttgctatttctctttcttttcctttgcattagctaaggtcaccagtacagtgttaaacaatagtgctcatagcaggcattcttgccttgactttaatgcattttgttattcagtgagatttattcatgtattaattaatatgatagtaattttactgtttaggagcacttattttcagggaaagtagcctactaattagacattaacaagaaggtaaagatacctaacttttatatcagtatgtggtcttgtgcaaacagtgtattctcaactctcccatttatatagtgaggataattattaatctgtaatgtaaaattcctgtaaatgactaagcaatatgtaaaatatcagagcccacatattaaagtatcatcatatgacaggttgccatttgttgagttattttcaagtgcttacggatattttacactggggcatgacttctgagttcgtggaaaattttttgttctgaatttttcagaatggctgatctgaataataacgtatatggttcatcagcataatatgagtaaagcctattcaaacctttacatttctttcctgtcggttcccaaaattattcagagaaatggaggggtaaagtagtatagataaacaaaattgttcatcaccagcccatgtttgaaatataccattaagatagacagcggctgggcgcggtggctgacgcctgtaatcccaacactttgggaggccaaggcgggcggatcacgaggtcaggagattgagaccatcctggctaacatggtgaaaccccgtctctactaaaaatacaaaaaattagccaggcgtggtggcgggtgcctgtagtcccagctagtctggaggctgaggcaggagaatggcgtgaatccaggaggtggagcttgcagtgagcctagatggcgccactgcactccagcctgggtgacagagcgagactccgtctcaaaaaaaaaaaaaagctagcagacagcagttattcaataatgaataagacacgatttctgcctttttgaattgtatatgaggttaagtagcctttacttgtcttcccaagtgagatttactgaaactaacattttagtagtctcccattcctagcacaatgcctggaatctgttgggttctcagtacatttttgcttagtgtacttgaacttcagtgtttatgaaacatagattcctgcatattctggttcagtaggtattaattaggacccaggagtctgcactgttaacaagcacctcagggtgttttccggtggtttctcttaataaatacaaagaaaattttctgaagagagatgttatattcatctcatagaaaatcaattttgggtgggaggaagtttcactgtaatcttcatgccttatacaaaggtaactttgccttttacttcagacttcagcttttcatttaagaggaatctgtatatttagcacagtcgtgggttgttggtatccacttagtaaatatctattgattaccttatttttccctgctctgtcatccaggctagagtgccctgccgcaatcttggctcactgccacctctgcctcccaggctcaagcgattctcccacctcagcctcccgagtagctgggaccactggtgtgcaccaccacgcctagccacttttgtgttttttgtagagacggggttttgccatgtttcccagaccatgttgattattcagcattgattacttgcagtaattatggaattagtttttaatttactaatccagcgttttgtggtaaagttacaattttaaatgtagtttaaaaataaaacgtttttaaactggtctctgtttttcctccttgggaccttgtcatagcttaggtggagcttgaaataatgaagcgtgtcagatgtggcataacatggttttttaatgaccaaaatgtaacttttattttaaagggtattatatacctggttatattgaaaggtagccttgagatgtataagagccttctttgtattgttacacactcttccaaaatatggacaaatcataaatgatgaaaacatgattgcaattttgtagaatttactagttttggcatcattaatttggccaaaatacatgtaataatgggaatttaatgcattataggtttctataaaaattctacaattatagaaatatttttacagtgtcctattcagtaattaataaagccttctttcatgcaattataaatgaataccaatgtcctattcagtaattagtaaaggcttctttcatgcagttataaacagataccaatattttgtattggtggacgtgaaaatatttatttggtaatcttagtaagggatgcatattttttgattgaagactatgcatttacccagctcaaaggaatggatattttatttttgaatttaactcagtgatgtcgctaatctatgtgaacacgccaactgtgtgtgtgttggtggggggggtagttagtaaccatggagctaaggattgatgaaggttggtgataaagggaaacattcccttggaattaagacattgttccttgctgggtgcagtggctcatgcctgttactccagcaccttgggaggaggctgaggcgggtggatggtttgagcccagaatttccacaccagcctgtgcaatgtggtctctacaaaaaaaaaccccaagaaaattagcccagcatggtggtgcgagcctgtagcctcggctactcaggaggttgaggtgggcggattgaggccagaagcgggaggcagcagtgagcttgtgagggtacgggggcgagataactgtctcaattaaaaaacaaacaaacaaaaaccaggcgcagtggctcacgcctattatcccagcactttgggaggccgaggcagtggatcacttcacgtcaggagtttgagaccagcctggccaatatggtgaaaccccgtctctactaaaaatacaaaaattatctgggtgtggtggtgggtgctagtagtcccagctactcaggaggctgaggcaggagaattgcttgaacccaggaggcagaggttgcagtgagccgagatcgtgccactgcactccagcctgggccacagagtgagagactccgtctcaaaaaaaaaaaaagattctgtgtattagacacataaagcacttgtgtgccaggtatagttgtgttttacaaatattgacttatttaatgactacaataactccatgaagtaagtacaattattatttctttttacaaatcaggaaactgaggcacagagaagttagagaacttgcccaacgtcatactgctgttgagtggcaaagttgggatttgaacccagaccttctatcctcttcacctttgttaatgctgccttttgtttcctgaaagcattgctggtgtgtttatgcgttatgtctttactactaattatatttgatttttggaaagatgtggtattttatgctgtgcattatgtcgtttttgtggtttataattcataatgccatgatgtttttaatttaacaaacaagtattagaaaaggtaaagttgttgtatataataactttgctaataatcactgaacgttgtctcagcaagtatatgtgtaatgaatataaatttataccattaaaaaaaagtagccattcattcattcacattttcttgtaattctgcttgtttccatatttgcacttaagatctgttgaacgttaaaacaaatttgcttccttagattttttaaccagtcaccatttttttaagttggtaggatgggccatattgaagataaactatattttacaaattttatcagcatgctctatgaacttgcttctcaaactggagtattaacatatgtatgtgtttttaccagggtgtttgtgaagctacacataaaagtattactcttttaaagtaccatttctagttctaaagattggtgagggtggaaatattaagtactttaaattttcagcttttaaaaattttttatgttgaaactaaatgatttttaagaagcaaagaatttcacataaattatggttgaccatcctagagaccatgaaggttgtattaattcattccatggaaaacttttaggagtacttgattatatttgaagtaaattggtatcttggaaagttgtgaaattggtgaacctgccataccaaaatggtaaacaaaaacaaaactttcctggggtactgaaaagaatgatgttaccaaaggcacgtcttgttttaaatcttatgttttatttttttctttaatcttaacaaaccccacttttaaataaatccttagtaaaattaggatttatttggggctgttaatttacaaaaggattgattgtgatattcctttaaatagcttgcttcttcagtttacaaatgttcattatattcataatgttcaggcctgcatataaataaagcagggaaaaccggtgatagatacttagttttttaactataaaacatcctggtaaaaacattaaaaggttgtaaattggggaacctgtatagccagtgtgttttttaggttggcatatataagtgatattgatataattgtcttttgtttcattctaaatactgagcttagggcttgaatttgccatctgtttttttttttttattaagtatgaccattaaaacaggaataatttgattgaagactacgcatttacccagctcaaagaaatggatattttatttttgaatttaactcagtgatgtcgctaatctatgtgaacattgtagagtgacataaatgtcttctttagagtatccagatggaaattgtggcacaatgcttttgtatttcagtgacttcagaaagaaggtaggcctttaggagagtatctggggaacctttcaatagggtaattgtggggatagcaaattaagtacagtcgtgtgttgccaacaacagggatatattctgagaaatgtgtagttaggtgatttagtcattgtgtgaacatgatagtgtgtatttaccacaaactgagatggtatagctacctatcacacacctaggctatatggttatatatagcatagcctattagtcccaggctacgaaagtatacagcatgttactgtactgaatactgtaagcagttgtaacacaatagtatttgtgtatctaaacatagaaaaagtacagtaaaaatagagtgtaaaagaaaaaaggtataatttttttagcttaatctgttcttttaaaaattatatttcaataagtttttggggaagaggtattgtttggttacatgaataagttctttagtagtgatttctgagtttttggtgtacccattacctgagcagtgtacactgtacccaatgtataatcttttatccctcacccccatcccacccaaatatggtatacttgtttagggcagttagcttgcaggactgaaagttgctctaagtgagtgagtggtgagtgaatgtgaagtcctgggacattactatatgactttataaccactgcacttaggctacactaaagttgtaaaaaagttaagtgattgtgctatgacattatgacagctacagcatcattaggcagtaggaatttttcagcttcgttatgacattatggaaccactgttgcatatatggcctgttattaattgaaatgttgtgtggcacatgattgtagtgggcatgctattctggagtttattttctttgtggaatttgccatctaatagcagagataagtataaaacattttcttttagtagaaagttaagttagaaggagtatactttgttcttttggtttgagtgccatttagacttgagtgaagaagaaaaatagttggtagaattcgcatagttctcaggtttcagattcatagtctgagtttcctgatttgtcactaaatttgtttctcatccaaacatttttaatttacctcatctgtaaaactatgtagattgcaaatttttataatgtagctaattacttttataaaagagaatatttaaaacaaattgtgcatgatagaggaatttgtatcttgaagtttcttgtgctttaagtaggagatgaaccagaagtatgaattaaattgttggagagttttttgatttttctttttgcttgataaacaggaaattctggatatgtgatagtaaatgtttgaggctcctctaaggaagtgctccatcaattttctgtccttgctattttggaggggaaatttttcattttgaggacataatttctatgatatgataaatactaagaatttttcaaaaaataaggcaaatatgatagcaatgagtccagattgcagtgggaaagaaatataggaataagaaatacttctgtaacagctctggaaaacaggaaaagatgaaatcataaaccagaaaattttgaggctttctagaaagatgtaaggctgacaagattagattcctgaaaaccattagtattgaacagcttgtactacacataggggaaagtatctggtttctgagtagaaaagtagacttgcttacaaattcacctagcttagagatgtcagggctagggcagagaaatggctctgtgagcagtatcaaggtaattagaagactctggaattgatgagtcttgaagaaaaatctgtctgttcctctctcttctttaccacactaagagcagagtctgctcacaaaatccaatagccttccattatggggttgatggagatgggggagactcttgagggaagtaaagcagtgattttcaccagccatcagtacagaacaatccggatttaaaaagatgaagacaatgaggaaacactggatattagaggaaaaattaacagtgtaaaagaaaggactggtactgaaacaagcaaagcaaatagctcagagataatagtttatatagaaaataagaaactgaactttttagtattgggaagatacagtattgagaaaggaaccatgaacaaaaaattcttgacaattaaaaatatgattgccaagaagtcaaaaaatagagaaggttgtagaatccagagtactaagttgattccacagctgctctctgaacatttgttgacctagaggcttgcagttaaaggtcacatggattttaggagagagatctttgggccttcaatcattagattgaagagttagaaccctgcagtggaaaaaacacactcaaagtgctttttcctatgttcatactcaccaattaacacagaagactcctgtgacctcaaaatatgtaggatttcttcccaccagtgagtgagcagtcagttctgcagacaccagctagtgtcctccaattcaattcttttcttctttttgagacagagtctcacgctgtcgcccgggctagagtacagtggtgcgatctcagctcactgcaacctgcaacctccgcctcctgggtttaagctattctgccttagcttcagtagctgggaatacaagtacgtgccatcatgtccagttaatttttgtatttttagtagagatggggtttcaccgtgttggccagactggtcttgaactcctgacctcaagtgatctgcccgccttggcctcccaaagtgttgagattatacgtgtgcgccaccgcgtgtggctcctccaattcagttctcacactatctacctgaagacagcatcaaagcccagaagttgagggttcagtctcacaaaactgcccattactcctgataccagttgcaaacccaggtggtgggtttttttttttttttattgagacatgatcttgctctgtcacccaggctggagtgcagtggtgtgaacacagctcaccacagcctcgaccttctgagctcatatgagcctcctgcttcagtctcccaagtagctgggactgcaggttcacatcaccatgcctggctaatttttaaatttttttgtagagatggggtcttactatgttgcctgggctggtctcaaactcttgggctcaagcagtcctcccaccttggccttccaaagtgctgggattacaggtgagagccactgcttctggctcccctgggttgttttacctgtgcttctgacggaccaactataaatcagggatctcacaccctttccttggtttcagttaagctgctgaagtggcttacagaacacagggatacacatttaccagtttattataaaggacattacaaaggatatagctaaagagatggatagggcaaggtataggaaggggcatagagcttctctgccttctctgagtgtgccaccctagaggaacctttatgtgttcagctatctggaagctctcagaagcctgtcctattgctacttttatggagacttcattggataggtgtgattgaagaactgtgtagaaatgtgattggacaaaaaggttatgagctaatacttatagactgagtgggaaaacctagaaaggccggttcagattcttagcctctctgtgcactgttaatttctccagggtatgggagaacctcttctgaaatgggtgtcttattacctgcagtcagacaacgtaggtcagagaatttctttatgggcagcttcaagatggaaaggcaggggaaaattcctgccttggggagaaaaaggatcatgtgaaaggagggaaagagaaggtcagagacattaccttctgaggcctacttctgaaggccaatgtataacaaggactgtcagtgttatgaaccaggatccatgggcgaaaacctgtgtcatctatctttcacacctgcataaagccaggattcttcacgataaggcttcagtgaaagggagcctagaaaattaaatttactttccacgagaaagacactgtgtcctgaattggtgggttcttggtctcactgacttcaagaatgaagccacagaccctcgcggtgagtgttacagttcttaaaggcagtgtgtccagagtttgttccttctgatgttcgcatgtgttcagagttttttccttctggtgggttcgtggtctcactggctcaggagtgaagctgcagactttcgcggtgagtgttacagctcttaaggcggtgcgtgtggagttgtttgttcctcctggtgggttcgtggtctcgctggcttcaggagtggagctgcagaccttcgcggtgagtgttacagcttataaaggcagtgtggacccaaagagagagcagcagcaagatttattgcaaagagcgaaagaacaaagcttccacagtgtggaaggggacctgagcgggttgccactgctggcgtggcagcctgcttttattctcttatttggccccacccacatcctgctgattggttggtccattttacagagagctgattggtgtgttttacagagagctgattggtccgttttgacagggtgctgattggtgtgtttacaatccctgagctagacccaaaagttctccacgtccccactagattagctagatacagagtgttgactggtgtatttacaaaccctgagctagatacagagtgctgattggtgtgtttacaatcccttagctagacataaagattcttcaagtcaccaccagactcaggagccccgctggcttcacccagtggatcccgcactggggctgcaggtggagctgcctgccacttctgtgctgtgtgcttgcactcctcagcccttgggcggtcgatgggactgggtgccgtagagcagggagtggcgctcggggaggctcgggccacgcaggagcccatggcagtggaggggaggctcaggcatggtgggctgcaggtcccaagccctgccccacagggaggcagctaaggcccggcgagaaattgagcacagcagctggtggcccaggtgctaagcccttcactgcctggggcttgcgggccggcttgccgctccgagtgcggggcccgaggagcccacgcccacctggaacttcggctggcctgcaagcgctgcacgtagccccggttcccgcctgcgcctctccctccacacctccctgcaagctgagggagccggctccggccttggccagcccagaaaggggctcccacagtgcagcggtgggctgaagggcccctcaagcgcagccagagtgggcaccaacgtcgaggaggcgccgagagcaagcgagggctgccagggctgccagcatgctgtcacctttcaacatcagagacgttttcttctcttgggcttttggtgtgggactgaaaagtttccactaaaaacttgtgaccattagcctgccttcataagggtatgggattgtaatttatactacctgcatagtttaggaaactgcagacagaaaattatttaaaagcaatcaaataaatgttggcagtgctacaaagtacctaacagaaaagtgaattatcttcagagggatgctccttcaggtatgcccattgatagagtctaaatgaagtgctttcatattaaaaaaatatgagaaactcagcaatcatgagcaacagtgagcaggaaagacaaatagcagaattagacccctgtgaatgtcagatattgaaattactaggtaagacaatggagtataaatgaataaaatgtttcaaaagaattaaaagggaggggggaattaaaaacatgagcagggagcaaaatactgttaagaaataccaggtagatctgaaaaagaatctaaagcagttgtagaaattaaagatataataatgaccttgaaaaatattaaatgggttaagtagattgaactcagctgaacagagaattaattaacttgaagacagatttgaagaaagcccagatacggaaacatgaagatgtttagagtcagaagaataaacgtctaatgtgtatgaaattgaaatttcagaaaaggataatgaaaagactcacagttggtgtccaaagaaagaatgagaaattcccaaaattaaagtgtgaatcattaaactgaagaagtacgattaatgcagaggaaaaaaagtaactggataatactgaaaactaagagaaccttttttagcagccagaaacagattatctacaaagctatagaaattagactggcagcagacctctaaactataacaatgaatggtagagatcatagagctaggttttcaaatgctaagaaaaacaaatgtcatcctagggagagtaactggcagaatcattcagaaacaaggattttgaaatagatttttcagacagcatcagattgataaaaatctgacagtattgtgttggtgagtatgtggaacaatgggaactcttagacagctggtagaattataaacaactgcttttgagagtaattcagtaatgtctagtaagtttcagtatgcctttctccagtaacccaggaattctacctatgcatacatatatatcttagcattgtttattgatctcttttgaccatgatataactgagatcaaattttcgggaaacaaaatttatccttcctacaggcagtacattgtgatctgtctctgtacgtcatcactttgttcatcttcctttttcccctttactcccaagcattctcttttatttatttatttatttatttatttatttatttatttattaagctgtttgtgatcctggctcactaatgtgatattattgatgggttacaaactgcagtttgaaaaacactgccttaaagaaacaaacagaataaggatagggatattcatagcaatattgtgtgtgagagtgaaaaacttgaagtcatcttaagctctaacaaatggaaaatgggtaaataaactgtggtatatctatctaaggatcttgaactagacatcataataaatcattgaattacaatgcctatattaaatgaatacccttacaaatatagagtatagaaaacaaattacagatgagtatataatgtgatactcacatgaagcttaaaaaatgcaaagcaatggtatatatagttttatgagtatatacatatataaaaacaaagaaatccatggaaatgggctgggcgcggtggctcatgcctgtaatcctagcactttgggaggccgaggtaggcggatcacaaggtcaggagttcgagaccagtctgaccagcatggtgaaactccgtctctactaaaaaaacccaaatatacaaaaattagccgggcatggtggcatgtgcctgtaatcctagctatttgggaggctgagtcaggagaattgcttgaacctgagaggtggaggttgcagtgagccgagattgcgccactgcactccagcctgagcaacagagcgagactccgtctcaaaaaaaaaaaaaaaaaaaaatccatggaaatgataaacaccaaacttaggttattcctgggagtgaaaaagaaaggtatttctgttatccagataatttttttttccttaagctgggtagtggacataaaggtatttattaaataatatcttgtactcatgtgtatatctaaaatatttgacagtaaatttgtttgaaatggaggtggcagtattgacaaattgaaatttctcagaaagtacagcagaaagagttgaacattatgagagaaaagtttgagacctgtataatagatgtgggatatcagtatgtgtgaaataggaattccagaaataaaaaatacagtgcatgtagcagaagcagtagatagtaaaatggtagaataaatttgttctgagctgaaaaaagctttaaaataaaacctatgaaatcaagtttttggtaaaatcaaatatttataaaacttcaaaatttcaagtatcaaaagaaaatgaagttcccagataaacagcaggcgtacccctaacaaagaatctgattggcatttgatttttttttcttttaatgctgcactggatactaaggaagagtagaaacattcctatagaattctgaggtagaagtattgttaacgaacaccatggattttcatctaggtcctgctgctcactgcacagaaagccagtcagagataatgattattgccaaagaagaaggctttaatctcatgctgcagctgaggagatggaagatcagactcagatccatctccctgatggactgaaactagaggtttatatagcagggaagaaatgtaacaatatgcaagaaaacagtaactagaggggcaaggaagcaatcatgatgaatgaggagtccgctctctatctcattgtctggttgttgggatctggtgagtttcagttatttgatagtttttttgggaggcctgaaagtcatttccttaggaaggaactcagataaaacaaaaatgagtttcaagctttaagaccagaaggatcaatttctatgtttattaaaaaagacataaaaacccaaaaaactatctatgggactattgggtcagtttcagtattacgaccctaaagttctatgtgcaataaaactattccttcacgataaaggcaaaatatattctttccgaaggactgtgagcctataataattacatatttaaataaataaatatagtatttgggagtacttaagcaaaatgaaatgaattggaatggagaattttctggaccaaaaaaagaaaggtttatgttaaacatttgtgaacaaaaacaaaccaaaacccagtcagtgacatttaaggttaaatacaaagaattactaataatgtactttgaagtgtaatataatttttgagaaaatattcctgatataatgaatggaacttaggaaagaaatgacagctgagaaataaaattctaggtgacttaatacaagctgtcctacagcaagtgggagtggagcaaggaggggaaagtaaaagaatactgtctattcatggtatactatgcaaagagcttctatgcacaggaatggatggatattttatacttcttgatgtttatgacaaaatacaggctgaaatacgtgttgaaaatttgaggagacttttaaaagaaggccaacaatcaactcacccaaacttcctcaaacctgtttgacagaactaaaaatatatttaataaaaaaaaaaaaaaacaaaaaaacaaaaaagcctataacagcattaggtattaagaagggtgacattggtgcagcaaacttgggggaattccctgatgatagaaagtagatggactgagaggggcagaagaacaagaacagagaaaaccgcaactgaaagtgaaaagctcctgaggttcagtggacctcaaggaactctatttgtgttaccagtttgaaagaactggagtggaggggaggtggtgatgtgataatcagagtaattaattaaaaaactgcctctaggctgggcgaggtggctcacgcttataatcccagcactttgggaggccgaggtggacagatcacctgaggtcaggagttcaagaccagcctggccaacgtggtgaaaccctgtctctactaaaaaaaaaaaaaaaaatacaaaaattacgtgggcttggtggcgggcacctgtaatcccagctactaaggaggctgaggcaggaaaatcgcttgaacccaggaggcagaggttacagtgagccgagactgtgccattattgtactccagcctgggtgacaagaacaagactgtctcaaaaacaaaacaaaacaactaaactaaacaaacaaaaaacaaaaacaaggctggtgcggtggctcacgcctgtaatcccagctctttgggaggccgaggcaggcagatcacctgagttcaggagtttgagtccagcctggccaacactgcaaaactctgtctctactaaaaatacaaaaattagctgggcgtggtggcaggtccctataatcccagctactcaggaggcagaggcaggagaatcgcttcaacccgggaggcacggaggttgcagtgagccgagatcgcaccattgcactccagcctgggcaacaagagtgaaactcccatctcaaaaaaaaaaaaaaaaagctccaaactgcctgtagtagctggatacttcccttcctcgcttcctcattcatactgaatgatcagcagcagggtatttttctcaaggatagagtcatggcttctattctgcatatgatgattctggagaaggcttctggttgggattggaaagagcctgagaactctatcaagaactcatatgggaagaaggaaaggaaagatggctctgtatgtgtgtaatacatgaaacactctatcccaaaagtaaagccttccttattttggcagtcttgggggttccagcctataatctgctttgcaagcacacacactaaaacatgctgcttgatatgttttgcccgcattgagcctgaaatctgctctcccattcagggaagatggcttcagagacggacagacgtgtagatctataggagaaacccaggccagttagatagttctggaacactattcacaaatttggccaaggagcaccagaaaaccaacagtgcaaaacagaaagtgaacgaaggaaaaaactgacccctggaaagtgggaatggtgcaacaaatacatagaacttaaatataataacctcagagagatttcagagggcaaggtagctaaaaattcaaatcaggccattgtgaaagaagcaataggtgaagttctcagaaacgaaaaatctgattgttaaagaataatcaaaggaaggactgaaaattgaaacagtgatttagaaataaagttgaagaaacatactggaagctaaagataaaaagatggagataaaaaatatgaacaagtgtttaagtgacatggggcacggaaccaggtcttcagaggagacaggaggaggggagaaaagacgtaactaagtacaatacctaatgccgtggcgtattagataaatatttaaaaagatgagtgagattgaaatatacttgtgaaaagatggtcaagatatattaagtgaagaaggaagttgtgagaacagtatgcatagtatggtatttgtggttaaaatctatatgcatgttcaaatgtgtacaagaaagagtgaaaggatatgaaacactaataatggttaccttttgaggaaaggatggaggaatgagagaggaattcttttaaaatacataatgttgttttgaaaggaacatttttatttaaaaaatgaaagaactacaagttacattggagaggaagggaggagagcaacatgagggtagaagtggttacctaaataagccatttaaatttacacataatctccaacctatacttttctttataacatgtacttttctgttacttcttagcagttgtctccttcccctattattcctggacgtttacagaagtatattttcacacacttctctgaaccttcccttttacccaaagtatggtgggggtgagggtgtgactgataatttccttattgcacatagattttgtgagagatgatatagatggggagaatcacgtaaagtaaggatatctttaaattctaggtattggtttactaataatagtatcaacccatcatcttttttggaatgagtcagcatataaataaaataatgaatggtaaagagaaaaaacaaagagaattataaattcaaaaggtatatcctggtgggtatttttgagttgagattaggaattgattagtatcagaatagtaacatgtaagtataatcacagaggtttgtagtggtattctggaccacttgaaaggcccatcctttttgtgaggagatggatatgatccttggtttcaatatgccacatctactataaacttctgaaccctccaccatcattcaggatgcatctctcatggttgaagaagtggtggaggatggcatgggaaagagtgcctgaggatccttgcctggaacaagttatggaaagaaagtcttacaggtattcttcttacatattttacttgattgctatgtttttatgggacaaaatagttctctttcttggaagagtgggttgggagggggagagaagaggaagatgggtgtgttggggtagagcagtggccttcttttccaagggtggtagagaaattaggaaagaatattagtgtctttctgtcttttttctttttctgttcccgtacaacttttctgtcatcttcataactaagttgtatcagagttttcgaattgcagactcatttacatgataatatgattcatcaggaacatttaggtacacagcatgctgacataatagtattagctatcaataactcttagaaaccaatgggaaatgtttagatctgtgaattgtactaaattttaaatattttgaatatttttaatacaaatcttatttgtaactaacttgttgatgatctcttctttggttatgttaattggctatttaaccatttcacactctgatttatttctcaggcatgaagatgttaacaatgctgtgcgttttaattaagtagttaattaactggagctccctaagtcttaagttcctgatttttctctagaataccagaaacttaagtgccaagagctcagagaatggcttccaggacagctctagcctcactgcagcttaaaaaattgcaaacagatttttttttttgcaaaccatatgtcagggaatttctcagaggttttctaagaaattcttttatttgaagttttagaaacactatcttcagttgtattgctgataattcataattctgttgtcctttttaaatgataatataaaaagtatgcattagtatgtggggaagttgtttttgaaaacttacagcagttggaacttactcctgtaacaactctgttaagtggaagtaaacaaagataagtgagcataaaattggtcaaggtaaagtaagtgaaatgaaaccatataatagtagagtttttttttttcttttctgtttcagtgaaaataagtaatgttgctcttaagagagaattttgtattattttctcctcttcttttttttttttttttctagcttgggctctaggaaaagagccttttatcccaccttgtcttccagtccattttgaatcaagaaagactcattgaagactcctttgagaaaagtctgttttgaagaaggaaaaagaaatactgtttgagagaaggcaaacagacaaaaagggtgatagaaatatgtatttttgttgtatatgtaactctaagagaccttcctagagtgaatgaaggtagaaaactgaaaagggagtaaattaaggaatgattgaattttgtgggtcttgatggaaaaacgctggtcttcttttaatgtggaaaaacagctagtgcttcagtcctaggaattatgtctctgctgtgggcagttgtcataaactcttctcacaatccgagctgctctttgtcctctgtgaatgaaggtacttttgcttccatttcatccaaggatgaatgaaaatgtatagcatctgcccaaacctaaaaagtacagtgtgtttatcacgagagctttgtaaggtacttcacttccactttaaaattctttagtgctcaaaaccaactattgtgggtttttgtcaataaatactaatttttcaagatgaagtatggtgatttctattcatattgtggtcaattttctcaattttgtttcccatagatagcgtgatggaacttaaattttattttttacacttaaataactgtgctttttgtgatgcgtaatcatgattttctcttttccttgagattttaacagaccttatattagtgcatatgtcaaaataaaaatttttaaatagtaaatatgttgtaatattaaggatattgatttttttctattaaatgttgagcttggtgttggtataaaccctgatcctaaacggtaaattaatacttggaaattaagagtgtaactatgttatatagaaaccatcttgcgaattggtttgtgtgggtggtttttaaatttagtttttaatttttttagtatgtaatcgtactctttcaggattatctaaagcacttattgtaattggttgtttacttttctgcctcccccaccacattgagtggggaaataaaaccaaatgagtatttggaatctagtatgatccacccaatagtgaaagctaccaggatgggaatgattcctggagaatactggggaaacttgtagagtgtatgacaatttagcaagatgtataaggatgaggaggaattccaaaagcaggtggatgggggagctccaagaggggagtttccagctgagtgcaagttgtagaccatttactgtagcaacatcttagagtagaaggctggatggtagaagaggagctgcagagataagcagaggtagctagcacacagttatgagaagttggctggagaatgagatttggcaagtgctccatgtaatgaagatttgtttaaagaaaagatgtgatagaaaagggctgagttttaaactccccaagtttaagaaggtttgaagtttttaaactttaaaagtggccagggagggagccaatagagtaaaagtataatggtgagggttatgctggatgcaagaaattagtgtttcactaaagaagaatgttcagttgtgtcagatgtcacagagaggtgtagaaacataaaaagtgcaaggaatccttcagatttggtaaagaattgccactggtaaatttgtccagaacaatttcaatggggccagaaaactctggattgtgaagtactcagagatgagaacatgcaggcagtgattttattttagaagaattatttatctgtctttgcctttcatttaaaggcactttctcaaagttcaggttcctgactctatgatataattatttatagactgcctttctgaaaatagttctatatgggttaattttgttaatattagtatgttgacaaaagaaaacataaaggtcgatatgattattttcaaactgagaagctgctgtaccaaagctagtttataaaattagattttgtatttatggacttactcatctactatgttacagtagtctttgttttgtgaaactccaaggaaatattttctacacatttcaggttaagaaagaaaaacatgcgtttattttgtcttaaacatgaaataatgttttaagcattctaaaaagtacttacaaatggattaaacacattggcgttctttatagttttactctggttcttttttttgtgacttgttattcatagtctttgcaatgccgccctctagtgatcgatttccaaaaatgcattaattaacttgtaagcctgttacagtctttctcttttgactctactgatcctttgccacagcctttgtttggtgttctcttttattgctcttccattagttattcttattctcctttaatggcattagggaaagatcagaagtttcaggagcaaaaaaaaaaaaaaaaaatacatatatatacacatttgactatgaatccttaaaacttgtccatttaccagtctgggcatagggcaagttacctgtccagagttcttactgggaatgaatgagaatgtctttttgtggcacctgacacagacagcaaagagcaggcattcaacatataccagctgtctcttccaccctcttctccccaacattgctgagagtagggatcagtactgttttttttttttttaaacctgtcccttctcctcttatataacatctcaatttgttgtaattacctgtttacttgtttgtgttctataacttctagaggtcaggtatcatgtttggcttgtacatatttgtatctggtatttagcagaggccagtacacacagggtcctcattggatatatatttgttgaatgagtaaatgaattaatggatgccagtttttaataagaaccccagactgtgttaccgacatttctgttgattgattgattatgcagattgtaaatgggtaatatatgatataattagattttacccatgacctttcatagaggtatttatttcatgactttttcagtttattctatagttattggtcttctcaggttttggataatatgataatttgtgttttccttaagaattgtctgttttgttcagtttaaaaaaattattagcaaacacttatgtatagaattttcttatgatatttgacttccatatgtgacaaaaccccctttatcattacatttatgttatgtcttgtgttgtctgtttttagattgtaattagattggaggtatatatgtattttattgtttttttaaagcaatggccctttgaattttattcttctgcttgctaactgaaaaaataattttacctgttttttttgtcttccaggtttttctaacaacttagtacttccatttttctttttgtgcaaaagcttttattactctaaatttgcttctaaattacagatttgagtaaatgccatataatagaagatgctgtttttgttattttctagattttcaataaaatgtagctgcaatttcctcattgatctaaaagttacttaagagggtatttaaaaatgatgaaatgtatgtgtttacaattgttattttccatttttagtataatataatcagagaataaggaatgtacagtttctggtttttgagaattaaaatcttttttggtgatacatataagatcagtatttaaaatgtgccccaagcactgacaaagaaggtgagtcctctgaagggtatacagttttatatatttattcagatctctttttttttttatgtgcttcagctatcatgtatttatgataattttattaaagttttgtattactgttgtgtgtttgtcatttttctcattgttttttaacgttttattgctacattatttgattcttagaagtttgtgattgatatcttcataatatattttattcttcatcaattaaaaatattcaatcttttcattaaacattgcttatcatgtggatatccaaatgggaaaaacaatgaaacttgatccctgcttcccaccatgcacatttgattgaagatctaaatgtgaaaagtaaaataagcccctagaggacagtataagagaatatcttacatctttctatcagactgaaagtatcagtactttataatcttgaagtaggaaaatgtttcttaaacaggacacacaactcacaggtataaaagggaagattgataacctggactgttgacagttcaagaatttctgtcatcaaaagttactgataagagaaaaacaaaacagtaacagcagatacttgtaatatatatatctgacagatggcttatatccatactatgtaaactcctacatcagtataaaggacagacaacccaatagaataaatgggaaagagatttgagcagtcagttcaaactgtaaagacataatattaacactcagcagaatggctaaaattagaaagatcgacagtaccaagtattagcagaaagtggagagcgatgcacctctctttttgctgctggtgggaaaatataaattgtaaaaatcacttctgaaaactagcaacacctgctaaagctgtgggtatgtgtatacatacatatatccagcaacttcgataggaattcatgcagatacccactaaaaggcaagcacagtaacattcaaagtagcattatttgtattagccgaaacctggaaacaaaaatggccatcagcagtaaaatgggtaaacagattatggtagatttaattcagtgctgtatagtaatgcgtacagcaataaaaatgcatgaattgcggccccgtgcaacaacaaagataaattacatgaaccgatgttgatcaaaataaactagacacaaatacttaccgtgtatgattccctatataaaattcaaaagcaggcaaaactaggaatttaaaaactataaaatacaaaagcaggcaaaactggttattagacctcaggttagtggctacttttatggatgaggaagggatagggattgggaagtggtattgggcttctaggtattagtagtgttccttttcttgacttgggtggtggttacatgggtatactgaccttgagataattcagtgagttgtaaaatttatgatttgtgagtttttctgcatatatgtatgcttcaataaaactcaaattacggtaagcaaaaaatactgctttagtgtgaggatattattattaaataatattaaaataactagaaattcagtgaaacttaatcacgattgtattacctattgaaaatgtcagtgaataataccctctgctaattgtttgcctatatgttctcacattcagtcctacctcttctctgtcctctgtatggcagggtacatttagaaaaatacaaaaaaaaaaatgaaacttttttctcttatattttggttttgtttttattttcatttgttgattatatctttgccctctttttttaaaaaatttttccttatggagttttttcctatattgagagtctttgactccttttttctttgacttttactagaggagttctattcatttttctttttctttttcttttttccttttaccttttttttttttttttgagacagagtctcgctctgtcaccaggctggagtgcagtggcgtgatctcggctcactgcaacctctgcctcccaggttcaagcaattcttctgcctcagcctcctgagtagctgggactacaggcatgtgccaccacacccagctaatttttgtatttttagtagagacgaggtttcacaatgttggccaggatggtctcgatctcttgacctcatgatccgcccatctcagcctcccaaagtgctgggattacaggcttgagccactgcgtctggcctgttttattcattttcattcatattttaactgctggcttattcatttagtttctcatgcttcattgctgttatgcaaactgttttctttctacgtgtgtagagggttaactttaattctcctgaaaactatttctatgtttttcaaatatttgagcctatattttttgaattaacactattaaagatacattaatttccccagtttaaggtgaaacaatttaacttctcccattctttttcctctcacctctgtctttttaatgatgtagttcgtgattcagattaaactttattttcaattttttatttttgcattttgtttaatctcgagttaatttcagacatatgcttttttgtaaacatatttacaatcattattcactcaaaaatttattgagcacctactaagcaccagacactgtcctaggcaaataagaatataagtgaaaaagacaagacccctgatctcatcaacttgttgatggtcaaaaataggtaaataagatgctttaaattttgaagggtagtatgatgggaataagtagggtgaagtgatacagaatgaatgactgcagttcggattaaggctatgttaggttggtcagagaagtcctttttgaagcagcaatatataagctgagacttgaataagatgggacatgaagctgggtggagtggttcagggagaggggttagccaatgccctgatgaggtttcattttttggaagaacatttattcaatattactgattgaattttgtcaggcatttgagatagtcatgaacgaaacaggatttttgctttcaaagtatttacattttacgcagaacagataaatagatgagcaaataatttcagaatgtgataagtgctataaagaagataaaatgctagaatgaggagaagggaccactttaggtaggataatgagggatgcttttctgaggaggtgacatttgaattagtaacttggaagtcagtaatagacccagacatgtgtaaatctagggaacagcatttagggtagcgttttagttgggttggaacaaagagggtgaagatgggttgaatcttttcgacccttacgtgcttatgataagcttagaacttactctaaatatggtggaaaactataggttatgactacagattcaattactatagcaaaagatctttaactatagagcaccaaacaaaattgaagttactttcatataactcagtccaaagctggtagctggctattttccttccacaaggttgtctaaagactctggttccctctatcttagtctttaaccctctgataagcagttacctgtgtctatgtggtccaagccacttcgccatttacagatccatgtttctaacttgggaaaggggatgaaaggctagcaacttaaggaggaagggacagaaatttttgcatgtaggagtggaaaacattaccagaccttttagctttgaggaacatgttaatttttttttaaggcttccattaagaatgttgatattcataggggacacctaggtttcagtgaaatcaagaaagtcaaggaaacattgagagaataggctgaggagatagacgacatttctgatctcagataagtagttccagaaggcatgcacagtgaaatcatttgagacctgggatggaggatgggggagattcgtaatcttctttgtgctcagaaagagaatctgaatatttttgttaacagtttcagtgccagtccacttatgctattatgttatttctcttgggttattgtgacttatttatagattggctttgtagtttcttttaacagtatttcagatgtgcataggactggtaaaaaatgttgagcttttctgtattttggccagctgtgaattcattgagtatagtctttgtccctgaaacttcaatagcctttgtttaattgattctaatatttgaattagttgacagattttaaaatattcaagctttatgtccttaggtacctcgtgtcttaataatatagccatgaaaatattaacatttgtaatccttatacactaaacaaaaaaggggggagtgtgtatataataaagcatgttaccttaaagctatcacactgattgttttactaatcatttgtatatgtatatacaccatagaagtataaacaacatgcactctcacactgaaaagcattgctaaatatgatggtttctcctttgaaatgtactttgagatatttttgcatgtaggtacactattgattacatcttctattaatagactattccactgaaataagttggatgctggaaaattctgtttaaatttgattagatacttgagttgaatgaatttgtttaaagttctttttaaaattgcatgaaaatatgtgaaaaagtttaaaaataatctacagtattttggcaggataacaagaaataaaatttctttttaaaaaatgtgagttttggtaaatgtttctccttcaggactggtgcttctaatacaggttggtggttgtgcatatatttatggtttcacatatcagtactcaaagtctgatcataatcatgtaaaaatcattgaaggaaaaggttgcgagggtgctggcccagagtttcaggaaggtgtgtacctaagtactctaggacagatgtgtatttccactaaatatcttagaggtggttatttcataattttccttaaattctgtggattgatgacctcaaaaataatgatgtataagtatagttatggaatttagcattaccagcatcttaagcatagctgtagttacatatccttccatgtttgtgacaacatggagaagctcgtgaagacacactgagtcagtaagctgatagctcttactttctgtgaatatgtgcatagtttacaaaagtctgttgggcttctgatattaaaattatgttagtgaacttatatataaaataatttgaggagtggtcctccaactttaatgtgtttaagaatgatcttacaacttgctaaatcctgatgtcttggcccttgttccaagagctttgcttggttctgtggaacacacttgaaactattttagagattaaagaataaaaaatagaagctttgaagaatagtgatctgtgaagcaggaaattaaaatatcatgcctaagtcattaacatttctgcatagaaatttgcattagtttgatataagcctttctattattgttcactaaaatattttaagtgattgactttgaaagtgtcctttgttttagcttctttgttccattctttcctgacatgttcccttcagtcttcttttactttctttagtaaatgtttgagtgtttaccatgtgtcagtcattgtgctaggaatcttgaaggactcaaatacgcaaaacacatggatctagcctagaagttctcatttcagagattaagcgtcatttataaaacaagtgataattgtataacatgttgaatgacacagtcattcagagtagtgaaaaattcacaaaacagctttgtagtagctcctaaaatatgaataggagtttctcaaggggacagaagggaaatggcattccagttagaacaatatttgcaaagacatggaagcattaaagagacatttgatgagatcaaggtggtgggtaagttgtagaaaaggaggctataaaataggttagggccagagacttttatcttttaatttattttactgtttaacttatgccaggggagttgcagtgaatgtcacggggagaaaaaaagatatttcaaaagtagaattggtaggatttagagactagttggatgtgacttagagtttaaagttagaggagtcaagggtgactaattggaataattaaggaaaatacagaatctaatgaaatctgacttctttaattttcaattatatttggataaacaaggacctttaaatctgatagcctcttttcagggcttattcttcctgaagtcatcttagcatgtgaacattacctcttatagtctgaagccacatttgtttgtttttccctcagccctactggtgaaactgtacgatcttgcagtctgcttcaaaagcctgtgtgtgactcagtcattctactttaggaattgaaaccaaagaagtgatcagagatgtgttccaagatacatataaataggtctttatattatagtgtttttatgattaaaaaatgggacatggcttaaatggctttcaaaaaaggaattgatttaatttttgtatatctaaggtactgaatgggtaagttagggaaaggctgggctattgtaacaaagagatttactaatgattccatggtttaatttaaaaagatggaaatttatttctttataggggaatgtttcaggtcaattagaaattctacttctgtggtcattcagggacataggctctatccatcttatttctctaccacctcgtggggcattaatgatctatgctcaattttaggcacatccatatgctggctttattgaaactgttcttgccatggttgccagcaatgacacaggttgagtatctctaatctgaaaattcaaactccaaaatatgaaactttttgaggggtgatgtgacgccacaagtaaaaattctacacgtaagtacttaacataaactttgtttagtgcacaacattattaaaaatgctgtataagatgtatatgaaacaaatgaattttgtgtttagacttaggttgcatccccaagattatgtgtatgcaaatatttcaaaatctgaaaattttgaaatccgaaacatttctggtcccaagcttttttttgagacagggtctcactctgcagcccaggctggagtgcagtggcatgatcttggctcactgcagccttgacctcccaggctcaggtgatcctcccacctcagctacctgagtagctgaaactaagttgtgtaccaccacacccggctaatttttgtatactttgtggagacagggtttcaccatgttggtcaggctggtctcaaactcctgggctcaagtgatcttcccacctcggcctcccaaagtcttggaattatacgcaagagccactgagcctgtcctgtccgaagcattttgaataagggatactcaacctgtaattaatacatgaaataggcatttcagtgcttctgttgtttcactgtgatatttgaaactgctggccaactttctcctccgtgggcttctgctggtttctcttctgtccctctaagtatttgttcactgtgtctttttcatgttcttttcctttgcccttcctataaaggtttttgttctccagttttctgtctttggtccgttttcatttacatgtgtacctatgttgatctcacccagggccactaccacatgatggtgtctcctaaatctacatctctagcctgaaaacctttgttttgagcatcaagacctgtacatgtaatgcctctctacctgagtactctgcaggaaattaatatgtaacatatccaggactgacttaattatcttctttcccaagctggctctcgcacctgcattacctctcatagcctcctagatcagaaaccaggaagtcaacctcagcaatttcttgtcctccctcttccagtgagacctcaacactttattaaatatgcctcgagtattattgctgacattttcatttttctatctccattgccacagtcttagttcaggcgaagattattttaagagcttcctcagagatctgtgtttccatttaggctccctttcaatcctacttattggttaaatgggtcagtgattttcttctactggtatttggtgggcagcagctgtagttttaaattgcatgatatctggcccagtgctgagtgcagttcagctgttaatacgatactaaatgaagaacatttgtgaataaagacaagattagtaatgaagtaattattaccataatattcaaagaaatctggaagaaaattagaaactactttcacatcggtagggaaaaagtactagagccaaagaaaatgattttggtattttactgtttaagtttacatacaatctgaatcacggaaccaaagacatttgttgcagagattagcattatttaaggaaatcaagaacaaatagttcctgaactcagtgtgtcagttcaacctctgcacctttgaatttggctggactcctgtgggtcctaccaaggctgcacgtaacagaaagctatagacttccattcctgttctggccagttaacttaaattctttgtgtgtggacatctgacacacctgtttgattctccctcttggtgttaggactcctcgcatctgatctgtggtgatccttcacagtctctctcgcaatttctttgactgttgtataactctgcagtccttaactatatttgctcacctaattttttagtgctttctgagcttcaagtaagaagctttcttctttatttcatgcttcttggttgagtcatctctggcttacctggcaggagaaaggagtatttgggcataattagtgtttttacaaagtatgtatagggtattgtgctggctggtatatatggcagaaagaagtgattctgcctcaactcagattagtaataattctcctcctgccagttgacgtttattgtgcttttactatgtctagggcactttctcacatgctttactatgttttaatccatttaattctcacaacaatgctgtgagagaggtaatatccccataagtggggaaactgaggcctagaagggttatatttgaccagtaccacagagctagtaagcgacagagttgagattcaaatcggcataatgtttccagaatctgttgcctccgttttttactgactcttgaaagaggggttaatatggtacatgcatagctataacacaaacagagatgctcttttaaataacattaagttacaagacaacatgcaaaatacgtgagtcgtcattgtggagggaaaggaatattggactgccatccactagttctgtgaccttgggcaagcaacataacctctcagtactttagtttcattatccatagagttcaaaggtcttttgcaaaagttctgtggattacatttttttttctttttactaatttaggctttgtttccttgttgtgtttagatttaggtatctactgcagattaaattacatcttttgaaaattttgattttccacttaggttataccagtgagttagttatagctttgtatgtgatactgtaaataactccattatttgtgctttattatgtgaatttggacttgtatagaacaaaccaggtcctcttaagcataaacacattctgtaatcaatcaattctatatttattgggcatttactatatatcttattctctgctagaccctgtaaaatcttggtatgttagtcaatatattagctttggttctgcactcaagaattcttacagaaatgttcactgtttggtattttgatacatagtcttgaaagtctgtccatttttgtgaaatggcaaaatatcaaaatgacaacattttaaaacattttatttttgtgtcagagtagagacaaacactgatttcaaaaatttcaaaattttacccaagacccacagtaagaaacatatgacctatgtgtgtctaatgtatatgtaacagacaaaattttcatgaaacaattatttactacatgtgactcactgtaatactttagttctagtctatactattttgtgcaaatgttcattgcagtctatcaagttaacctcacaggttctaaagctcttaaccgacaggctgaaaatcctacacttgactgataaggcaaaattatgaatgctgttgttttagtgatttttttttttttttttttttttgagacagagtcttgctctgtccgcccaggctggagagcagtggcgccgtcttggctctctgcaagctctgcctcctgggttcataccattctcctgcctcagcctcccgagtagctgggactacaggcgcccaccaccacgcccggctaagttgttgtatttgtagtagagatggggtttcaccttgttagccaggatggtctcaatctcctgacctcgtgatccgcccgtctcggcctcccaaagtcctgagattacaggcgtgagctactgcacctggcctgattttttagtgtttttttttttttttttttgagacagagtcttgctctgttgccaggctggggtgcagtggtgctatcttggctcactgcaacctctgcctccctggttcaagcgattctcctgcctcagcctccctagtagctgggactactagtgtgcgtcaccatgcccaggtaatttttgtatttttagtagagatggggtttcacatgttggccaggatggtcttgatctcttgacctcatgatctgcccgcctgggcctcccaaagtgctgggattacaggcatgagccactgcactcagcataaaaaggtttgtgttttgaatgaacatttatttccttttttataaatgaggatttcgtacattttactaaaagggcagaaatgtgcttctccttttctttgaagtataatcttttgaactttatttttacacaagattacttgaagaattaggttgcattattatataagctttagactgagtcatactgtgtattcatatcacaattttttaactaaattgttttttagcagattatagcagtaggataaaatgcacatttttaatgcctgagctcccatcccaaacagcttcacacatagtctcattaaaataaaaaatcctgggagagtgaagtgtgtccttatttaaagaacttctggatctatttttacccttgtgaggctgattcttatgaggcagtttgcacagtgactcagcacatgggttctagaatcagacttccattgttcaaatcttagctctgtcagttgtaagaccatgggcaagctagttgattgatctctctgtgtctcagttttcttgagttacctcaagagggtggttataaccattcaaaatattaacatagagaaacaggacatatagatctataaaactcgactttattttaggaaagggtagaattaggatgtctgcagatggctccattgttcgttcttaaagatacaatgctgaacgctctcatgcgcatgatttttctcttgagtgctcgcccttccaattcaacagctcacttatttaattggcctaagacttaattcccctgcctctcttcctagctccaactttcatgaagcttccttggataaaaatcttagcaacagattatcctctcgcaccccccaccccccctgtgctccacagtttctgagattccaaactaatcctggcagggaaaatcaaggaaaccttcatataaggatctcatatttgagtgtaagctcacctgagcaggagggcattccaggcatgatcagcttgctaagtaatacaggaaacaaaaagttcagccagaatacgaactcctcattctagtagaatgatgataaaacatacacagataacttcaatactgtgaaggatatgataaatgtcatgaggatgacccaaagtgctttgggattcagagagtgagaagtaacattcataggaagttttatgaaagtagagacatccaggctgttttaaaggatagttaggagtaccagagggctttagggtgggatgaggatgaccaggcaaagggcattctaaagtcacaggggaaggaaatagaggatgtattgaggaaaagtgagaattcacccatgatgagaaatatagagagtaccacagattggggaataggggctgataagattggaactatccaggttttaaccaagtgatggaaagccttacatggtgggctgtttgggatccattaaagaacttacaagttaatagcttttgcttgaattctgcccaaagataaattttttaacttgaccagtaccatgttgcttttaaatggcttttttttgttttgttttgttttgttttgagatggagtctggctctgttgcccaggctggagtacagtggcgtgatcttggctcactgccacctctgctgcctgggttcaagcgattctcccgcctcagcctcccaagtagctgggattacaggcccccgccatcgtgctcagctaactttgtatttttagtagaaatgggtttcaccatgttaaccaggctggtctcaaactcctgacttcaagtgatcagcctgcctcggcctcccaaagtgctgggattactggcatgagccactgtgcctggccgttaaagttcattttaaatttttattttaaattttagtatttaaaaatcaggggattttacattacaacttagatttcctttttttcctgtaaaacggagatctgaaagtacaaggcccacatccctgcatgacatgtgagcagaggcaacatcctttggacagggcattctttgctttcagatttacaacacagtatatttgtatatatttataccaggctggcctccctcagttatgttgcctgtctgtctcctataggcatttggatattagatttctgcagtagagaaatgtattagaagtcaaaaatagttactgaaatggcattaaaaaaacagccagtatgaaccaagtttccatcagataaaaatatatcccaaataaatatttgcacatcaagcaaaactgcaatcaaaacaaatattgggatctagtatgcagaaaattcaggaactcagaatgtgcttagtaaatggggccaaaaagatccccaaagaatgtcacttccctgtgtctatgctcctatttactgctcttccaatgactttgggcttttccatgtgatttactttgaccaatgggactgcagcaaacatgacccaaccagaggcttaaagattgcttgcacgttggtgtctgtgctcgcttatcacgcaaagccctggctagtatattggagaatgagaagccacgtgaagcagagacagaccatcccagctgaggcccctataccagcctgactactgccagccagatgtgagtggggccatttagaaccatctagccttagtcaccccaccagctgactgtagaactgcctggttaaccacaagctaatgagcaatataaaggatgttgttttaagccactaagttttggaagggatttttgcacagcaaaagcttaggaggaagctttgaagatgtagcccaaaaatgacgttgtaaacctccagcacactagctactattaattagcctacgagagagaatcttctaatataacatctataatacctaagagaactgaactatatatttgagaataaatggatatgctggagtatagaggggtttgtgtgtgtgtgtgtgtgtgtaatctagaacaatgatcagataggagatggaggtgtggagattgactggctggtttcaagaaatgatctcagaaacagcttgacccctgggattcctctagttccctgattgtatatccgtaaaacctcttaccgaacccaaaattatttttctgatcatcttgataatacatttattataatttcatttttacattaatttctatagatatttgtggggttttcttgggatggtatactactaattatttggtttttcttttggggagcgggaatgttgatttaaatctgtatccacatggctggattaagactaaactcacttttcaggcattctcaaaagggaggaggttcactgacagcacgccccttctgatatcattagacaacttactggtacccttggtggcttctctgaatcctgtctatgggtgccaaaatacagggatttcaatatgggggaaagtaagaatttggagtattcccaggcattttgtgtgaatatctcccagcatcttattcttttaagtgtgacggctaagggatcatcaggacctactgatggtcttccagagatcatcaaatctggctaaatcttcaaagcttcctcctacagttagcttttgctgggcaaaaaaacccttccaaaacatagtagcttaaaacaacatcctttatattgctcagtacctggtgatgatcccttagctgtttatcagatgatcttcagggagtttgacagtcccatagggaaagtgatgaaacaattttaaaacgatatttaagaagtttgaaatgtaaaatatacttatgattttaatgaaaattctgttatatcctcaaatggaattataatcttaaaagttatgcttttgaaataaagacagtattggccatttcatcttgtgttttttttttttttttttttttttttgagatggagtcttgctctgtcgtccaggccagagtgcagtggcgcgatctcagctcactgcaagctccgcctcccgggtgcatgccgttctcctgcctcagcctccccagttgctgggactacaggcacctaccaccacgcccggctaattttttgtatttttagtagagacagggtttcaccatgttagccaggatggtctccgtttcctgacctcgtgatccacctacctcggcctcccaaagtgctgggattacaggtgtgagccaccgtgctgggcccgaccatttcatcttgattaaaattgagttaacagagtttgtttctcctcgtctgcctcatatcgttagtgaattatatcttttgttaaatttgcttttcttgttccaacaggattacatgatatctctacctcataaaatgaatcaatctatctctaatgtggcttattgatgcctaaaatagaggtgaaatagtaacataatgccagaactcagaataaggtcataggccaggtgtggtggcttacacctgtaatcccagcacttttggaggccaaggcggaaggattgcttgaggccaggagttcaagaccagcctgggcaacttagtgaaactttgtctctacaaaacaattttaaaaaatcagaataaggtcataaatataaatactaaacagaatttcagtgtaaacaaagtagtatatgtattgggatatgaatctctgagtttgatgattttgtataaacaagcaaagaagaaaacataaatagaagatacatgattaatatctgcaaatttgattttatgttattttctagtacttggtgtgttgtatgttataaaattttgtcaaatagtagcagaaactactgacacctttgtattgctttcaaagtatcataactactctggaaaaccagttatgtttttttcctctagggcaaaggcaagtaatgctttttcttggtgtgtgtgtgtgtatggggtgtggtgggacagggatgaaattgctgcattttgccactaaaggaagagataggacttagacagttcattcacagatggactctttgaactaaaaatggtatatgagagcctgcatagcatgttgatgaagatcatgggctgcctgggttcaaatcccagccttcttacctgcggagcatgttgattgattaacatcatgggctgcctgggttcaaatcccagccttcttaccagctgtgtgtacttggtcaaaccacttcatttctgtatggctcagcttcattttacttattgagggaatagtagtaatatgtactatatatgtatgtttgttatgagaattataggagttaatatttgtaagcattagaagagcatgtagattggccaggcgcagtggctcacacctgtattcccagcactttgggagctgaggtgggcggatcacgaggtcaggagatcgagaccatcctggctaacactgtgaaaccctgtctctactaaaaatacaaaaaattagctgggcgtggtggcggacgcctatagtcccatctactcgggaggctgaggcaggataatggcgtgcacccaggaggcagagcttgcagtgagctgagatcgcatcactgcactccagcctgggcgacagagcgagactccgtctagaaaaaaaaaaaaaagcatatagatcatggtaaatgctatacaaatattaagaacatgcattagaactaaataaaaatgtctatgagagggaaatgttttttataaagatgagattacgcggctgggcatagtggttcatgcctgtaatcctagaactttgagaggccaaggcaggtggatcacctgaggtcaagagttcgagaccagcatgactaacatggtgaaaccccatctctactaaaaatacaaaaattagccaggcatggtggcgcatgcctgtaatcccagctacttgggaggctgaggcaggagaatcgcttgaacccaggaggtggaggttgcagtgagccaagatcatgccatcacactccagtctggtgacagagtgagactccatctcaaaaaaaaaaaatgaaattatgattcacgcaaatataaaatgagcacttatcaacacatttaactttggttgaaaggagaatttaaagaaccatacatatataggcaataaagaatactgaaatgaatttacaagtaatgtaaaataaatgaaaataaatataaattgtcctcaagataatactcagttgtattccagggaatataattcatgtgcatttatatggacaataattcacattattatccattttctgcagcttacagagttttaaaatagctcaaagacagtgaaaggtagagatcaccgtgataggtaagctatacaggacacccactaatttcttggagtgagctcatatcgaaagtttttcacattttctctgacatgtattataaacaattataaatgtaatcattataaacaattataaaaccagtgcaaacttaataataaatattaccctcagaggaggaagtagaagggacatactttttccccaaatatgactttttgaacagcatatgatattgacaaagactgtctctttaaccaaactttagttaggtccctctggacaagcccttttcttgtctagaccctgtccttgtcagaccttcgttgtccagtttgagcaagaatcttgctaagtcagtttagagagaatctcctatcccaaatatctaacatttcggtatctgatcaaattcctgatcccccaccatcccccaggcaacatatgatcatactggcctaccttcagcaagaatcccatcttacccctagtgtttcctcttagtgatttttccatccattgaccccatcctgccccttggctataaattcccacttgttcctgctgtatttgaaactgagctcagttcgatactgacgtctcttttcctctattgtaatagtccctgaataatgtttttactgctttaactgctgtccagctctagttcctttaacagttaatggtcctgtgatacgggtaggattagatttattattggattcctggatctctcatccaggactcagctgtatacctttgaagcctttgtcttcactcctgactgattgatctgggatctgttgatgagtctgactcctaaaccattgccctacatgacagttcactgaagcatggtaggaacagatattcatacttaagattctgagtttactggttgaagttgggttagagacctatgttttttttgaaaggtactactgggctggtagtctttcttcatggcttttggttccaagtggggattcacatccagaatcctgagatggaaatggtttctcctggcactctgtgaggtctccctgttctgtttgaacatgcttctcccatgggaacttattagttgactgaaaccctcttctcaaggttctgctgactacagtagtctcccctgatccttagttttgctttctgcagtttcagttaccagtggtcaactgtggtctgaaaatattaggtagaaaattccagaaataaataatttgtaagctttaaattttgtgctattctgagtagctttatgaactcttgtgctatctactccatccttcctgggaagtgaatcatcctttttcagtgtatccaaattgtagatgctatacagccattaagtcactttgtagtcatctcagttatcacattcactgtctgtgtattgcactgccggtgttcaagtcacctttattttacaaaataatggccccaaagcacaagagtagtgatggtggcaatttagatatgccaaagagaagccatgaagtgcttcttttaagtaaaaaggtgaaagttctgtactcaaaaaaaaatcgtatgttgagatttactataagaacaaattttctatgcgtgaaattgtgaaaaaggaaaaaaatttgtgctagctttgctgtcgcatctcaatctgcaaaattacagccactatgaatgacaaatgcttagttaccgtggaaaagacattaaatttgtgagtgtgagacattaatagaaatgtgttctgactgacaacagccgagtgtaatactatctgcggtttcaggcatccacgaagggtcttggaacatattccctgtggataggagggactactagtatgtgctcctctaaatctgtttacttattatttgacaaggataatttagaacttcactggcttctctaggaaacttaagatctttccaaagtggctcctctaagacctctcccttcccattgcttctgctcctccttctccccttgccatctttgatttcccctttaattctcttgaatcttttgatgtttcccttcaaagccttacctctttcatcatccttctgtccatatctgccagactttttcttccctacttcagcttctcagctccctataggcacttgaactttaagcacactgtccctcgttgaaggttttcaagggtctcaaggatccccaaaagcaaccacctgaggctataaaggaaaaaacactaattggaaacactgaatattttatccagtcagatgggctttggagacatccttaaagctgttcgatgtcacctcagttactgcctaaaatttggtccacagcctccataagattacatgggaaaatcttaaaaatcttctctataaatattattaaaaaacattaactctcatatagaacaggtaacctaatttgttccatttatcaagaatacaattttgacaaaaatgtagaccaaagataaaactatattactttgtttacttgattaattgctaaagttttagaataaaagctgtaagatctgtttgcggctatctgcgtatttgtttgtatatgtttatgtatgtatgttatatatatgtgatatttttctacctaaggatagtattaccagcataattcataaaatctcataaggaagcactattcaaattatcttagagattaatgaactcttatataagttaaatattccaaaaactcccagaaatgtggaaactaacccaaatgtgttttaaagttcatacgggctggatgtggtagatcacacctgtaatcccagcactttgggaggccaaggcgggaggatcacttgaactcaggagttcaaaatcagtctgggcaacatggtgaaacccatctctaccaaaaaaaaaaccccaaacgcacacacataaaaaatacaaaaattagcctggcttggtagtgcatgtctgtagtcccagctactcaggaagctgaggtgggaggaacgcttgagcccgggagttggaggttgcagtgagctgagatttcaccactgcactccagcttgggtgacagagcgagaccttgccccctcaccttccaccccccaaagaagtacatataactttgctaagtcttcaataaataagattaatattattggtttaataaaaatgggtttgtcttaatgacttgtcagcgttaagtataatgtgggcatgtttttattctacttaggtttgctgatcagataaacttatgtctactagatatttaagattataaaaattataaatttcacctaagaaccactgtacaagtaaacatgcactaacattgaattgctttatagccatgacttcttgtatatcaagcatagcagtaaaacaaaaatccatgtgtttaacttttttaggtttttgcttttataatactttcctaataaatgcatatgttgtagaaatcgttaacagggaaataacttgagatgttggctagctttgtttaatgttatagtatgtctgcctggaaattgtttttaaaatctttttagtaatttgcaaccttagacttacattacattacattaatagatattcattaaaatctacataatttctaagaaatataaatgactgaaatactaatgctaaacctaagtttgagtttatatactttggctttttattttcatatgacataaagaaactagatataattgggcctgttaataaaatgttcttctgaaagattacactataaagaaacaaatatctctaggaattgtaagatgatatactcataaaacctgctagtttgctatagaatgctagtatgtgacacagtttacagctgtctccttaagttttctttgtaaaagtgtattggtcgttaaaattacatttaatacatgtaagttaaactactaaaaataataagtgtgaggagaaacaactctgtatgcaaagtatgtgaggaatgaaggacttttttttactgttgataagggaaaaagagtgtaattttgtcttaaaataagattactggttattccagaatgagaaagaggaaaaatgtaggacgaaatctgaatggatatggaaaactgtaggtttgcagaaaaggaattctttatgttttcaagctggctatgattaaattgatttctatataaagtttttttttaaataacatcagcccaacagtgtgctaatataaaactagaacttggttttatttctgttaaagcaacaaagttttcttggaatattggtctgttcttagtaagagactgtgaaaggtttttcttttttttttttttttttcttttttgagacggagtttcactcctgtttcccaggctagagtgcaatggtgcgatctcggctcactgcaacctctgcctcctgggttcaagcgattctcctgcctcagcctcccgagtagctgggattacagacatgtgccaccacgcctggctaattttgtatttttagtatagacggggtttctccatgttggtcaggctgatctcgaacttccgaactcaggtgatccgcctgcctcggcctcccaaagtgctgggattacaggcgtgagccatcgtgcccggccgcctctttaccttttaagtaatctgcctagggaacaaaaattctgtgccttatcaaaataatttattgtgctttgtgttttctatgtcatctccttttaagagaacttaactattgtttcatagttatcgaggatcctgtttaatcagcattcaaatcttttgacatttttgagttttccaaaatcaaattctaaatgaattctttttttgtttgtttgtttgagatgaagtctcgctcttatcccccaggctggagtacaatggcgcgatctcggctcactgcaacctccacctcccaggttcaagcgattctcctgcctcagcctcccgagtacctgggattacaggcgcctaccaccacgcctggctaattttggaatttttagtagagaagggggtttcaccatgttgaccaggccggtctcgaactcctgacgtcaggtgatccgcccaccttggcctcccaaagtgctgggattacaggcgtgagccaccgtgcccagccctaaatgaagtattaatcttggactgaccttgagatttcccataggtcccctggaaaatgtcaaaggattttttctttcacctagtaaaaattttgtttgtttgatatattaaattatgtgggaaacattgtcaagtaaaaagtgatgcttaagcttttctaggttatatttgtatgggtaaatattaataataaaacattccagaaattatgtgaatttcatagacatttgccaataccctcattgtccatcatatgttctggtatatactgttatcatcataatgccaactattatttaaatatttaaatattgtgtgtcacaaaaataaccaaattccctcaccagttttatcatttttataatgaacagatgtttaaccacagacattttaagtcttttattatccacagatagtttttcttttactctgattcttcctgaaagcttccataatcagcttataagccagaatgcttcattttcaacaaaactgattgtctcagagacctgtggaaaggactatgccaggtactctggggtatagccttctaatggcattgcttagatacttgtagaccataccattggaatgagtatggatttctgcagctagtagagaagctgacgggttcataaaactgctaacgcaggataaagcagaagattcaattacatggggccgaataaactaataaataagataatttttatggttattgttttggaatatttatcattctttaatgtcttatttaaggagactttttttctgttgtctcatgctttctataactcatgacaatttagtaggttatgcttttgtaaaaagagatgaaacatattttcttccaacctgatccctccagaattcagaaacacttactgagtattcttattctcaatggcaatacaattatttggataagttcaataagattctgtcttccttgtaacagggcatacttggaaaaatcagtttataaccaaggctttgactggaatgtcatatttgagaatgatgcattgaatcagatacgtccagacagttttaaggcacaaagactttatggagtcaatgcttacaaagtcctcttgggaaaaccggcctggtacctggcttattgggcaggggttcccaatccctaggtctcagactgggccatacagcaagagttgagcagcaggtgagccagcatcttccctacccccagtctgtggaaaaattgtcatccacaaaactggtccgttgaaccaaagactgctgttatagggttcccagccttataggtgggtaaggaaggtcacttcctggcaggtccaggaagcttaggatattttgggaacctcacaagagaggaattcacccaaatctatagttcttataggaaaaatatggtagtgcttggcttgacttttaatcttcaagaggcttttagaagcctaatatgaaggtcaggcacggtggctcacgcctgtaatcccagcactttgggaggccgaggtgggtggatcacgaggtcagaagatcaagaccatcctggctaatatggtgaaaccccatctctactaaaaatacaaaaaattagccgggtgtggtggcaggcgcctgtagtcccagctactcaggaggctgaaggaggagaatggcatgaacctgggaggcagaacttgcagtgagccgagatcgtgccactgcactacagcctgggcaacagagtgaaaccccgtctcaaaaaaaaaaaaaaaaaaaaaaatctaatctgagattcctcataaaaaattccagtaaaacaaactcaaaaaggcctaagtggtcatttttgctgcaattatgtaaataaccaggccaaatctaatgagaccagacttattttgtaaacaagagttaaaaaaggaagtgagtggagagaaaatttatgcttaaatggaaaactatagtgtacccttgtgggttattaaattctagtcctgttcattttttttttagctttccgttgtcaacctataaactggactggatcctgccatcttatgcattttctcaattattctagtttcctctgatagcctactacaagtttccaaactaacatttctaatttttccccaccttcctcacttggcatcactgagaactaaaactatgcttttcccaaagcccaggaagctgaagctgtaccacttggtataagctgaagaaatcaccacaccttttcatgtatgggtaacttcatgagaatctcttctttccttgaacaataagagggactgacaaagtctgtcttcttaagcaaactttaggcaggtttctctaagcctttttcttgtctaggccccattcttgcaatacctgcgtagcccagtttcagcaagaatcttgctaagttagttaagagaaaatctcttacccttgatatcagatcactcttgatacttggtcaaattgctcatcccccaccaggcaatatgtgatcaccctgacttgccttcagcaagaatactgttcaggctctataaccagaatccccctatatttcctcttagttatttcccatccactcacctccatcctgctccttggctataaatccctgcttgttattgctgtatttggaaatgatcccagttctatactgaggtctctttccctttattgtaatagtttctgaataaaatctgtttttactgctttaatcacttccagttctggttttctttgacattatcagaaatatataatatgaaagagcaattactgtcatgtgtttacactgacagatatttcagcttgcaattgtataaaaccagtgatgtacaagctgagttggtgctttgtgtacatagagaatgtccatgagggcgatatacttggcaactttttgtcttatttattactgaaaacctagggtatggaaaaagatacattgagatctgtgtgtgaaaaggaaggcaaggcattgctatgcaaataaaagaggtggcctctaagtggtaatttatattgttgtatttgcaaagaatagttggtggtcaaaaatacttcattaggttttgatttactgttgaaggaaatactgctaattattagtcctatcaagctgtagcctttaagtatgtacatatctttttggcatactatgtgaggaattgggctgtaagtataatctgactgttgaggaaaaaagagcctcatgttagtttttaaaatgagagacaatgaaaatattccctcataatgctgataacttgagtaaagaccattttgagtaacttatttgagcaacattgtcacagcagtatatttattcaataaatatactgaattgcttgaacctccacttcagtctcaaaatattccattttaaaaatttgcagatgacagattagagtttcttttgaaacaactgaacggtggtataaaaatggtttaaacttcaatgttttcccatacctttctttttttttctttttttttttttttttttgagatgtagtctccatctgtcgcccaggctggagtgcagtggcatgatctcagctcactgcaacctccacctcccaggttccagtgattctcctgcctcagcctcccaagtagctaggactacaggtgcgtgccaccatgccctgctaattttttgtatttttttttttttttttttagtagagacggagtttcaccatgttagccaggatggtcttgatctcctgacctcatgatccacccgcctcagcctcccaaagtgttgggattacaggcgtgagccaccgcgcctggccctcccatacctttcttttataatttctttgcttttgagaaagaaacacatgacttattgtctcatatgtttaaaaattctatcactgcaaatgtgagttacttacataatgcttcatgagaaaatgaaataatacttcttagagctaaaagcagttaaagaatgattagaaaatctatttactctgtttcccatgttgaaatggtctttctgcattcgtgataagtctgtcaatttaatgcctgatagagttctgaaacatcttcagtgatgaatctttgtaatttctaggttcacaatagtctaaatatccatttgtctctgacaaagccaccaaatgtttattgtcatttaacaatcgttaatggagaatcaagagtttataatttggttaatcacaatagaaactagttggatgtggaactcaaggacttgtggctcagagtccttgtcattgggtcaggtgttgacaatttgataacagcacaaacaaaatatagtctctttcactgataagcaatagtaataaatatgatattttatttaaaataaaatattttgaaaaagtatcttagtattgtggtccatgaatgctgaatatggatgctgaaataatatttgtcacctttgtaaaaaaaaaaaaaaaaaaaggtagttttggccaggtgtggtggctcgcgcttgtaatcccagcactttgggaggctgaggtgggtggatcacctgaggtcaggagttcaagaccagcctggccaacatggtgaaaccccctctctcctaaaaatagctgggcgtggtggtgggtgcctgtaatcccagctacttgggaggctgaggcatgagaatcgcttgaacctgggagatggaggttgcagtaagctgagactgtgccattgcaccccagcctgggcaacaagaatgaaactctgtctcaaaaaaaaaaaaaatgattgtgtttgttgatcacttactatgaggcaaacattctaagtgtaatgaactcacttacagtggtttacaaactgatgcatggagagaataatttatccagactcacccagctgttaactggcagaattaggattttaacagagtcagtctggtaggaaagtctgctctttcccactatctggcagagataaatagtactgtaggagtccctgagaggtcaactcaagtgtaagtattttatattttgaggttcctaaagtttttctctatgtcattaacatacaagttgcccacattattctccttgtcattattactacaaccagtgagtattttgatagaatacttctgggagaggcccaggcgcggtggctcacgcttgtaatcccagcactttgggaggccgaggcgggcagatcttgaggtcaggagatggagaccaaccccgtctctactaaaaatacaaaaaactagccgggcctggtggcgggcggctgtagtctcagctattcggagaggctgaggcaggagaatggtgtgaatccgggaggcggagcttgcagtgagccgagatcgcgccactgcactccagcctgggcgtcagagcgagactccgtctcaaaaaaaaacaaaaaacaaacaaaaaaaaaccttccgggagagaagcggttactaagaagggaatgctttatagacagagaaaggatcatttttatggtcatagattattttctagtcttggccaaatttttttttttggggagggtgtattgtggtccaaagacaatttaggtgactcataacctatcacctctaatcccccaggtgtctcaagattgcatgctcatgagagtatctcagtgagtgaatagcagtgtctcctctcattaaaaatttatgcatatcataaatacttttaaaaatgagagtgtctcagtgaatgaataacagtatctccttgtatgaaagatttacacatatcatactttaaaaagtttgagtttaatataaattcaaaaatataaatcagctttcctgtaagtatattaaaaacctttttatgaatagcaattcaaaatattttaaaacatttattttgcacagcttttactagatttatcttattgctattttgttcaaaataaatggaaactcaagtttatagtcttgctctaaatcattttttaaaatatcagatttcagaaagtaacgtttttggcttattttagatatacctgcttgctggctgttgtgtgttggggtagagctttctttttaaaatctagtagcaccctctagagcaaaaggtaaaatacaatttgataagaaaggagcagtttcacaaattcaaatttcctatccggagtaatagtttgttacttagaagtaccaaagagctggccaggcatggtggctcatacctgtaatcccagcactttgggaggccgaggtgggcagatcacttgaggtcagaagttcaagaccatcctggccaacactgtgaaaccctgtctctactaaaaatacaaaaattagatgggcatggcatggtggctcatgcctgtaattccagctacttggttggggggtgggggggtggtgggggagaggtgggcggggctgagggcagagaatctattgaacccggaagacaggggttgcagtgagccgagatcacgccactgcagcactccagcctgggcgatagagtgagattccctctccaaaaaaaaaggaagtagcaaagagctgaacctaatttttttttgctcaaatatatatatattcttatcaaggatgccttttaggtaagttcttcttacctaagattaaagattaatacatctttttcttacctccttgtgaatgtaatggtacataattttattttagaatggatattttaataaaattacccataagtattgaatttcttgttgaccaatataacatgctaaagttttattgtatgtccattttgtatgtgatagtgtgtttgttttgagaattacaaaatagagaataaaccacaccccttgtacttacgctcttatttccacttgttttttgtagtagagcatgacacatattgggtcttgtagtagtcttgagtaaaaaattatctcgattaagttaattaataatattattattgatatatatccattttctattacagaagaaaatactcaggaaacatcccaggtgaagaaaagtttgactgaaaaagtttctctctatagaggtgacatcacattgctagaggtagatgctatagtcaatgccggtgagtagttgattttcctgtgatgtgtttgttatgtaagtattatttcaaaatttttaaataaataagaatgtaagtattttagaaaaaaatgctttttgacgtagaaatgtctattctgtttctcttcttgattaaaaacattggagatctatttttttgtatgttctgcaattaatgtgcatctacagtaccctctacagtgaaaggcgctaggttgagattaggatactgcaccactggagaagtgacagattgttgcagaaagttcttcagaaagaactttagcaagtatattattgttactttcgtagcttgaattaatagttggccaacataaatacaagctcatcaagcttttttcttcttttgaataggttgtcaggtgatgattgaactatgtaagacaaaagtgaaaatataaagaaattatttcagttatttcaaaacttaagttgttagggttccagttttcattttcattatgaaatgcttaattttaaccagcatattttaattatttttaataattagttgtctagttaattttcctatttcaacattgggaaaaattttacagatgttatattttattatgtggctatatatcaaaaaagatataacagccgtgattctacaaaaatattgtaaatgagaggatatttaatgattttaatttgtgttttgtaaagttaggctgtttgaagtttgcaagtgtcaattaaaaacaaatctggacttaggtaaggagaggctttatctaaatagactatgacaataaaaggaggaggatgatttcaatagggggaggcagaatattgtgttatcgggaatgtttttccagagttcagctggttctggggaagggctgttaaggaggggttactcaccttccattgcttcagggtggaccaaagttcaggggttttgaggaaggagaggagcctgactaaagtttggtcaggtcgtttgtgggcattgaccaaccagaatggtaaatggggacaaagagtttggctaacatgtatgagacagagaatgggaatttggaaagtctgtttctggccttgtcattggttgcaaggtggtcatctgtcagttttatctagtaaactttcccagaacacaaaagggtaggggtaatttcttgactgtggctctttccaagaatacagagttcaggtgagtttcagtgttatctccaggtttcctttggtgataataaattcacagagaatagtaggaaagtgcattggcaggtgaacagaagggtctaatggagaactgaaacattgttcaaggatattgtacagctctggcaatttagcagaaagttcagaataccggtcagcttgttgttcccttagaattgggtatcagttacagctgggtgcggtggctcatgcctgtaagcccagcactttgggaggtcgaattgggtagatcacttgaaggtaggaattcgagaccagcctggccaacatggtgaatctcatctctaccaaaaaaatacaaaaattagccaggtgtgatggcgagtgcctgtagtcccagctactcgggaggctgaggcaggagaatcgcttgaacctgggaggtggaggttgcagtgagcagagatcataccactgcactccagcctgggtgacagaattgagaccatgtctcaaaaaaaaaaaaaaggattggatgtcagttgctttgtaccacagctgctttgctgtaatcaaggctcagttttctccttttcttcttctgatgcttctgcacttcctttctcctttgctgcttctgctgcctgtctaaaatgtaaaagtcttcttgagagaggaggctgggtcatttaattgccacccaatatgactcactccttcatcctcaggttacctcatagggtacaggtctctcttatatgtagtatctatggattgctcatttgtggccctgggtatcaagatgctttctctgtcccgtggggcctctgggggaagacaggcccttagaaagggtctcaggaagtcctctcctgtagttttaataagatatcactatagctagtaatttaatgtatatgccctaaattctataaatatatgagctttaattttaaaacatttaaaagattatatgtgtgtatatatgcataaaagatatatgtgtgtgtatatatacataagagagatatatatacacatataatcttttatatatatacacacatataaataaaagatatatatacacacatgtgatcttttatatatacacacatatgtatatgtatacacatgatcttttaaatttttaaaaattaaagctctgctgggcgcattggctcatgcctgtaatcccagcactttgggaggccaaggctgatggatcatgaggtcaagagattgagaccatcttggccaacatggtgaaaccccgtctctaccaaaaattcaaaaattagccaggcgtggtggcgtgtgcctgtaagtcccagctactcgggaggctgaggcaggagaattgcttgaacccgggaggcagaggttgcagtgagtcgagatcgtgccactgcactccagcctggcgtcagagcgagactccatctaaaaaaaaaaaaaaaaaaaagttaaagctcatatgtttatagaatttagggcatatacatcaatatatatagacacataaaagatatatatttatactcacatatgatcttttaaatttttaaaaaatgtttatatgtatgtacatatgtatataaatacacttatcagccttcctgtgtgttcttgtaatttctagccattactcttagttctgtcctgaggaagtacaattgatcatatctacttcctttttaaatacttgaagatcactctcacaagttttctccttcttgttattaagataacattgaatttgccacgttagcacacacttaatacagtaataatggtctttgttggattttgctgtcttcccatggaagccacacactagtgccattttctctttttgtgtcaactccccaagcaatgtcatctccttcttaaaaatatttaatactgtgtatttgttaaattgaattatttaatatgtatgattgaatttgtagatctctgactaataggacattcagcattggaaacgacacagtgaaccagttggctctggtgttttttatctgatcaattaatacaaatattttgggagtaattattgaaataaatggtgcaaaacagaagaacatcattaactacctcatcactattttgttcttttaaatattattatcttgctcttgcctaaatgtataatttttcatagctgctgcataatatataagggtatgatgaatttatatgaagacaggcagcaacttttgcttactcccaaaacgatttggtaattttagctcacctctctggttgtgatgattgtaatttggccatgttttgcatctcacaaggatagtctcatcaggaagatcccaggtagatagaaaagggatgccaagtgaatatacactgtaatggctctatttacagctttctactgtgcagtttgtttgcctggtgtggaaggagtggaacagctgttaacttttcaggtgaacaagacaacatggcaggaaactatagagctgcctctactgagagggggagtgaaaaacagtacccctagtcactatgccaaagcagcccagttgtcacctcctattagacttctgaagttctcatgaccatattagtacattggaacacctggtcttagttgctatgaatgaaatgatttcatattttaaacttatttctaataaagtgttttttgaactaccttaacctctttaaatgtgacccagggtggacttcttgtgtattatattcttctctctaggaaattatgcatatttagtatgttttaataaaacagattttgcaggcattatagtacacagggcagtagcacaagtttagagttaggcagacctgggttcaaaattcaggttatcataaccaaggccattttttatttaaactttttattttgaaataatgatagaaaagacaaaaataacacagagtcctatgaaccctgtgtaaacttctcccaatggtggctttgtatatagctatagtacaatatcaaaagcagattttaaaaaataatttattttagtttcagggagtgcttgtatacttgttacatggtatattgcataatgctgaagtttggggtatgactgatcctgtcacctaggtaatgagcatagtactcaatggttactttttcaaccttgccctttcttttccttcccccttattagtgttgccatttttatgtccatgtttacccaatgtcaaaaaccgaaaattgatattgttacattactgttgtctagactacagactttattcagttttaacaatttttaaacttgcattcatgtgaatgtgtgtatatatgtgtgtagttctttgtagttgtatttaatgaatagattcatgtgaccaccaccacaatctagatacagaactattccattatcataaaagaactccctcatgctggccgggcacggtagctcacacctgtaatcccagtactttgggaggtcaaggcgggtggatcatgaggtcaggagttcgagaccagcctggccaagatggtgaaaccccgtctctactgaaaatacaaaaattagctgggcacggtggcaggtgcctgtaatcccagctactctggaggctgaggcaggagaatcgcttgaacccgggaggtggaggttgcaatgagccgagattgcaccattgcactctagcctaggcaacagagcaagactccgtgtcaaaaaaaaaaaaaagaaccccctcatgctgccacctttgtatttatatccacccatctgcctcccttcctgttttccatctctaaggttttatcatttttagaatggaatataattctaaaaatacataatcaataatgctgcagtgaacatggcagtaccgatatccctttgacatacttttcagtttctttggatacctagaagtagaatcaacagatcatatggcagttttatttttagcttgttgaggaacctccatggtgttttcctctgttaacttacgttcccaacagtgtgcgggagttctcttttctctgcatcctcaccaacacttgttagctttcaacatgacaaaagccattccaacaggtgtgaaatgatatctcattgtggtttccatttgtgcttccctaatgattagtggtgctgagcattttttttcatgtacttgttggtcatttgtgtgtcttcttctgagaaatgtctgttcagatcctttgcctgatttttaatggggttatttgttttcttgctgttgagttctttaagttctttatatattttggctattaattccttttcagatgtattttttgcaaatattttctcccattttgtgggttgtctcttcactttgttaattgtttgctgggcagaagttttttagtttgaggctgtcccatttgtctgtttttgctttcattgccacagaaattgaacttacagtagagagtatggttaccagaggctggagggggattggaggaaggaaatggggagttgttgatcaaaagtttcaaagttttagatatacaggaggaataggttttgagatttatctcatagcagggtgactgtaataaataataatgtattatatatttcaaaataactaaggaagtaaatcgcaaatgtctcaccataaagaatgatagataagtgaggtgatggatgtgttaattagcttggtttaatcatccacactgtgtatatatatatcaaaacatcacattgtacctcataaacgtatacaatgattggtcaatcaaaataataataataataaagtcatgtaaatagaatcatacagcatgtaatcttttaaggttgccttttttcactaaatataatgctctgagggccattcagattgtattaatgaattaatgaatttatttattaattcagtaattgttcattcctttttattgttgagtagtggttcattgtatggatgtaccagagtttgttcaaccattcacccattgagggacatttggattcttttcagtattttgctgttaccgataaagcttttatgaacatttatgtacatgtttttatatgaccatacatttttgtttctctgggatagacatccaagaatgtgattactaggttacatgtaagtgcatgtttagttttgtaagaaactgctaaactgtttttcatagtagttgtaccattttacattcttaccagcaatgtgtgataggttcagtttttctacatccttgccagcatttggtggtataattatttcttatttattttagctgttgtaataggtgtgtgttaatagctaatcatgttttttgatatttattttttatttttaaatttttttctctgctgtttgaatcagcatcatcattattttaatttgtgtttccccaaaggttaattatgtcaaacacctctccatatgcttatttgccacctgtatgtctttttggtgaaatatcagttcatatcttttgccattttgtaatgggtctcagtgatatttgtgaattttgggcatttttattttttaaggccccaccctaaatcatattgatatatactgaaatatactacagcccacatccaaaacagtccatacttagttggatgatagttaattagttaatataatggcatgttttgtagatatttaggtaaacattaattttgattttgtacttttcatattttggaaacctaaattatctttttctaggctcttgaaaagctttttggtattatgctcatagtactaattataaactgccctgctgacatcagcttgattgggcaaattattcaaccctttaatcctcacttttgaaatctataaatagggataatactagtaattaagatcagacagatgttgtaaataatgtgtgaaaaatacgtagcacagttctcgcacaaaatatgtacttggtatagtttagctatggtatttatttttgtatggctactgaatggatttaatactactgctgtcttttctgagagaactcaggttagtagaggaaacggaggatatcttctgtgttaagcattgagattttccattattcagagccagttttccgctgaaaagcactggtgctcaagctagagcagctgctttcttcctgagcagttttcaaaattccacatatttttatatggatttgtctagttactaatatataattgacacttacctgtatgtacttttagtttgactctattttaccttattttttaaagacaggaatctcactctgtcactcaggctggaatacagtggcataatcatagctcaatgcaggcttgagctcctgagctcaggccatcttcctgcctcagcctcccaagtgctaggactacaagcacgtgccaccatgcctggctaattaaactttttttttttttctgtagagacagcatcctgctatgtttcctagggtggtcttgaactcctagcttcaagcgatcctactacctagacctctcaaagtactgggattataggtgtgagccaccttgcctggcctttgttttgattctggttttaaataaagtacaactgtctgtacaaaaaagaggtgttttcagaactagattgtctatacgtgatgttcagattctgcctcacaaagcagtatttttgtagaaaaaaattcagtatttactatgagtaaaagtcacactttaaaatcagttacctcatggggatgcttgaaaatattttggtacatatgcttagctctttacggttaaacaaacagattttcaaatgctgcctaaatagaggagtaagaaacactcatttgacaaaaaaaaaaaaccccaaaaataaacaaaaaaaccccaggaaaatgtattgagtgcttattatcagttaagaactaggttgaacagtggaggtaaagacaagtaagtaaacagttgctgtacagcaggatgaagtgtttattagagccacgtccaaggtgccatgggcaaatagagaaaagcaaacaactcaagaaagcaggtgagtgtatattgcacttaggaaaccacatgtggctgagtgtgcttggagcaaatacaggcagaggccagatcatgaagtgctttgtatgtcactttgagggctgaggtttttttttttaaaattttttttttattttttagaagatggggagtttttgaaaacatttttagggaggatatgtgttagagagatccctttggctgcagtgtgaaggataaattggggaaggattaagtttaagggggagactggaagcagaaatgaaactatttaactttgtactaagtacttcagcttaaataagtctgatttttcccctcctagctcataattgtagctgttgcttcttctgactctgccctctttaatggtgggatgattcttggatgattatgatttgaatgcagtttgatttggagtaacctcgaaaagcttaagtctattgtgactggattagagcagacaaatagaatcaaagtgtatttgttctttcaacaactttcttgaattctcaatttgtacatatgacatatcaagacactgctaatctggcttctgctaaactgttttcattaaaactgttctcaccaacgtcaccataacctctttttcttgaagtaatgggcccttttttgatccttgttttcctggatctctctgtagtatacaatactgttgactacttcatccttgaatgttaattttcctttagcttcagtgacacatttggtagtctcctctccttagctatacagccataaccttcatttaaatcacattatttcttacctagactattgcagtacactcctgaatgctttacttgcaaactcacctactctccagatgcagacaaaattatctttctcacattacttctctgtacagccacctttagttgctccccatggcccataagattaagggcaaacttagtgtgtcaaacaagacttgcttcaatatccctgccttgccagtctccagtccaccagtctcttgccactgacctgcaattttttctgtcccccaccgtttttctcatttctccctcccacccactttctctttcccccttttcctcctgggctttgcacaagctgctgcctctacctaaaatattacttctctaaagagtttcccttcctagcagttcctgcctcagtctttcagcatgccagatgtttcatctcctactggaagcgtggattcccctccatccttccaatcttgaatgagtgtcagtactatgggttccttagctttatacacttctgctagcatagcacataatctaatatcagttcacttatgaaggccaccgaaatgatttggatacatttgcttataaaggctttataagatttttaccaaaatgaaatcacaaaattaaaaaaaaattgtgggaaacttgaagatccccaagatcttcagatgccagtgtgagaaacacagccatagaggataggaaatgtaggactcaagtgagagactggaattaaagacatagattaagttagcatattaattttataaatatgattggtaagaggtattgagagctaaatgtgctaaattgttatgataacctaagaggcatatttaacagatgaagaaacatagccacggagaggttaagtgattcacctctggttatacagccagtaagtagatctagagcttgtgttcctagcatctttcctgttgaattctttcacacagaagctatgataccatcctaagccatctatctatattaaatatagataattccttagttgaccttttggctcttggaacactatcaaccaatatgtgatatcaggagtttttattaaaagcatgtagtaattatcatctctattaaataatacctcatgttttagtccttctctgggaatttaacaaccacatcttgtttgaattgactataggtcagttagtgaagtgctgacagtctgagcaggtctggaaacatggcctactgaagtgtagttgacctgcctttgacagttcattgtaactttggaaggattatatccaaatattttaaatgcaaaagaaaaatgttaccttgctcactgtgcaggaatagtaaacaataagatcattcctcttcttttcaaattttttggaagtgtttaatttactagtatgtaggacagaacgtatttacaatcaggtctagataggtataaataaaaggatgaattaaggttaaaaatgtctgtgggtcctagtaaattatattggcacacttttggactgagagtggattattttttctccacgtacagatggattctccatgtacagaagagatagacctggaagcaaatagatacagttcattgtgtataaagtatgtatcgagtactctttgttgatgcaaagagagttagtaaattatttgttttgatctaattcctgtgatgaataaattgtaattttgagtcagaattaattttcaggacctagatataagttattttaccttttttttttttttttttttgagacagagtcttgctctgtcacccaggttggagtgcagtggcacaatctccgctcaccacaatatcctcctccccagttcgagggattctcatgcctcagcttactgagtagctgggattacaggcaggcagcaccacacctggctaacttttttgtatttttagtagaaatggggttttgccatgttggccaaactggtctcaaactcctggcctaaagtgatctgcccatccggcctccaaaaaggattgcaggtgtgagctactgcacctggctagttttaaaaacagtctttgcatatatgccatatggtcagggattttattagttccttaccttgtttgagccatagagctaagaacatacttggtcccttatcttaacattgcatgtcctaaattgtgttttgagagaggataacagatgcatctactaatctttggcctcctgtctttctcccttcttgacatttacacacaaactttgcccatgggaagtttagtgcctttcctagatttctgaggatttgttttgaggatgcttacattttcatgattgcttctttctctgtaatatggttctagtaaatttccgatggccacagtttcctccttatttcttgccattgctgttttctctgtcttccctgcaggcttcatcccacacttagaacaacccaatatttcctctatttcccaaagcactactaatattatgggtagtaggtgtgtactgtaatttaagggttcatcaaacaggcctgccatcttaatgtagctgcatataggattatctgtttacagtgactaggtccttgtatagtcttataccaaacccattggtcaaagagctttggtcttttctagagcttggggataaatacatccatctgatttatggttcagtatgtcattagagacaattttacttgtactgtgccacaatcacagaaaaatattttggagaagatagattgcaggctgtgttatgaaaaacgaatgataactgtctaattgtaattggttggttatagccaaaaattaattcagtttgtcagaaaagtgatttttaaaaatggaaagtgaagaaagttgatttatttattttagctcttcctaccccatactacaaggagaggcatatttacattgtgattaattatagaggacttggagtcagatcaatcattattttaaatatgcctattcaacttcctggccaaataactctgacaaattatttaacctttctgaacctcagttttctcatcagcaaaatggagataatacaggttgaatatttcttatccaaagggctagaagtgtttcagattttttttgggttttggaatatttacatatacataatgagaaatcttggggatgggacccaagtctaaacatgaaattcatttatgttcatatacaccttatacacatagcctgaaggtatttttatacaatattttagaatacttttgtgcaataaacaaagtctgtgtatgttaaactgtcaggaagcaaagatgtcaagtgttgaattttccactcgtggtgtcatattggcacttaaaagcttttggattttagagcatttcggatattggatttttggactagggatgttcaacctgtcgtagagcctatttcacaggtctgttgtgaaaatctaaagaaatgatggccgtctaaagagatacaaagtacttcacacagtgccttatatacagacacatcagtaaatggtagcagaattatactccttagttttaatatttgaaaaaatttttatatgaatgttacaaggtaattatgggtgtttttcaagtcctgtacaaagatatgtgtaagaccaactaacagggtttattctgtgtccttcagctttagctgtgacagtatttacttgaattgcatttaggacaagttgtccaattctgaagttttataataaaagccaagtttttatgacattcttgtaatttgtatgaaccattgaccaaggaaaagaatggttttagtgtacgttaacaatgtgtttttactacattagttgtgaatgtcatacttgtgtcaaaaattgagatgatgtcataagattgtatagataaccatttaatagctgagcatgatttaagaataattgatgtagaatatatgaatttttatataggtaaataacatattaggactgcacaggatgaaaggaattgtacttattagaaatgttttattcacctctacttgcttaaaataaatgttatttttatgtatttgttcagtaaaactgaaatgaaataaggcatatttgaagttagaatttaagttattggggaaataaggttaatttactctcttaaatattttaggacacaattaacagtaactacttgattcagtttgaaatttcatctctactagcaaagcatcaaaagtcatcaaagtcaaaagtcattttgacttttcacaaagtttttgtattatatattttttctcttgactttctgttgagcagtaatagatccaaacacacacacagaaatatatagcttaataaattttgaaaaactgtcacacctgtgtaatagaatccagataaaaaagcagaacgtggctgggtgtggtggctcacgcctgtaatcccaacactttgggaggccgaggcaggtggttcacgaggtcaggagttcaagaccagcctaaccaacatggtgaaactccatctctactaaaaatacaaaaattagccgggcgtggtggcatgcgcctgtaatcccagctactcaggaggctgaggcaggagaatctcttgaacccaggaggcggaggttgcagtgagccaagatcatgccactgcactccagcctgggtgacagagtgacactccatttcaaaaaaaaaaaaggcagcagaatgttaccagtaccccagaagccctcttggcatccctggtaatgaatatagtgaagtgtatttactatcttgacttctagtaacgtggattacttttgcctgtttttgtatttcaggtaaattgacctatatatattctttagtgtttggctgtttttgttcactattatgcttgcaacattgatacataccattggttatagatgtagatgattcattatcattgttatgtaatatttcattgtataaatatgtcacaacttatatatcctatctactgttgatgagcggccttaagtagtttctagtctgggtgttttagtactgcaatgaacatggtaacacatttgtgtgtggtatttttgtaaatagatatctatatatttgtgttggatctatatctgggatattaactgtaaaatcataggatatatgcataggacactgttgtgtggttttcactttatacttccaatagcagtgtatgagagttcttattgctctagatccttgtcaacatttattttctatgtttttaaaaatagtgcataaattaggtcaactggtaatattttcattaatttgtaagatataccatgataaatcaaatttgatagcagtttgtagctaacaatccatgttaagccagcatttgtaagtgaagaaataaaaaatgtaaatgttatggtcatatggccaaggataagaagatggggttgttttatgtagttcctattgagttcatgaaaatacaaatgtatttttctcccatagatggcaacacttaggaacaaataaaccattgtattatgaaggtaatactattattattactactatcactgttaacccttcatcatatgggaagacaaagggaaaaaagtttttggaatgatattctcaaaactacatttggaaaaaaaggtaattttagaaaaatgtctcagaaagtctatttccatatgtgaaatattccataaagcctgtcattttgttgaacatagatattttaaaatcctgcagtataatcttaaagtcacattcaaaataggttgatattaatagtttgcttttgcatcgtagatatgccttattaataaataagattcgtctaatttcttatagtattaataatttaaagatatatcacattaatttttttccaactataacactgatgcatgtttattgagagaaaatatagaatagtataaagaagtaaaatgtgtcaaattttactatccagaaataaccactattaatacttgttttacatccctataggggattttagagactttaaatattatatatagtatatataaaaatatatattttttttattttaaatatatataaatatatatttaaatgtatttatatatttattttaaatatataaatatatagtatatatacatttatatataatatatataaatataatatataatatataaaaatataatctataatatatattacatattatatattatatatgatatataatcatatatcatatataacatatataatataatataatatatatcatatataatatataaatagtatatttatttttgattaatataatcaaaattgacttgacttaagttagttcaagagttttgacatctttaccgtattgtcctcccatctcggactgtggctggttgttagatttattttatcttttccccctgatatttgtcagtacaatttttttattatttattttatctgattattttggtgatataatcaatttgataattgtccaccttactgaagttaattataaaaacttttgagttggttcccttggattttctaggcatatacatttttatgcacactgcttctctgccctttttattccattggctaccacatggcaacaatattaaattagttatcataaggcattcttgattattcccgattttattgggaatgaccatagtattttgcaattcattcaataaatatttattaagtacctactatatgacaggcattattttaaatatgagagataaaatgatgagaaaaacagttataatctaagcccctgagtttacaacctagtgggaaattgtggtcaaagagttatcttaataaatataaaattataattatgtaagtttagcgttgatagattggggcttttgttgtaaatttccttttaaatttggctaattataaggaagcctaagtttccaactataaagcatttaggtccttattagagagagtttgcctgttaggaaagttgaaatgaagttaaagtattaatcacaatgaaatggttattttgtgtttataagcaaagacaaaataaaacctaaacagaaaaacccacctcatctatttttgacccctgtatctctgcttttaagggtctattccctggagttaaatattatagtaacatagtcttccaggagctttgttttggtctttaagagagactaaaagaaaaaaaaaacgtgagacaacagctgcttcggcatttattccatgttattttgagtttttaagcaaatagacaaaataaaacatcaatttctctgcatgatttctttaaaccttttgtgtttttttcttcttgttgactgagcacttaagttcatactttttcatattgctcttttttctttaaaataatttggatgtcttttaatgagtcttttttttttttttttttttttttttttaagacggagtctcactctgtcactcaggctggagtgcagtggcatgatctcggctcactgcaacctccgcctcccaggttcaagtgattctcctgcctcagcctcctgagtagctgggactacaggtttgtgccaccatgcccggctaatttttgtatttctagtagagacggggtttcaccatgataaccaggatggtctcaatctcctgaccttgtgatctgcccgcctcagcctccgaaagtgctgggattacaggcttgagcgaccgcggctggccttaatgagtactttcattgcttctgaagaactcagagggactcaagagcctgttgagaaattcattattaaaactgttaattataaagttactgaaatttcagacttcttaatttgggataaccatctaaataaacaattaacagctggctacaaactacttatagaatgatactgttaaagtttgggggagcaatagttcttagcatagaaacaataatgttcagaaaccacctcctgcctctctgcagatccaacccaatttccattcaaactaagtcagccaaaggggaaaaaatgactgcacaccattcacttcttttgttttccctcctctgctatgccagaaattgctggaaattgtccaaatcaccactgttgatagctgtcatttagtcaatctgtgggatatgtttgagtaggtgatggatgggaatatatgatataggatggggattgggatataggatatatggggatatatggggatataggatggggatgggaatatttggggatataggatgtaggatggggaagaacttttttttttgaagtggactctacactggttatagcttcatgtttgagcttctagctattaggatctcagtgtctttttaaaaatagtgtggggatagacagaaaacagcatttctatgaggatggagtgaaagaacaaatgaacatgagcttttgtaatgtgttaaattatcattttttgttgttatttagccctgcatctcagcgtctttttcttcaatctgacttatcactttgtttttctgatctatattttttttttctgaaggaatttgtgcagtcaaactaaacattaaatccttcaaggaattagaagataattctcaagagaaaataattgccagggagatggatggttgccaacaaattcccttctgagtttatttttttgttttcctactttgagccctgctatccctatttttaaaggaatatcttctgaagttaaatagtaacaaagtcttccagagtctttcttttagtctttgagagagactaaaaaatgcaagggaaactggcagccactgcttgggcatttgttccatgtttttagagatcgtcttctctctttgagaattcttcagtgcacttagggaaacttatattttgtttgttatacatactggtcaactgggttttttaaaaaagagaacagtttttttttccagtctgattataaaaggaatacacatgaatacttaagataggaagaatgtaaactagaataacagaacttcatctctaatgtttgtaagtatatatatcattgtttgttaaagttcagtgtttatgcttctggttattttattttcattgcatagatgtattttgtttttttacaaaactggtgcaatagtacattttaaaatttgaggactgcttacttttttgtttataaatacaatactttttatatgtaattttaaatagctacatgatattcaatcatatacatgaattttaatttatttaatcatcccctcattgttggaaatttaaattattttaagttttttactgttataagcaggctgcgacaaacatcctagcacataaatgtttgtagaaatctttgattattcccttggaggacattcccttaaagtgaaattatggaagcatgaaagttttaaaacttttttaggtacacacagacacacatacacatacatgtatatcttatatctacatacacacacacgcacatacacacacataaccaaatagctctatggaaaggttaaattaatttatatctcaaggtgtaagagtatatatttccctaaactttaccattattaggtttgatgaatttttttatgctttgtctttgaattatacttcaatgttgttttaatttccatttctttgaagacagggagtataccttttggtattaccttctgtaatagaaagcaggatcttacctataaaattttattggcaccaatagggtacaaagtaacttggtggtgggtagccaagaggcattggtgttggggtgggacttgaggagcaacacacgctgaatgtttttcagctaagaaactcagatagccgaagttcaatgtcactgcttctcctcctgaaatttaagatggtggggaatacagatgattgctgaagttcctcagagtgagagaggaactgtttattcaactttcagcatagtacctaccatgtagcacagcacttggcactggggatgtctatggctatggctttggttcttggagttcactcaggacagtttttctgaaactttgaggttttaccttaggcaagaagctctcaagtttctcccccagggctaagatgagagtggggatccattggtgacgtataagccagagcacttctccctttgcatccccagcttcagaagatggactaagccctcacatgctgcttttcatttggactgagccaattaaactgagactgtagaagagggaaccagtttctgggaaagtaaacagcagcgtttatattagtatgagggtcatagggaagtggattcttattctacctgtggttaacaatgaatataaataccctctgctgtagttcagttcttgtaattgcgtggcttgtcagaggtcaattatagtttaaatataagctgaactgtataactatactaactgataattcatgaggcctaggggctggctaatcctcatgtgcaaccttatttggaatattccatgcacttttactttttaaaatttttatttaaataatgagtaaggaggaaggctgaatagaagcccacaccatttgtctctcctgtaggaatacaaaattttaacaactacacaaaaaagcaccatcacaagaaccaaaaatgagatgaggaatcatagtacctgattgtaacttcatattgctgaaagatgcactgacgagggtaggaaagatgttcttgaatcaccaatgccacctcagccccattcctcggcattggctatgtggtacagagaatctgaatttggaggaaggagagcacagtgcctgggtgactcagtaaactcagcgctgccttgtcacagtggtgatcacagctatgctgggctcagccagtacctgtgcatggaaggagcatttggaccagacctagccagaggcgaattgcccatcccagtgttcagaatttgagcttcttagtagacctccccactgagggccagagtgctctggggtcctaggtaaactcaagaggcagtctagctcacaacgactgcagttcctatgcaactcctagtgctagtctgggcttggagccagtgaactagggtggcatatggcctagagagacaccaaatggggcagctaagggagtgcaccatccctcttccaaccccagacagtgcagtttgcagcaacaaaagtgactccttctttctacttgaggagaggagagcaaggagtgaagaggactttgccttgcatcttggataccagctcagccacagtaggatagggcaatgggcagagttgtgaggccccctttctggccctaacaggccaaaagagaacctgcggccttgaaggaaaggacccagtcctggcaggattcatcacctgttgactaaagagaacttgggccctgaataaccaacagtgataccagatagcataccatggaccttgggctctgagatgtgctggctttaggtgttacccagaacatttccagctgtggtggctatggtgaaagactccttctgtttgagaaaaacagaggggccacagtggggtagagtaacaagcaggttcttggacagcatttatggaactgccctgtgcctgtggggagcccactgccctgaagggtgagtcctaggcctggtagcattcaccacaagctgactgaagaccccttgggttttaagtgaacattggtggtagcctgacagaaccccacatgggctggtggtggtagtggccacagggagagtctcctctgcctttggaaaggggaaggaagagaaggaaggactttatcttgtggtttgagtgccagcttaaccgtggtaggcattggtgttggggtgggacctgaggagcaacacatcacgtaaatctctaaggtttttgactacagtccttggatctcagagagcattcctgaactcacctagggcctgggggatctcattgccctgaagggagggacaaaaatctggctggctttgccacctgctgattgtagagtactagggccttgaatgaacataggtggtagccaggtagtggttacagtgggccttgggcaggacctggtgttgtgctggcttcaggtctgaaccagcattgtcccagtggtggtggtcacaaggatatgtgtgtccctataccctcagttccaggtggctcagcatagagaaagagattcagtttgtttgggggaaagtaaggggaaaataataagagtctctgcctagtaatccagacaattcttccagatcttgtccaagaccaccaaggtggtacctttatgagtctgcaagaaccacagtgtttttgggcttggggcctaagtccctttgaatacctggaaagtctttccaacatggaggggcacaaacaagcccagactgtgaagactacaataaatacctaattctttagtgcccagacaccagtaaacatctacaagcatcaagagcatccaggaaaaaatgacctcacccaatgaacttaaataaggtagtagggaccaatcctggagaaacagagatatgtgacctttcagacagacaaatcaaaatagctgtgttgaggaaactcaaattcaagttaacacagagaaggaattcaaaattctatcagagaaatttaacaaagagattgaaattattaagaatgcagtagaaattctagagttgaaaaatgcaagcaacatattgaagaattcatcagagtctcttcttaatagcagaattgatccagcagaagaaagaattaatgagctcaaagacaggctattaaaatacacagtcagaagaaacaaaagaaaaaagtatagaaaagaatgaagcatgcctacacgatctagaaaatagcctcaaaagggcaaatctaagagtattggccatgaagaggagatagagaaagagatggggtagaaagtgtattcaaaggaacaatatcagagaattccccaaacctagagaaagatatcaatatttcagtacaacaaggcagatataacaaaaaagactacctcaaggcatttaataaccaaactccccaaagtcaaagatagggaaaggatcctaaaagcagaaagagaaaagaaacatataacataaaatggcacttcagtacatctggcagcacctctttcagtggaaaccctgcatgccaggagagaatggtatgacatatttcaaatctgatggaaaaaacccctttgccctagaatattatgtctggaaaaaatatccttcaagcatgaaggagaaagaaagaccttcccagagaaagagggattttatcaacaccagaattgacctacaagaaatcctaaagggagttcttcagtctgaaataaaagaacattaataacaataataaattatctgaaggtacaaaattcactggtaatagcgcacagaaaaacagaatattataacactgtaattgtggtgtataaactactcaagtacaaagactaaattaaccaatcaaaaataagtacaacagcttttcaagatatagacagtacaataagacacaaagaggaacaacaaaaagttaaaaagtgggggatgaagttaaggtacatggtagttattagtttttttttcttgtttatgcaatcagtgttgtcatcagtttaaaatattgggttataagataatgtttgcacgcctcacggtaacttcaaattgaaaaacatacaatggatacacaaaaaataaaaagcaagaaattaaatcatgctatcagataaaatcactttcactaagaggaagacaggaagggaagaaagaaggaagagatcacaaagcaaccagaaaacaaataacaaaatggcaggagtaaatccttacctatcaataataacattgaatgtaaatggacttaagtctccaatcaaaagacataaagtggctaagtggataaaaaaaaaaaaaaagctagacccaatgtctgttgcctacaagaagcacatttcacctatcaagacacacatagactaaaaataaagggagggaaaagatattccatgtcaatggaaagcaaaaaagagtaggagtagctatacttgtatcagacaaaatagatttcaagacaaaagctgtaagataaagaaggtcattatataatgataaaggggccaattcagcaagaggagataagaattttaaacatatatgcacccaatgctggagcacccagatgtatacagcaaatactattattagagctaaagagagagatataacccaatacaataataactggagacttcaacaccccactttcagcattggacagatctttgagatggaaaatcaacaaagaaacactggacttaacccgcactatagaccaaatggacctattagatatgtacacatcattttgttcaacgtctgcagaatacacagtcttttcctcagcacgtggatcattcttaaggatagatcatgtgttaggtcacaaaacaagtcttaaaacattcaaagaagttgaaataatatcaagcatcttctctgaacacaatggaataaaactagaaatcaacaacaagaagaattttggaaactatacaaacacatggaaattaaacaatatgctcctgaatgaccagtgggtcagtgaagaaattaagaatgaaattgaaacatttctcaaaacacatggtaacggagacaaaatgtaccaaaacctatggggtataaagaaagggaaatttatagctaaaagttcctacattaataaagaagaaaaacttcaaataaataacctattgatgcatgttaaagaagtagaaaaccaagagcaaataaaacccaaaattaatagaagaaagaaataataaagatcagagcagaaacaaatcaaattgatatgaagaaaacaatacaaaagatcaatcaaataaaaagtttggtttttgaaaagataaataaaatgaacccatatttagccagactaagaaagatagaagacccaaataaataaaatcagagatgaaaaaggagacattacaacgaatactgcaaaaactcaaaggatcactagtagctactatgagcaatagcatactaataaattggaaaatatagttggaaatggatatattcatagacacatacaacctatgaaaattgaaccatgaagaaacccagaacctgaacagatcaataacacattatgagatcaaggccacaataaaaagtctctcagtaaagaaaagcctgggacccagtggtttcattgttgaattctactaaacatttaaaaaagaatgaataccaatcctactcaaactcttctgaaagtcattctgtaaggcaagtattaccctgataccaaaatgaaagacacataaaaaaaacaccaaaaacacaagtacaggccaatatctctgatgaatattgatacaaaaatccttactaaagtacaagcaaactgaattcaacagtacattaaaaaaaccatttatcatgaccaagtgggatttatcccagggatgcaaggatggttcaacacatgcaaatcaatcagtgtgatgcattatatctatggaatgaaagacaaaaaccgtatgatcatttaaattgatgctgaaacagcatttgataaaattcaatattccttcacgtttgtaaaagatctaaaaaaactcggtatagaaggaacgtatctcaacataataaaagccatgtatgacagagccacagctggtatcaccctaaatgggggaaaactgaaagcttttttttaaagatctggaacatgacaaaaatgcctactttcaaccactgttattcaacattgcattgggaattctagctagagcaatcagacaagagaaacaaataaagggcttccaaattggaaagaaagaagttaaattatctttcttttcagatggtatgatcttatatttggaaaaatctaaaagcttcaccaaaaaacaaatagaactaataaacaaattcagtaaagttgcaggatacaaaatcagcatagaaaaatcagtagcatttttatatgccaacagtgaacaatctgaaaaagaaataaaaaggtaatcccatttacaatagctacaaataaaattaaatacctaggaattaaagaagtaaactatctctacaatgaaaactataaaacattgatgccagaaattgaagataacacacacacaaaatggaaagatattccacattcatggattggaagaatcaataatgttaaaatattcaactacccaaagcaatctatagattcagtgcagtccctatcaaaataccaatggcattcttctttacagaaatagaaaaatcaatcctaaaatgtatatggaaccacaaaagacccacaatagccaaagctatcctgaacaacaggagcaaaaactggaagaatcactttacctgacttaaattatactgcagagctatagtaaccaaaacagcatggtgctggcataaaaacagacacatagactaatggaacagagagtctggaaacaaatccatacacctacagtgaactaattttcaacaaaggtgccaagaacatacattggggaaaagacaatctcttcaaaaattgatgctgggaaaaactggatatccatatgcagaagaatgaaactaaacctatatctcatcatatacaaaagtcaaaccaaaatggattaaagacttaaatctgactatgaaactactacaagaaaacattggggaaactctccaggatattggtctgggcaaaattttcctgagtaatacttcacaagcataggcaaccaaagcaaacatggacaaatgggatcacatcaagttaaaaagcttctgcacagtaaatgaaacaacaaagtgaagagacagcccacagaatgggtgaagatatttgcaaactacccatctgacaaggaattaataaccagaatatgtaaggagctcaaacaactttataggaaaaaaatataataatcccattaaaaatgggccaaagatgtgaatagacatttctcaaaagaggacacacaaatgtcaaacaggcatatgaaaaggtgttcagcatcactgatcatcagagaaatacacatcaaaacttcaataagatatcatctcaccccagttaaaatggcttatatccaaaagacaggcagtaacaaatgctggagaggatatggagaaaagggaacctttgtacactgttgatgggaatgtaagctagtacaatcactgtggagaacagtttggttcctcaaaaacctaaaaatagagctaccatcatccagcaatcccactgttgggtatataactgaaagaaaggaaattggtatattgaagagatatctgcacacgcatgtttgttgcagcactgttcacaatagctaagatttggaagcagcctaagtgcccatcaggagatgaatggataaagaaaatatggtaggtacatatatacacaatggagtactgttcagccataaaaaagaatgagatccagtcatttgtaacaacatggatggaactggaaatcgttatattaaatgaaataagtcagggacagaaagacaaacttcacatattctcacttgtgggagctcaaaaaatcaaaacaattgaattcatggagatagagagtagaaggatggctactagaggctgggaagggtagtggggggttggagggtaagtggggatggttaatgggcacaaaaaatagttcaaaagaatgaacaagggctagttttgatagcacaacagagtgactatagtcaatagtaatttagtggcacattttaaaataactaagagtataatttgattttttgtaacacaaaggataaatgcttgaggggatggataccccattttccatgatgtgattattacacattgcattcctgcattaacatatttcatgtactccataaatgtatatacctactatgtacccacaaaattaaaaaataaaattgaaacatttttgatgtatagttttattaattttagttgaaagaaatgtatgctttatttgttacatatacaggtcaacttaatttctaaatattattttttacttttttatttgtgacttttaagcagctgctacctttgtagattctaaaaaatctggatggtattcattttctcctattgtcttaatataattgcacacatttggccattttttgacttaatttttctggaaaaatgacatttattattgaattccagtctttaatttacataaaaattaggcaccagaaagagtagtggagtaaaatagcttatcagtagataatagacatcctcatattttcatgaaatataaatctatacaactttaggagtttcagaggaacttaccgatttattaactttgcgttgggtgaatagctcttttatgatgtgaattctgtatctttaaaaaggatacttgattaagaacagtattcttatttgtagcccaaatttgtgccttttgaataataatggtttattaaacttggtgttgtgtaaaggaagatttggccattttgataaggaaaggttgagaattatttttcaacattcttctctagtttacctttttagttatagaagcaccccatgtttggtttacaataagaatagaaataaatattttatttttacatactgttagtacaaaggcagcagctttttcactactcattttatttttgtaaatttgaagcaaatttatggcatgaaatttccccagcttcttttgaccttgaggtgcaatatgatttgctttgtgaagttttaattttatgacacatcacatttctgtcatgtccaaaattaaacttcagggtaggtgtatatttttctacactgggattatgaacagaataaattatcagagaattatgtttaaatgaatatataagtataggaatgtataggcttagctacatctctctacataaatagcttgttagtgtgcaatcagtcactggagttgccatgaacttggagcttaatgaacaggtggagaaagaggatgaattccagttcaaaatggatctgacagcttatcaggcaatttcactgatcgctaatccagttcgtttggcaacttaatttatcacacagttagaattctcatcccgtgggtttccaggtggaaattaattctggaacatgtccattaccactgggttgaagagacctgcttaagctttgtgaggaaatttagaaataaattattttaaatgcataagccagatttctcttatgattccctttgtgtttatccaattccttcttaaaatatttggatgctgctagcatttgatggtatgcccatggaggtgaactaaggtttatttattcattaatatttataaattaaatggaagaaattgttaatcctaattaattagtgaaataactactataatagataatcctgtgaatataattctatctttaggtatagaaaaattgctgatctcgaacatgttttaagcatttcatagcaacaaataatgaacagaagaaattatttccttaaagctcacaaatctatgtcttctgagtacttacaaattctctaattagtctgatttacagcccattattttatgtaaaagtatctgctaaagcaatttccttgacaataaggaagaaatgcgacttgcctctcacagctcacattctgactctgtttggaattcccaaggatgagtctaattaaatgggcttggcttaggacctggctgtagcttaaaataccttcaaaaccagaaacacattttctccactttttaaagacttgatttatagtgcatagaaagttaaattgaatattgatccttgaaaagcaaatgtgtcctgtaaaaaatgacaacaaaagaatacaataaaagatgacagagtgattgattgtccaaagcctatagatagtagcctcccccttttatgtcatcttctctaggcatctgtagctctgagagggtgatagggatgaagtgttagaggaggattagttgcaccctgacatgaactgttacattttataagaagattgaggaaggtggtaacaaattatttctaagaaggaattttgagaaacgaggaacggggcacaagatcagtaagacctatgatataactccaggaagggacacgacggaatttcttataatttctcaaactctgaagcatcttcaaaaagaatttaagtcagtgaaaaataattgagatgatagaaaactacaaactggcgtaacagtgtcattgattggatatgtcaggaaaattgtgcctatcattcttatgaccaggcttattaaagtaatatcttcataatctagaggggctcagtgttggatcatcctggcatccttctcaaatcccttttctgagtccttggcatttttccctggagcatattgcagacctacaaccttgtcatttcagaaactgtcctttcatttttacctttgaagggaaatggttactgagtccagtactagcccttgggaatcaagccaaaagaaaaaaatggtagggcattgtttgattttctcctcctttcctacaagagcagtggttgcgtcaaaggttcagtgggtattggaatcaccaagaaggagataatgatgatgataaagcacagtggatcaattcggggttttcctcctttttttaaaatgtttttcctattaccatcactgtcactgtgatgatgataatggtaataggaaaaatatataaaacaaaatggggaaaaccgtaaatagacccagtgtgctttataacatttctgatttactatttattactcctcattatttaataaagtgtcccatgtactatgcaaatggcagacagtaaaacccccaccatgctgtttagtgaaatgtgaggatcatgtataaaaaatcctcaagctagacttaggttggatgaagaagacagtgagaaatcttgtctttttaggttaggctttcttgtttttcctttgtttaacttttgtttcttcaaatggcttgcagcttggaagagacaacttttggtctaaaaactattttggttgcggacagaggcagtatcattgaaaaaacagtgtgttcaccaattagaagttcatattgcttttaattctgcttccaacagttttgggacttgaagagtgaaattgagatttgtgtattttttcttcagtgctgcataaatggccatttatggtaaaacctgagaataaaggaagaccaaaaaaagcaaaataaaataagacagaaatacacaaattatagtgattctgatttttccttatgaaacttgagatccagtaagtaaacttcggttggaattattgggcattcaaacattatcattcacataagaaaaaggctccctgtcagtaagccgagatattagatgtgtaaatataatgagccatttgtggagacaccgaccagattgccctgcattgtgatagaattgatgtaatttgagtatcagatggggctgattggtgaatcttgagaagacagttacttgacagcaatgatagattttgaccctgttgtaactggtatacttgaggtaggaagcaattctactcattctgtcaaacggaggcctccactcataaagtgaactattatttagaggatcttgtcttcttggctattattaaaatgcaatttttgtctaatcagctgttattaaaacgcaattaccaaataatatattcttctcactatggtgatttgacagatcaaaagctttctgagggcagagactgcgttatccgtttacgtatctccaatgctttgtatcatgtctggcccattgttagtactcaaaaagtgtttgcggaattaatgaatggttgagtaagttgcttcctataatcaagacttttagttagaatggtggtaaatttagacttagaggattttgtactttgtatcagtggggctgccctaactggtggatttattttttaatgcaatttttttctttttatttaaaatttctttggaagcacagatgatattataaacataataatgtaaataaagtaagaagaaataaattactgattactccaccttccagcagactgtgttgattttttcctgttcatctctatgcatttatatacttttttgtttgcatttttatgacttagaacccagatttgatgtgttatactgagttttctacttaatattaacatttttaatatagtatttaggccaggcacagtgactcatgcctgtaatcccagcactttgggaggccgaggcagttggatcacgaggtcaagagatcaagaccatcctgggcaacatggtgaaaccccgtctctactaaaaatacaaaaattagccagttgtggtggcatgcacctgtagtcccaggtacttgggaggctgaggcaggagaatcgcttgaacccgggaggcagaggttgcagtgagccgagatcgtgccactgcactccagcctggcgacagaacaagactccatctcaaaaaaaaaaaaaaaaaatgtacagcttctaattttacatggctacatagtatattctttactttgtattccccctcaacaatattctatttccctatcgctttatctttctattgaattcctactcagctttcaaggtcccatttaactttgcaacagtcttccaatttctgttgactcttatgatccttgtactttacgtacagtgactatagaacttttgatactttaacttttttctttttatgaaaattatgagaaataaggtacatcagagcatggattacacaactctgtgtcctgatgcctaactcaatgttggtcatgtagttggccctcgacaaatacttgcagataacattctaaggtctgggaatagagggataaatgagatatggtttctggattttatgctcaaagtatattggtaggcaggtaggcagatatcatgtagaaactgaccttctagagttgtttatatggtgctaggaaaaccgagaggaggccagtatattcacagcatagctttttcttcttaataatcttttttcctctactttcaggaatggtatgtgtaggctaaggagttctcacattttcatgactcttcatttcctttggaaattattttctaaaagattccatttcctcatgtttgcttttctcatgccttgtttgcccatgtcacttgctctttttcatttggtatcttgaaatatagtttttcaccacattatataatcttcctacataattgcagcaggcaaagttctaagatgttcctcaagattctccatacttcccccaccaggatacaggccctgagtaatccctggggctataaatttgatggattttacttccatgactaggttatataatatagcacatttaagaaaggaagattatcaggatgggtctgactcaccgtagtcatgattatgactacattaatcctttgaaagtacagttttctctgtacttctggtctacaaacatgtgagctaataaatgaatattgttttaagctgtcgagtttgtggcaatttgttatacagcaataaaagtgaatacaatagtatattaaccatttgtggtatttgctacatatatattttttagtttatcttgctataagttttgtttgtacaaaactcggcttcttcatataattgcatctactgaagatttgtttctttatgatttctagtatttcttcaaagtttagaaggcattaaacagggtattgttggtaggacgcacagaggatttgagtctgagtgtcaaataattaatttgattagactctgccactggcattcttttgcataataatttataaactttcaacctgaacattgactttctccattgctacttagctgaggagaaatacgaattctcctttggaaaagtttggggatttctagaacactaaaccattctttttgatgattgaatggaactttcaaatcttatatttcaacacgaatggggatctcacaatggaaggcagctccctagaactatgctgttagccctttccttcaccataatacttggcaagagacaacttacacagacttttcatttttattctacccttcttccaaattctctggatggtctagcctgtattgcctgttgttttcagtgttgttctgatctcaaatgggcttccacaagtggctagaagggattagttttcatatttcttccattagttcagtattgaactaaaaagcatggttataaatgacaactttagtgactgtgattttttttttttttttttttttagacagagtctgactctcttacccagattggagtgcaatggcgcgatctcagctcactgccacctctgcctcccaggttcaagcaattctcctgcctcagcctcctgagtagctgggactacaggcacccgccaccatgcttggctaatttttgtatttttttagtagagaagggatttcaccatgttggccaggctggtctcgaactcctgacctcaagtgatccacctgcctcagcctcccaaagtgctgggattacaggcgtgagccaccgcgcctggccaaatgactgtgatttttttttttttttttttttttttgagatgaagtttcactcttgttacctgggccggagttcagtaatgcgatcttggctcactgcaacctccgcctcctgggttcaagtgattctcttgcctcagcctcccaagtagctgggattaccggcgcctgccaccacacctggctaattttttatatttttagtagagatagggtttcaccccattggccaggctggtctcaaactcctgaccttcaggtgatccacctacctcagcctcccaaagtgctgggattataggcatgagccatcgcacctggccatgactggatttttaacacccatccacattattggtcactgttggtgcttcaagtgtttctgtaacattcctggattgacactaaaaaaaatcctaaacaagagaattgttactattatggatacatttgttctttcaacttacaaatattaaggacctactgtctgctagctctgcaggcctcgccattttttgccttttccatttgacacttatatgtcaaatagcctgtgctaagaaagtccttaatgctacaaaggaaagtaaatgtacttatatttgttgcctgacttaacaggaatatataggcaaaagctagtagttatgctgaatttaagacagtatgtttggtctaatatccagaattcacaaggaacttaaatttataagaaaaaaaatgaacaaccccatctaggcaaaggatatgaacagacacttctcgaaagaagacatttaaggccaggcacggtggctcacgcctgtaatcccagcaatttgggagtccgaggtgggtggatcacttgaagtcgggagtttaagaccagcctgggcaacatggtgaaaccccttctgtactaaaaaaaatacaaaaaattagccaggtgtggtggtgagcacctgtaatcctagctactcgggaggctgaggcaagggaattgcttgaacccaggaggcaaaggttgcagtgagctgagatcatgccactgcactctagcctgggtgacaagagtgagactccgtctcaaaaaaaaaaaaaaaaaaaaagaagaagacatttatgtggccaaaaaacacatgataaaaagctcagcatcactgatcatcagaaatgcacaacaaaaccacactgggagaccatctcacaccagtcagaatggtgattattaaaaagtcaggaaacaaaagatgctggcaaggctgtggagagataggaacacttttaatctgttagtgggaatgtaaattagttcaaccattgtggaagacagtatggttattccacaaggatctagaaccagaaataccatttgacccagcaatcccattactaggtatataaccaaaggaatgtaaatcattctactataaagacacatgcatgtgtatgtttattgcagcactatttacaatagcaaagacatggaaccaacccaaatgaccatcaatgatagactagataaagaaaatgtgatatatatatatatcacatgtattatatatatatatataatggaatacatgaaatcagaacaccatggaataaaaatgaatgagatcacattctttgcagggacatgtatgaatctggaaggcatcatccttagcaaactaacacaggaacagaaaaccaaacaccacatgttctcactcataatgagttgaacaatgagaacacatggccaccgagaggggaacaacacacaccagggcctgttatgggtggggggtgaggggagggaacttagaggatgggtcaataggtgcgacaaaccatcattacacatgtatacctatgtaacaaacctgcacgttctgtacaggtaccatttttttttagaaggaaaaaacagtatttttatttttataatgtaagtgtgtgataatttgtttaaatctaatattgtttctattagcttaagttaagcattgagacaaaaattggaagcatggaaatgagaaaactctagtaacgattctgtcaggggtgcatagtcattgtgtatagattaggaggtagaaagtgatcccgtcttatgattttaaagtttgaaaggaactgaaggataatccaggccaaatgcttcatgtcatagatggggaaacagagtcctagagagaggaaataacgtactcaaggacgtggaggtcctatgtggcagaaccatgcgtaggaccctatttcctgttactcacttcttttcctttccttgatttgggttgctttgttactggtacttaataattcggtagaaacttgacatgtacttcatgatattaaattgatattgtaggttggactctggaggggttttaggactccttgtcttttctgtgggattgaaacaatatggtttctattaaaatattcagtgacccttctatcttttgaagtatttggttagatgaaatgtggatagtaaccaaaacctctataagtagtattatactttggtctgattgaattactgagcagttttgtattattcttgttgagtatttttggtttgttggtttgaaaaaggaaacagttctacagatgtgtttttttctagtaacttctgactgcttttctattgatctcctttttacgtcaaataataaagctaaaagaagctttgttatgtcttttaacaaaatattgatcttttattggtatgaaaacatcttggttgttaaattgcttcattaattttatacctcttttatattgaagtctgtaattgtttggtgtaagagttactccagttactgcttgttttaaaattgattttccttttaatttagagacataaatgaatcattttttcccctttaatttcttcctgctatataaaagacattaaaacttttttaggctatcaataatattacataggtctttttggataatacagtcctatgttgttggtgaaggttctaaacctgctagtcttgcctagtttcagatattgtctggtaaaataacatcactatattatgcatgcagctactccaatacatatggaattcaggaaacttggatttgaattgtctctcttttagttattatctgtggcaagtcacttagctcctctcagtatctctgtttcctcatcttttaagtggagacaataagatttttagagtccttgtatggactaagtaagataaagcatgcatccctggcacattgtcaatgctcataaatagtagctgtaaaaatactgcacctagggtaaactatagaacagtatatttattctgaaacattattcctgttagctattatttaattcacccagcttactttcctcatcagttaatctgtaacccttttctccttatataaaagacttggaattatttcattgagggaggtcaataagaagattcccaaggaggatctgattaaagagtatctattttccccatgataagatcaataattccttctcaagggggtgtcagaacgaatatttgaaaattaccttccaacaaactctttctttgcttctgggaatagtacatatttggaaaggagacaataaatagatgggcagtatcttgtgcaggagttctgaacaactatagaatgcttccatctgttcacttttcagttttgttctccttgactttcctatcttagactcctgaggttgttagatgcacccctctcatccacacagtgactgtgtctatctatctggcccataaaactcctttccagtatgtgagaaatacatccgttatacaggattagagacagtggcatcgtcttccacactgtagtttaactcaggcctggcaccaaactagtgttttttgatgaggttgttatcaggcaagagaatgaagctagttctgtagtatggtaccacagagaaattagcctgtttcatgaacaaatgcagataatagggtacataatttttagtacttgaagcatagccatgagtgtaatctgattgtcggaaagtatacaattcttaacctatggcccttattttaaccaaacatagtctgaatgttacaaaactttaaattatttatagaaataaagtcattttatcattgattatctgaagctcctgtttttgtccttgataaatcatataggacctttagttacctctccaatttgcactctctctgtatttctggacatatcaacaaactatttctcagctgctatgtggcattggtcatactgtttctctcctacccaaatgctccttgctgaaggagcctcaccttcatcagcactgcagcatccatggtaaagatgtagggaagacaactaagaccccagctccatgcttcacctggtcacctaggccctttgaagaaatcttgcagtgcggcataccattagtctcccttggacaagaaaatataaagtcctgcctccctagataccagcctacctaacgaagccttctaaaatagtgggctttagaaaatcaaatctcgtatctgaagatagtggtaatcatcaatgtttcagaaaggtagcatttctggcccttgagtgcacttataaaggttgatgaatgtcagtggtttctggcaggtttaatgcttaggcaagggaaggaagggaggaatcaaggaagaataggaaatagtgaagagagtaagtaaacagtggggaaataaaaatatgtctgtgatcagcagtggtaaaattcccctgaaatttgttagagatacaacttagtagttgcctgaagatgcttatctttccctagtggtatttaaaatctctctctcctgccactagcattttagttctttctttcttctttcatgtatgtttaatttttgaaaataattggagatttatggtagtatcagtggtattttttccattttttttctcttgaactatgttttctttgctccaaaaagcaaatggcagtcttcaaaggacgatttgtttctatttgtataaattgagtataagctgcatccaattcctagtgcatgcataaaactctttttgaggaaatgtgaccaatatataacattttattgaatgtttcttgaaattggtgtcaaactgttttttatttcatttcttttgggatgcctaattgaattgaaacttcattatttcattccatggcttaggccacctttagagggaatataccatgtgagctcctacttacccattaagaccagatatccactagggacttaataggctaatgtgttcctctttcacctcctatgtcctaaatttagcattagctaaattgactaattaaaataaccctagccttattcctcttcctagtggatattgttttatttaaacatttcatcacagaacttggtacaattgttaggcacttcttacatgatcctggaactgaaatgtcagatgcgtgtagggtattataacctaaccaaccataatgagataccaggatggctatgattaaaaataaaggaagtggtgagaatggaataaaaagtgctgcagaggatgttgagaaattggaacactcaaacatggctggtaggaatgtaaaatggtggagccactgtagaaaacattttggggattcctcaaaaagttaaatataaacttaaccgtggaatgacccagccattccactcctaggtataatgcccaagagaattaaaaacatatgttttcgcaagaactttcacatgaatgtccatagcagcattttttgtcatagcccaaaagtggaaacaactcaaatgttcatcttctgacgaatggatacacaaaatgtggtctatccatacaatgaaatattattgagctatagaagggaatgaaatactaagatatgctacaatgtagatgaatctcaaaaacattgttctgagtgaaagaagccagacacaaaaggttacatattgtaggctttcatttatatgaactatccagaatagataatggaggcagaaagcaaaatggtagtagccaggggatgacagaaggaggggatagggagtgactgtttaatggatatgagatttaatggatctgagatgaaatgtcttgaaactagataaaggtggtggttgcacaacattttgaatgttctacatacaactagatttcacttacactttcaaaaggttaactttatgttatataagttttacctcagtaaaaaataagcaaactcacagaatttagagtgaaattctaaaatcttgacagccacttgctcccttcattttttcgggactaatcttgtataatttcaggcttaggctaccttgttggggtaagatcagttttaaaattcataatgctttttttctaaaacaaagtgttcagtaaagataaacaaaaagaaaaattagaatcaccataattgtaccactcagaacaattcttaatatttttgtatgtgtatttcctgtgttttttccagtgtgtaatatatgtacacatactctatacatgcatgtacatatttgtgaaatagggtcattttgcatatagtgtttataacatacttttatcatttaatgatgcattagaaaattatttggtctattttctatagtttcacaagtatacagcataactcttttaaaatatgtcttcagaaaaaaaaatagcagcaaaatagggtaaagatcatgtttcatttgtttttgaatccctggagttgttcaaaagaaatagccactttattggattgggttggactggattggattagattgaattaaactagaataacttctagaaaccaatgaagaacttctgaaatattcaacatcttgttttgttataatactctcttagcttcattttagttggtgacttgatatacccctttttcccttcagggtgtcaggattgtagaagcctgagtgttacgtgaagcaaatgtccccatgtattctgttttagtttactatagctgccacaacaaaataccatagatggggtgacttaaaaagaaaactttattttctcacagttctgaagggtggcagtccaagatcagaccagcaggtttagtttctcctgaggtctttctccttggcttgcagatggctgccctcttgctatggcatcacatgtccttttctctgtgcatgcgcttccctggtgtctgtatgttctcatctctactttttataaggacatcagtcaaattggatcagggcccaccctaatggcgtcattttaacttaattacatctttaaaagccctatacaaataaaataaacacattctaaggtaatgggggttagggattcaacatatgaattttgggggtccatgtaggcatacctcatttattgtactttgctttattgcgttccatagtgtgggtgtgtgtttgttaattttttaaagcaaattaaaggtttgtggtaaccctgtgctgagcaaatctgttggcactgttttttccaatagcataggcactttgtgtctccatgtcaaattttggtaattgtaatatttaaaagttttcattaaaaatttaaaacattttcaattattatgggcacataatagttgtgtatatttctttttcattattattatatctgttacagtgacctgtgacaattggtctttgatgttaccattgtaactgttttggggtaccaccaaccgcacccatagaagacagtgaacttaatctataaatgtgtgtgttctgactgctccatcaactggctgatccccagcctctttccctgtcctcagggctgcttattctttgagaaacaacagtattgaaattaggccaattaataaccctgcagtggcctctaagtgttcaagtgaaaggaagagtcacatgtctctcactttcaatcaaaagctggaaatgattaaacatagcgaggaagacatgtcaaaaggcaagaggccaaaaatgaggcctcttgctccagttgggagagttatgaatgcaaatgaaaagttcctgaaggaaattaaaagtgctactccagtgaacacatgaatagtaaggaagtgaaacagccttgctgctgatatagagaacgttttattggtctggatagatgatcaaatcagccacaatattcccttatgccatagcctaattgtaaggccctaactctcttcaatactgtgaaggccaagagaggtgaggaaactccataagaaaagtttgggccatagtgtgcaggtagctgtccctacttgcttcttgctgaggctgcctcagaacccctttccactgcttcatgattttctgttgtctcttggcaaaaatggcaaataatgatgctgttctgaagaggctggagcagaaggaggcagaggtgggtcaaatcattgaatatcttaagcagcaagttgctctacttaaggagaaagccatttttgcaggcaattttgagggaagagaagaaactttgagtaggaaactgaaggaagaagttgaattgaaacaagagctaattcagacagaaattcaaaacagaatgaagcaaataccatttccatctggtattccactgcatgctaattatgtggtttctgaacgtgatacaatctacaccagtaacaaccacatcttctggtatcaaagaacagataaaaggaggagcaggagaagaagagaaagcaaaagagaaaattgaagagaaaggagagaaggagaaaaaacagcaatcaatagcaggaagcaccaactctaagccaataaatgtttcccaactagatctttgaattggttgcatcataaatgtcagaaaacaccctgatgcagattctttgtatgtagaagacgtagttgttggggaaatagtcccaagaacagttgtcagtggtctggagaatcatgttccttttgaacagatgcaaaatcagatggtgattttactttgtaacctgaaacctacaatgatgaggggagtattatctcaagcagtggtcatgtgtgcttgttcaccagagaaggttgaaatcttggcccttcctaatggagacaattacttttgatgctttccctggagagcccaacaaggaaccaaatcctaagaagatttgggagcagatcccacctcatttttatactatgatgagtatgtggctatatacaaaggagctccctttgagatgaaagggaagggagggtgtagggttcaaactatgaacaacagtggaataaaataaaacaaaatgccttcattatggaaatacattggagaaaaccttataaaaaggaatgtatttgccacttgtacctaaaaaaataataacaacagcaaagtttgaggctaccagaagtttatgaggtttaagaaaagaagctatgtccataacataaaagtgcaaggtgaagctgcaagtactgatgtagaagcttgaggcaagttatccagaagacctaggtaagataattgatgaaggtggttacaataaacaacagattttcagtgtatatgaaacagccttttactagacgatgataccatttaagactttcatagctagagagaagaaatcaatgcttggcttaaagtgtcaaaggacagggtgacactcttggtaggggttaatgcagctggtgactctaagttgaagccagtgctcattcaacatttacaaaatcctagggcccttaatattgatgctgaatctactctgcctgtgttctataagcagaatcacaatgcctggatgacagcatatcaatttgtggcatggcttactgaatattttaggcccacttttgagaccagctgctcagaaaaaaagattcctttcaaaatattacttttcattgacattgcaactagttacccaaaaattctgatgaagatgtacaaagagcagtcatgttaacacaacatcaattcttcagcccatgcaccaaggaataatttcaacttttaagttttattatctaagaagtatattttataaggctataattgccatagatagtgtttcctttgatggatatggacaaagtaattgaaaagcttctagagaaaaaagtaaccattctagatgccattaagaacacttgtaattcatggaaggaggtcacaatattaacacgaacagaaatttggaagaagttgattctaacccttgtggatgacttcgaggtccatccaagttcaaggcttcagtggaggaagtcatagcagatatcgtggaaatagcaagaatattagaattagaagtgaaattctaaagatgaactgaattatttcaatcttgcaataaaacttgaactgatgaggaattgcttcttatggatgagcaaagaaagtagtttcttgagatggaatctagtcctggtgaagatgctgtgaatattgttgaaatgacaacacagaatttggaatattacataaacttagttgataaagcagagcagggtttgagaggattgactgcaaatttgaaagaagttctactctgagtaaaatgctattaaatagcatgacatattgtagagaaatctttcatgaaaagaagtaaatcgatgttttaaatttcattgtcttatttaagagattaccacagcaaaaccaatctttagcaaccactaccttgatcggtcagtagccatcaacatcaagccacgaccttctaccagcaaaaaaattatgacttgctgaggactcagatgattgttagcatgttttggcaataaagtattttttaaagtaagttatgtgcattgtgtttttagacataatgtcattgcacatttaatagactacagtttaatataaacataattttatatgcactgggaaaccaaaaaatttgtgtgactcgctttattgcaatatttgttttataaaagttgtctggaactgaacctgccgtatctttgaggtatgcctgtaattcggtgttcataaaatatacccaactgaggaagacaatgtcattgtgtctacaagaatcttaccatggggactcagttaaagtgagtcacccaaatctatcaagaggtagattttcttacatttttatgaatggctctgattagcagaggagaaaattgataaaaaatatgtgtggcaagaatagtagaaaaaatgttggacattttttgtttttaaaccaagaaaatatctaggctgggcacggtggctcacacctgtaatcccagcactttgggaggccaaggtgggtggatcacctgaggtcaggagttcaagacaagcctggccaagatggtgaaaccccgtctctgctaaaaatagaaaaattagccgagcgtgatggcgggagcctgtaatcccagctactcgggaggctgaggcagagaattgcttgaacccaggaggaggttgcagtgagtcgagatcacgccactgcactccagcctaggcaacagagtgagactctgtctcaaaaaaaaagaaagaaagaaaaagaaaatatctaccgttagcataggaaaattcattatagcagcatattcccactattttaatggcctgaagagaaatagcactatattagcagttcataattaacccataagcagggcttgttgatcagtattttttgggaaaagaaggcttcacagtcgggattttttggtgctaaacagaagatactcctttcaaataaaagcaaattgggataaatttgtcattttttggagataaattatgaacattttagattagtagaatcttcctaatgatgaattccatttcaaggacaagttttgtttaaattttatcttcaagatctgtgaatatagaaaatttaaaataattgtgttttttttgtttttttttttttttcttgagacaggctctgttgcccaagccagactgaagtagctcaatcatagcttactgcaaccttggacttttgggttccagtgctcttcctgcctctgcctcctgaatagctgggactgcaggaacgtgccaccacacctggctaattttaaaaaattttttagtagagacagagttgcctgggctatgttgctcaggttatggaagattttttaaaacctgttttcatattggataatgacttctttaaatgtatactcttcacttgagcaggggataaagagttgttttctgaagtttggcttgagaaaacaactgtttgggttttaaaatccaagtggaaacatgttacaaatgaaatttttttttatttctcttatttaaaacaaacatagtttatagcttttatatattaacaatcaaatagcagaaccatctacatttatccaaaataagctagattagtttgtgtgtattttcatgtaagtcaaataggcatttgcttatgaggagtcatttaaatgcagctttacaagaagtggtacaattgtctgcaacatttctttatctcaaagtaatttggatgaaataacatcagaagatgtcagtttaaatgttccacttgaaatccggttagtttttgattattcacactaatggaaggagagtgtaggcatgtagactccgaagagacctttaatccaaaaattacttcttagcatttgaagatatttgggtaatacatttggataatggtgtgtttcatgtcctttggcttttttaatttaaaaaattttttcagagacaggatctcactctgtcactcaggttggaatacaatggcaccatatagctcactgcagcctttggtttaagagattctcttacggtttaagagattctcggccgcgcgcggtggctcacgcttgtaatcccagcactttgggaggccgagtcaggtggatcatgaggtcaggagatcgagaccatcctggccaacacggtgaaaccccgtctctactaaaaatacaaaaaattagctgggcgtggtggtgtgcacctgtagtcccagctgctggggaggctgaggcgggagaatggtgtgaacccgggaggcggagcttgcagtgagccaagatcacgccactgcactccagcctgggtgacagagcgagactctatccaaaaaaaaaaaaaaaaaaagattctcccacctcagcctccagagtagctaggactgcaggtgtgtgccaccacacctggctaattaaaattttttttttgttgagacagggtcttgctatgttgtctaggttggtcttgaactgctgggctcaagcgatcctcctgccttggcttcccaaaacattgggcatacaggcacgagccaccatgccagacccttttggctttattgacagcctttgaattttaagtaaatgctgaaatgtatgtagcttactggaatatatataggagactttatagttctttctttagatctttggatttccttaagagacagagcactttacaagaccttttgtttctcaaatatacatataaacagcaacacatttgaaagataaattccaactaatgattaatgttctttgcagagaatgacaaaatacatattaattacttagggttctatttgtattttactttcatagttagaaatctgtttctttttctttcttttttttagaggcaagattttactctggtgcccaggctggagtgcagtggctcaatcttagctcacttcagccttgaaccccccagcctcaagcgatcctcttttctcagcctcctgagtagctgggactacaaaaacatgccactgtgcctggctaattatttttatttttatttgtagagttggggttgctttgttgcccaggctggtctcgaactcctggtttcaagtgatcctcctgccttggtctcccaaagtgttgggattataggcatgagccactgcacctggccagaaatttgtttaagtaaaatgactgtatcagtcagggttctccagagaaacataacatatgtgtgtgtgtgtgtgtatatgggactggctcacatgatcacatgattatggaggctgactagttacaagatctgcagttggcaagctgaggagggttgttagcctttttgttttattcaaaacatcagttgattggatgaggcccatcccattaccctgaataatgtttgcccaaatgtctgggcaccttttggcccagtcaagttgatacataaaattaaccatcacaatgacctaccttaaagttcttagctggacattttgcatttctcatcaggaacctaggctaatttacaacctttgatattgatttcaaccacagtacagttaatgagttatcagtgatgacaaatcatgatcatttccaatacaaatattaactctgattatttgtaaatatgttatttttcccacattgttctagacagtgggacatagaggtaaagtaggtaaaggtgctcacctcctgtaacttatattccagtgggagtgacagataatgcccaataaacaaataaatgtatattaaaatgtcaggtagtgataagcataatgaaaaaataaaacacagtaaagaggtaccatttcagataggtttgttaggaaaagtcctgaatgggtgacatttgtacagagatgtgaataaagtgaaggaacaacttatgtataccttgataagcacatatctaactaacatttttggcatggtttaaggtctttctttcatatatctgtattttgcatactgtggtgctactcagatatcccttctatgaaagcttgttgccccaacttctgggaatacaatgggcaggtaccccacagctgtcagccccttcagggactctctcagctgcagggcgccaacttgactaactaaggtaaccctccttcccaggatggcccacagtcaatgactgattgctgtggaaatatagagtcctatctattttggcccagctagagataactctgaagggccattctaactccagagttccctgcgggatgagccaagactgttggtagatttggatgacagtttaactttttcctctgtccaaacctgtttcattcccctcccttttcataggtttgatcccaaaggtactccttaatatacctcctgctaatcttggtctagaggtctgcttcccagagaactcaccatttaatatgaagttttgtgaacctacagcttatttatgatcttatctcagtagtacttggcagctggttttatatcgggccacggtctgcttcctgacagaatcttacatgttaatatgaacctttcttttctgactctagcactctgaaaactgactttatacctaccacacagtttggaaattgttaaaaaggttatgattcccctaaccactttgatcttattatttcactgagagatattttagaagcattggtttatcttcactacctacaggagtctaatatattgttttatttaactagagtctggtcaacattaacctctttttcgtttataaagagaatgatacggctgggcgcagtggcccacgcctgtaatcccagcactttgggaggccgaggcggacaaatcatgagttcaggagatcaagaccatcctggccaacatggtgaaaccctgtctctactaaaaatacaaaaattagctgggcgtggtggcgcgtgcgtgtagtcccagttactcaggaggcggaggcaggagaatcgcttgaaccaggaagtcggaagttgcagtgagccgagatcgcgctactgcactcccgcctggcgacagtgagactccgtgtcaaaaaaaaaaaaaaaaaaaaacagctacaaattcatgtcaatgaatagggattttcaaattatcttcatgctgcaaaaggagagaaatcactttataacttataaccatgaagctatttccattaaatatttaagaaacgcaaaattcttggtaatggcaacaaagttaaacaagttaatatgggggatttttaaaagcaactatgtttaattatttcagggtttcatataacttttgaaaaattaatatatgatataaattcccatttactgtgtaattggtattatttatgaaagaacttcattcttcctgtatcaagaaacatagggattagatttgtaatttacataatctataagcatcatcatgaattcttttcaaacctgacaccaaaagtattttaagaaatctccataccaatatctgtcatggacatagatatacacattctttataaaattttagtatatgaaatacagaaatatatacagtgataataaatcatgatctagtagagaatatcccaagaatttaagattgattaaaatttgaaaatcagtgtaattaatcatattatcaggcttaaaattaaaaaccagccagatgctatgtcacagtgctttggaagattcagataggagaatcacttgaggccaggaatttgagatcagcctgggcaacatagggagactctgtctctacaatttttttttttaaataaattagctgggcatggtggaacatgcacctgtagtctctgctattggagaggctgaggtgggaagatcacttgagcccaggagctcaaggttgcaatgagctatgattgcatcactacactccagcttgggtgacagagcaagactctatctctaaaaaaagaaaaaccatatattcctttcaataaatacaggaaaagtggttgacaaaattcactatttgctcatgataaaaactcagaaatctagtattagaagggaacttaagattccctaccattgatgtgaatttgtgtcattctctttataaatgcaaattggaagggaactttagggatatctctgaaaaactttcagttaacattgtacttgatgaaagactgaatgctttctcccttagattggaaacaatgtaagaatgtccatgctcaccatttcaattcaacattatgctggtcctagccaatgtaataaaggaagaaaaataaataaaaggcagaatggaaggacataagtaaaatagtctttatctacagatgacgtgatcttctattagaaaattctaaggattatacaaaaatgctgctagaacaaataagtgagcttagcaaggtctcaggatacaagattaataaagaaaaatcaatcctatttctatatagtagcagcactcagaaatttccatttccaagtgttattttattaaaaaaaacaactcaaaatggatcgtagacttaaatataagcacaaaaaatgtgaaagttttagaataattcatagaggaataaaaagctggagttagccgggggcagtggttcacgcctgtaatcctagcactttgggaggccgagacagacctagatgtaaattccagacttgcacttgaatcacgttcttgctacatattatctatgcaatctctgttaaattatttagtttttcttagcctcactttcttacctataaaatggagataatatctgctaggaactgttaatgtaaggcagcggttctccaagtacggtgcctggaccagcagcattagcaccacctagaaatttgttagaaatggaattcagacctactgcttcaaaaactcagggtgggtcacagtaaattgtgttttgcctttcaggtgattctgatgctcaagttttagaaccattgatgtaaggattgtgtgtattgtgtgctgagtttcacagtgtttgctatgtactaggcacataattaattttaaaaacaaatgtctaccccagcaaaccttctattctcttcccttacactatttcttccagaaatgctttccccatttttctgaaccttaacattctttcaggacccaactcaaattccatctgcccccagaattcattccaaatcataataattctctatccccaaaacatagcacttaatagctagaactgttggtgctcactggtaaccactagccacatatagctattgagcacttgaaacatagctattatgcattgagatgtgctttaagcacatctcactggatttcaaaggcttactacaaaaaggggatatacagtcgactcttaagcaatgcaagagttaggggcacagacgttctacacagttgaaaatgtgtgtataacttttggctctttgaaaatttaactactactagcttactgttgacctccagccatactgataacataaacagttgattaacacatgttttgtaggttatatgtattacatactctattcttacaagagtaagctagagataagaaaatgttattaagaaagtcataaggacttataaggaaatgtatttactatccattaaatggaagtgcagcattataaaggtcttcatccagtgagttttatactttcatatgttttcatgttactaaccagcatccttttgtttcagcttgaagaactccctttagcatttgttgtaaggcaggtctagaggtgattaactattgtttgacaaaggcaccctgaatacacaatggaaaaaggatagtttttttcaaaaatgatgtcgtgaaaacttcatatccaccatgaaaataagagaaatcatattcttatcctacatcatatacaacaatcaactcaaaatggattaaatatttgagcatataacctgaaactgtgaaactcctagaagataacatagggaaaaatctccatgacattagttttggcagtgatttttaggatattacaccaaaagcacagacaataaaagtaagaataaacaagtgggactacactaaactaataggtttctgctaagcaaggaaatagcaaagtgaaaaggcaacctatggattggagaaatatttaaaaatcatgtatctgataaggaattaatataaaaaataagaaacctgtacaactcagtaaaaacaaaacaccaaagatgggcaaaggacctgaatagaaaactttccaaaggacacatacagatggccagtagttatattacaaggtgctcagtcatcagggaaatgcaaatcaaaaccacagtgagatatcactgcatacctgttagaatggctattataaagaagagacaaaagaaaacaagtgttggtgatgatgtggagaaaagggaaccttatacattgttgttgggaatgtaagttggtacagccattatggaaagaaaacagtatggaggttccttgagaaattaaaaatagaactcctatatgatccagcaatcccatttctggggactcatctgatggagatgaaatcagcacattgaaaatatatttgtacttccaggtttattgcagcattattaacaatagccaagatatggaaactactgaaatgtccattgatggatgagtgcatacagaaaatatgctatttatatgcagtggaatatcattcagcctttaaaaaaaaggaaatttctgttatttgtgacagtagtgaaatacattatgttaaatgaagtaatttaggcacataaggacaaatactgcaggatctcatttatatgtggaatctaaaacagttgatctcatagaaattttagagcatgcaatttagtatgtacagcatggaatagtgattgccggtggctgggtggggggaaaatgggaagctgttggtcaaagcatagaagctttaagttataaataaattttggagacctaatgtattgtatggtgactgtagttaataagaatgtacttgaaatttgctaagagaatagatcttaagttttccacacacacacacacacacacacacacacacacacacacacacggtaactatgtgagattacggatgtgctaattagtttgattgtggaaatcattctacaatgtaacatatatctaaacatttggtacaccttaaatatgtataatttttatttgtcaattatacgtcaataaagctataaaaacttttctgttctgaaggaaaacataaataaagattatattttagaagagtaataagaaataaattttcctggataatttcattgttttctctacaaagaaaggaagaaaataccttttccattaaaaacaaaaagaaaatatctgatgtgcttagtgattctgagaagtcatttatgataaacacagcaaaataatataaatattatgttacctctttatcatttagaatatttttgagtttggcattatacatagtctcaaactcctgacctcagatgatccacccgcctcagcctcccataactgctgggattacaggcgtgagccattccgcccagccgccctttaatctttataacaaatatgcatcataggtgttatctccttttatagatgaagaaaggcaaatgttaagaccaaaacaaaactagcaagtggcagagctaagattcaaacacagatatttctgactccaaaacctatgtttttaactgtactgcaccatagagaaaactggttttactcatctgttcctattttatggatggggaaatttccccatacttatatattttatgtagaaataagaattgtaaacaattttttaagctgtaaggtgacattattgatttgtattttttgcaatagtggtataatttcaatactcctgtaaagtttgaggctctactattttgagataaacagaatataaaggacaatatttaatcaaatctgtgaaatagtaaacagaatattttgtaacagttttcatatgcacagcatattacaagaaagtcttgagttacagattgaatattcccaatccaaaaatccaaaatctgaaatgcttccaaatctgaaagtttttgagcaccaacatgacactgtaagtagaaaatttcacatctgacttcatgtgaagggtcgcagtcaaaatgtaggcacacaacacaaagcatctgcaaaggaaaaataaaattgtctttaggctttgtttataaggtatacacataaaaaattaatgtattaagtgtttagacttgggtcccatccccaagatatctcattttatatatatgcaaatacgccaaaaatctgaaaaaaatcaaaattcaaaacacttctgtctcaagcattttggataagggatactcaacctgtagtaaggaagatgcctgtagttgataaaatattaagtttggtgggatttaatgaaataaaaatactgtgacatgattcatgcaaagtggtttgtcatttactaggattttgaccatttctaggtaaactctggctttcttacagagtagatgttcagaatatgaatttgcatttactgtttttaaggaatgatcactgctttcattacactataaaaacatgtaaatgataaactttttaatgtgaagaggtagttttttctgttattagttgtataaacaaatgcctgaagatatagttgtaagaaggttcccaaaccaatattcttatcttgattctgagcatagcatttgatttggcctgattcatacaactagaaaggggttaatgtttatatagggtgagagctctgcctataattgttacatatcttgcagatgaaccctgtatttttaatatacatatacccatatctttttagtcttaatgttttaaagtatcaactttcttttttctttttttgcttgagagggtggtaggatagagcttgtgtgtacctcagctccagctgctgccgaatgacttccaaccaacacctgtgggtgggagctggctggttttcctttcattgtcaagcctgggcatactaagggaaaatgcacctgccagagacctctttattttcgaaatgattatcagtggtatcggccgagagagaggcagctggtgggctcctgtaccctatctagccctctatatggatctttccttctatgttggaaaaacaaagttgaaatttaccacattttggcattacacttggcagttactgtgatgaagttgatcatattagagagtcattcaggatacctgaccttcctgccttccgctaccttaagtgaaaaatctcttctgttccctaatttactgtagcatatgcttcagtgtgttgtgttgggtagggcagatatccttagactaattctaatcctgagtgattcaagactattccagtggcaatggaattttacacctatttagtcatttggaacagagaggtatctgcttgtaataggccaagacaccttaattcctcatttatccattagctacctgtggggctttatctaagacacttcagtttcctcatccataaaataggaacagatgggtaaaaccagttttctctatggtgcagtatggttaaaagcataggttttggagtcagaaatatctgtgtttgaatcttagctctgccacttgctagttttgttttggtcttaacatttgcctttcttcatctataaaaggagatacacctataatgcatatttgctataaagattaaagggcggctgggcgcagtggctcatgcctgtaatcccagcaatttgggaggctgaggtgggtggatcatctgaggttaggagttcgggaccggcctgtccaacatggtgaaaccccatctctacaaaaaatacaaaattagctgggtgtagtggcacatgcccgtaatcccagctactcgggaggcggaggcaggagaattgcttgaacctgggaggcggaggttgcagggagccgagactgagccattgcactccagcctgggcaacaatagcaaaactccatctcagaaaaaaaaaaaaaaaaaaaaaaaaaaagattaaagggcatcatgtatgtaaagagtacagaggagggcacatagcaagcactcagtaccttataacttttattattctttttcagcttaaaaaattatatgtctacattgaattcatatttattcatgaatgaatacatacgatgttttctgtgtgccaggtcctgttctaagcatgtttcaaatattgtctttatttgatctgtatggtatcctgtaaggtgaggacttaaaatattcccaatgtgaaattgtgaaattgaggcacagacaatctaaaaacttgcccaaggtcacattgctggtaagccactaagccagatactttgaaaatagtattagcatttatattatataaaatctcttttagtttccctttttttcctaatagtgcaagtttattcaccatgtttttagtttttctcaggaagatttaaagaagtgttaggtggtggccttggtgcttcagtggctatcaggtcagccagaggtgactcgtttttgtcaccagggtgtgctgtgattccaccagtctgaacttactgcagctgctgtgaagctggatgggaatctctttattgtctttgctgctgcttagcgaccacaggtttttcagcttggcgctttaccatcacctgggcaactgcctgagatcccaagttattttctttttgtgttgtaccatcctttcctgctcatttgtgtcctcgtgtaaatgaaggagctagcatgtctggcttgttagcagagtgcctagatgcccgagctgtatgttgtcaagcattatgaagctgccaccacacttattattttgctacataagaaattagtatgtcaccaaattgattgctttaaaaaatttggtatcaatagcattttgttaaacttgccactgcctttagtacttgcatctttggtgctaagttcctgatgaatttggaattaatcattaaaaatgcacataggcttgataaacttctataaaatattaatattttctatagaatataaatttttcctatagccaaatactccgtcattatgaataaatgttatctgagattctgtttataaaggatcactttctattcatttgtggcttaaaagagatacttatgtctatgtagtaagaattatgaaaagagcatagattgatttaaagtcttaagagtgtgggtgtacatgcatgcacacacacgaaatataatagggcagcatctctggcagactaatcttgctttgtataattaagaaaacttttcatgtctttcatcattctttttttctaaaattgaagtcatctcttgatggttatcatcctagaaaatttgattagtaggaagcttaaacaaataaccaaaatgaatttattagcatggccatgtgatgttggctttgtacattgttttcaatatatgtattaatctgtagttttccttgaaagggtacttgtttctacatttttatagagagtttctcagaagcctgggctgtttagtgagaaatcttgggaaatgccttaccttactttagaaaagagacttatttctccagataacactgtctttaagcaaacagtgtttgtgtaaccaccttgtagcaacattcagcttgaagataatagccttcacatgcttgataaaatgatgaaatcactgaccagcaggatccgtcagtggagtcagcattttatcacaatgtgataattctgtttaatgtggaaatggttacaaaatcttctgatatgtgtggaattcctgtttgatgaccacttgcttggaggaaaaaaaaaacctgtgcaagaaggtttagtgtgtttatttcattgtaaagacatttctgaccattttctttaattgaatagcagaagtgtatgttggttcatacactttgaaatgtaaagtttctgctcaggccattgtggaatgagcatcttccattaatctcgcttcacactaaaatgagtaagagacttatgattttttgaactgcatgtttaaattgtaattttgctggaaaagttaccaaatgaaacatttctgaagaaattaagataattagacaagacttatgaaccacacagtgtcattatttttttaaaaatatatagatgaaagactggacaaagttcaattctgcattaaggttcctttcaaagtcaaaataattaaggtaatcaagcctcacactgggcaaaggtttttttccctcttttaatctgattgacttttttttctatctttgttttttatgaactcatattttttaggagattttagggagaaaaacccagtgcctagatagatgtgaatgatcatataccaatgaatgccattagcctgttttttcatgttctttacttgtgctcttggaaatttgagtgtcttaaataattggaatgcatataaagacatatttttttctatgctaaagaaaagcaaaaactttgaaattttttgataagtggaaatatagatattacaaagaatatattacacacttctaaatctaaatttgtcaatcaccgctttttataacttaagtttttggtagaagtatgttagcctttagttttgtactggaatatttttagggctatctgaccttctaggttttcttatcccctcagtctgaccttccacataacctgtttctgttcatttattgatctcctaccttttacatatggattgattcacttttcattcattcaactaatatttattacctgcatgtatttgcctggtccagaactggggtgagatattggccataggaaggtatgatcctattgtctgttcttacagcacttatggtctaaccagggaaagaaaaaacaaataattgaatttacagttaattataattttaagttctatagtattcttaagcagtcatttttttacatctccacacaagaggaaattgtgtattccttcagcgacctttagaagcagcctgcatttttttgtttgtgaggatagttgagggtggggagagactacactggtatgttatttgtatataatgcacagctttagtggtccataattatgggggtgttgcccattgtactgtatgaagtttttcacctccagactatgccttgcttctgtagatttctctcagggctcatcatgttcgccactctctatctcagttcgcagctccatttccactgcttgccttttctttaaagataatcatggttttgtccagggctttgccttatcctttggttgagaagatatcctctggatttccccaattcctccaggttttcctaccacatcttccctgtaaccatgagtgccttctcccttgtatagatacattaattatgaattactatatacctctacaaaaaaagcactgtatgtgtccctctgcgctaggcttaaagggaatttaagacaaaggtgaatagatttgtttcaccacagtttttttgtattaactaattaactttattttatttttgcctttttctacatgttctaaaccgccccacctcttttctcaaagaatttataacctcgtctagtgtttgtggtaggtataaataaatgttagttaacatcatgattatattttgtgtatgccccagcccacagttggagttcagaaaacattgattccattaatttgtgtttatttttcatagatttctaaataaatacaaatcttttagaaaatattgactcttccatttgtgatcattatgcttgaaatcactaggtagaagatatgtcctggggaatatcagaaacactagttttctagtgttttcttactggtaaagccctaggtaatagagctttaatagcatgaatctccagaaatctaaagctaactttaattcttttcactttctcaaaactatttgcttcaatagttgaataatatttacaaaatagttaactaatttgaaaactacacacaatattgctattctacttgtttctcacaattaaattctctattagaaatcctcatggagagtttgagcttcctaaagatttattgtaaatgtacaaattttccaaaacaaaaaggcaattaaatcttctgaaatttgaacagttaattaaaatcaatattaacgtaatgttaacataattgttttgtgcatattagtttattggaagtctgtttaatcactgcctgggagactattgttttatgtaaaccagtattctattgaacggttcctttttttgtaagactggttacagttttatcccctttaaagatttctgtaagtggccaggcgcggtggctcacgcctgtaatcccagcactttgggaggctgaggcgggcggatcacgaggtcagaagatcgagaccatcctggctaacacggtgaaaccctgtctctactaaaaatacaaaaaattagccgggcgtggtggcgcctgtagtcccagctactcagagaggctgaggcaggagaatggcgtgaacctgggaggcggagcttgcagtgagccgaggtggcgccactgcactccagcctgggcgacagagcgagacctccgcctcaggaaaaaaaaaacaaaaaacaaagatttctgtcagtatcgggttgctctgcgatttagtggttggccttgataagctgagtgcaaactgtaaatttgttttctagttctgccccttctccactggttgctgcttgtgtggatcaggtttccttctgttctagttagctgtaggcttgggtagaattcagcagttaattggagggagggagagagggacaagaagagaggctccacaatccagttgctggtgtatgtcactgtagaatccactgactgatattttatcctctggaaattataaaatcctactttaacacctacttttctctttgctgatggagaaatcagggaaatcgtggagaagtcttttagattgatgctaaaagatggattgatacttctttcatcctatcagccttttagattgataggatgaaggaaggttcatcaagtttttccagacatcaagaggttaaagtcccttgctggacgggaggtagagggtcaagtggctaagtagagaatgcttatagagcagtgcttctcaaacattgccatctatcacagtcacttggagagctaatagagaatacagtggcccaggcttcttgacataggccagggcttttgtatgtatatagtaagttccctaggtgagtctaagcttgagaactcctgggggtgagagtatctccagtcagcttttcctgtagtatggtgagtggtaaaagggaagccagggacagtgggatggaagaaggactaacatctgagggcttcttatgtactgggtaatgaggtaggtgctttcaggtgttatcacattgaatcttcacagcaacacaatgctgtagatattgcttcttttttatagatgagcaaactgaagttcagaatagataaatacatttcccaaggtggcatagtgtgtaataatcaggatttaaactcctttgattctatttgaattcaaagaccatgttctttccttgccattcattccttcagcaatagaagttgagcctcagttttcttatctgtaaaatgagattaataatagtaactcattgagttatgaaaattaaataatatatgctaagcacataaagcagtgccaggtacttctgtagtaagctcctaatgttaactatcatcattatttaaattatactctagttcttgctatgggacagttatgatgttaggggatggggatacaaagatgataagatattacttgacctcaggtagtttaacaatagtgggaagacccgacagttgaaagtagtatgttatttctttttggcatccattataaaatatgtgagtaaatttagatagaaaagcaaggaatgctgaaattcagagatggagcctgtagtggcgtgcatggacagactttccatgctcgagacttccatttagtaaaaattcaggcctgttgtggatcttcagatcatttgaaaaacagtcactgagcacttggggtttgctgtatttctttttattaaacctatttttagaaccctcatgctgatctcactcttttttctttttaatggaaatattatatgcaagtacagtgtctgaaaaaaaaagtgactttatgtatagtgaaaagcttcccttcaagttattagaaattttagatcttttgagtcttaataagaatttgattttttacctttttatgactcataagcaaattcaccagataagaaaaattgaatctgaaattagttaaattttactactcttggatattagaattaaggtaatagtagaaggataattgaatttcttagctaaattgagggcttgaaaagtttctgaatttcagtactaccactgactcatgtttgagttattatggattatctaccctttgtttatatgtgtggtctgtagatagcagcagggcctggcttagtgcttggcatgagcagatattcaggacgtatgtttgggaagaatgtatgaatgagagtaggtaagtagcaaagctggtgaataagcagttgaagaagatttttgtgatatcttaccatatttaataaattactttggaagacatttgtgtactgggatctgaagaacatgactgcataatttaatgattttgtaggatttattttattaggtcttttttggtgtcactgcctcagaatgttattgtattattttgatcttcttcacttgtcaggctctcagatttacttttgtcagtcttttacagtttctatacagtcaaggaagctgcactgttacatattctttcaagattaatgttttgggaccacattcttcatagtttcttttctgtcaaaccagtcatctttggtgagaagggtgttcatgtaagcagagaagctggtgttgtattatgcagaatgtcatttcctctcacttattttattttttacccagagcctttatcctctctcagctcctgaactgtggatagagatgcccacaatccagcaaatactttttgccttctggattctttgttcagggtctttgtgctcagtgtagcttccttcctaagtagttaataggtccctcttctgctgatctcttctctccccttcccccaattgccagtggtaagaagtatgaggttccttaacatagcacacttttctgctgttccaggtgcttctcctgctgttcctactcttcttcccctacctctctctgtacctagctcctgtttcagtcaccaaggtttggggtgcaactgattctgtcaacaagtatggagcatagtacccccaaattagtttttcaaccttgtcccttcccaaccttcctcatctagtagtccccaatgtctattgctgccatctttatatctataagtacccaatgtttttttttttttgagtacccaatgtttagctcccacttacaagtgagaacatggagtatttggctttctgttcctatgttaattcgcttaggataatggtttctagctatatccatgttgcttcaaagaacgtgatttcattcttttttatggacacacagtattccatggtatatatgtaccacattttctttatttaattcaccattggtgggcagctaggttgatttgctattgtgaatagggctgcagtgaatctacatatgtacatacattcagtggaaccatttattttctcttggatatatacccagtaatgagattggtgggtcaagtggtagttttaagttctttgagaaatctccaaactgctttccccagtggctgaactaatttacattctcattaacagtgtataagtgttctattttctccatagccttatagccaatgtgtgttgtttttgtctttttaatagtagccattctgactggtgtgagatggtatctcattgtggttttgatgtgcatttctctgataattagtgatgttgagcatttttgcatatgtttgttggccacttgtatgaaagtgaccagttttaaatgaatgtgtcaatataaagttttcctcctggttcacagtgtttttcttaagagtattgcctttttttcttgaaaaagagaataaaacttggtattttttttcccagacaaatcctaaaccttaagtttgggaaagcactgtggtcttctccttacattgtatttctgtattaagacatgaatgtattttgtctataaactgatttatttctctcatctatcaatagctaaacataatttctcttcttttatgtctctctctccccacctttcccccatcatcccttcttctacctcttcccttttctccctacttttctgcttctctcttaccatttttcttctctctttctctctcctggaccctctgattttctcacttgcccttcactaactatgctcaaagaagttaaaaactgaggtcggagatggtttttgtaaagactaataattctgatgcaggactaaattaaaaatagggttcttacatgaggtttgaattagaaagttgtgtggatattgtcatgtaacttcttctagtaacctgttctattgcttacatttaataaataaaagccaagctatgacttaaaaatcttatcccgtaatcaaagtaaagtctgtgctattgttatagtgagtgttatacaaaagcaagtcagtgttagtcatttacttttggaattattatctttcttctaaatgcaagcagtactttttccctcagcagactttaagtgtaaataactagagataatataaaaatattaggaagaagggattgattatctctcatttttgattagtacagatacagaattttatttttcttttttctttctgaattttcttcctcccttctggatttttatcttctttcggctttcttttaaagagaatacttctttgctggaatcaattcagataaaaaggtagtagttttttattggttagggaaatttagtaataaaaaagaagaatgggaaagagagagataagaaaaatgatgaggaatctagtcaattatgaatttaccagtacaggaaaatataatggtaacatggatatcttctgtttcagaagagcaggcaaggattgggggttacatgcctaatagtgattcctgcaagtcaacttttcaaaatagcaacatagtggagaattctgctgaatgatattcttaaaagcataaggccagtatttatcattcagcaccaaataattacagatagctttcttcccagaggaacagaagaagtaatgtgctagtaaatgcactaattctgtatctggcctgctgtctgtcacttcatgatagtagaagagttgtggaggaaagacgttaaatcatttgagatgtttttggtgctatcttgtatctactagtcaaattttacattacacattatgcacttaaagggcataagttttaaagatatttcaatgatgttctgcctagtgtagattttttttctgtattgtgtaagttcctgacttgaggttgtgaaaccttagcttgagggtgacaatgaggtgaagaagagatgtctatgaacctgattttgtgtgtatagtattttgtgtgttctactacagaaggtccataggttttattccaaaacctaataaaaatagaaacctgtgctatgagacccaggtaagaatttggcatggaaatgttagccaggcaaatagagaaaagatacattgttttcatagactcagccacaaaactgtgccttccccctctgatctcagccgcttactgtaaagaatgttacctataagtattgtattttgatttagattcccatgtttttgagtataattgtaaccaattttatggtaattatttttgaaagaaaaacaaaaacatggtctagttatatggcagttatccaaaagtattgtctccaaagctgattccaggataaaaaaattaactattttgaataatagctttaggatcactttgataattagaggtggtaattggccttgttgtattgtatcttttttttttttttttttttttttttttgagacggagtcttgctctgtcgcccaggctggagtgcagtggcacaatctcggctcactgcaagctctgccccccgggttcatgccattctcctgcctcagcctcccgaggagctgggattacaggcgcctgccaccacgcccggctaatattttgtatttttagtagagacagggtttcactgtgttagccaggatggtctcgatctcctgacctcatgatctgcccgcgtcagcctcccaaagtgctgggattacaggcgtgagccaccacgcccagcctgttgtcttgtatcttaacactcatttttaagtcattaattaactaagctacatactttatgtgtatttctccatgtttcagagatactttggcttaataaaaaatatttttaaagagtcttgtggttttcttttttaaaaatcaactaaaatatctgatctattaagcagaatttatcattctgttaacacaatctagtctatcatatttgacagtagtatttctctagtgctttgaataaattaaatcagtcaacaataattgcatttttagtattttaaaattctgttcctttttctcctctacattttttttttttttttgagatggagtctcgctctgttgcccaggctggagtgcagtggcatgatctcagctcactgcaacctccacttaccaggttcaagcaattctcctgcctcatcctcttgagtagctggaattacagatgtgcaccaccatgcccggctaatttttgtatttttagtagagatggggttttgctacgttggccaggcgggtttcgaactcctgacatcaggtgatccacccacctcggcctcccaaagtgctgggattacaggcatgagccatcgtgcccggcctcctctacaattttattttagtattatttattctcaattagtccaggtactgatgcttgtattatgaccattaatatataatcttggcaactcttgtgtttctgttggtaaaacattttcatggattctatcataatgtgatcatttttacctatcgttaagcagtttttcatcattgtatgcttacattaactttccattctgtgttgacaaccttttaatgttaaccaaacaactaaatttactttgatcataaatttaaattgggatgaatgggtagttatagataaaaaataaattaaatgttattatagatagatgtcaataatcaactcttcattttctgattgaattgaaatgtactgctaaggttatagttacgaaaaccaaggaaagtacattggggttttcttggtgccagcatagtgtttgagaagaaagttctaagaatagcaagaggaggagtgatgaatttagcaaatctttcattagtagtaaggtgtgattgcttgaaaagaaaacaatcttttcgagtgagaaataaaaacagtggcaggagtatatatagagaaaaatccaatgcaaaaccgtcctagtgggtgtcaggtaaccctacatgctttagtacaattaaaataggaatgttcaaagtgtaaagaaacagtggaaagagaagtccatctgggaacactgagagggaaagatgcccaaagtttcagctgttttgtggtccttggggccttctggggctactggttttacagttccaagagcatattaagatttttttcagatacaaccaatgttgcagctattaatgagaacaaaccatattaacattattattttgatcctcaaaggaaacaatacaaatgcctcagcaagtgctttctgattgtgtaaaactgaaaataattaactggaaaatgatcaaggagtgattttcaaaaaagatgtgatatatatgttctgtaattggcaaaagcgaaaataatcatattaagttgagaaaaaaagtccttgattaaaagacattcaccacgccatttaaaacattttgcaaaattttagttttatgtatgttatttttaaatcaggttcatataacaaaaagaagcaaatgttttaataatatatttatgtagtatcagaaaggaagaagactcctctcccatttatttttcctgctgactcttgttttaaattctaatttcaacaccctttgccagtttggagaaatgatttgtcagctgctctgtgaagaacactaaaatgcgataggaatattttaaatgcacaagtactgaaaggaaagtgcaggcgtttcccaagactttgaactgatgctatgttgtttcttaacagtgttagatctactaaatatttaaaaggcttttaaaagataaatggctttttttcattcctcatggtgctgatgacttggttgtgtctgatttttaactgatgtcatcagtattgacttgaaacatttcatgggtccttttctcattattcctgacgagtgtactgggcagcttttgttgctgaatgataattttttatctaaggagaataccagcaacaaagggaaattccatgggcgctgaaaatggaacctgctggagtaggttcagtatgtaatttagtaataccttttcttttctttttttttttttttgagacggagtcttgctctgtcacccaggctggagtccagtggcgcaatctcggatcattgcaagctccgcctcccggttcatgccattctcctgcctcagcctcccaagtagctgggacgacaggctcccgccactacgcccggctaatttttttttttttttttttttttttttttttttggatttttagtaaagacggggtttcaccatgttagccaggatggtctcgacctcttgacctcgtgatccgcccgcctcggcctcccaaagtgctgggattataggcgtgagccaccgcgcccagcctagtaatacctttttaaattttatcagtgagctctgctgtagttcctggaaattctggtgtcatattcctttgtgcctgtagctgttcatcttcccttgggccacaagcctgtataataactcatttcactctgatctttggaaacactgtgtgaatctctattttagcatttataatgcatgtcataattatttgtttacatgaaactctcccttgccagaatgtgagctccttaaggatgagaactaagtgcttttttctttgcatctcaccagcactcaacactgggtagaaagaagggagccttggggaggcctcttggatgtgtgtttcgtagttgaaatctctgttaatttgagttagagtaagagtactttgttttgacttgaaagtcctagtgagagtcattccttaatcaaaataactgatacatgtatatatacacacatatatataactcatatatacatgcatttatgtagacctttatttgaaatatatatgaaacataacataagtgaaatatataaatgtatatttgaaattgtaatcataaatatatctgtaataacattcaaattgaagaaagataattggctcaaaaatcagttaaaaatttcttccgagatttctacttttataagtcgtatcttttcatgtatattttactttttctgtacaattaaatgttgttataaataccttcccatcggtatgctatttcacgtatagattgattatctgtggtataaggaatgtcacaaatttcaaaacttacttttttgcctttttgaagtatttgactagggaatccacagacatgactgattaaaagggattatcagctttcacctaattcaactttaagcctttagtctggctttatttaaacaagtcaagataaatgtgttcctggcttttttaatcttaaaataggaaattcatttcctctttagtaatgcattttactatgttttattagttttttttctgttgtggttaaactcattttagaaaacttttaaaattcaggatacccttttctatgaaaacaagcagaattaatttctattattaataatcagcctataaaagttatctatcattttgttatcttaatatttaattataaatatcagtttttaatttacaatggctacattaattagctgggtgcagtggctcatgcctgtaatcccagcactttgggtggccaagccaggaggatagcttgagcctgggaatttgagaccagtctgggcagcatggcaaaatcctgtgtctacataaactacaaaaattagccaggcatggtggtacatgctcgtagtcccaattacttgggaggctgaggcaggaggattgcttcagcctggaaagctgaggctgcagtgatctgtgttcatgccactgcactccagcctgggcgacaaagtctcaaaaaaaataaaaaataaaaataaatcactatgccaatgtgggagttatgatcatctctgtttttaaaaattatctatgcaagcatggggcataacctttgttatagctctttcactgcattttttggctctatttcccaaataaaatagagaaacaatattttaaggaatgtattgtccccttagctttcttattttgccttttcaggaactatttgcgtttgcggtattgcttaactatgaaatgctagaattcataacccactatcttcatttcctccaggctagtagcttaataacatgaagaaaaattgattcttgtagtacctaaaatgacattttctgcctacataacctgttaatccagttttgagttcccattacattttcatcgtcagtggcaagccagattaatttatagtataatcattcaaaaagtttagtttacagattttaaagttgcttttcatatcaattttatttatgctgtttttatatttaaattgctttctatgtgagtcatccatgtaattttcatccaaactgaaattaacctttgcgtaatttctgctttcttgaaactactttttcttttgatgattaaatattgtatgattactggagttggtgattgctaactactgagagtcagtgtctaaagcacagtttctgactggcataaatgaaactactttgcaatagtcaatgtaatttcactgtaagggtcattgtgagcagatggttttccatcctgcaggattttaaatcttgaattctacagagtttgatattttgcacattaccaggagtttaccattaaagtcatggatttcaagtgatccaactcttctagctttaagagaatattaatttatgctgctttatgttccaattcttgaaagaaactggtatttagatgaaattaggtgattgacttttagactgggcaaaattaaactacaaaggatggcttaaaaaactgagaatggagcaagtgaggctccctattcatgctatgagagtctgtttttggactccttagagcaaggtatagtagcgctgaattctttcatgaatgccacctcctttttttctctttcatcctctttttcaaaattgatacataaaattatacatatttatggggcacatgcaaaatttcattacatgcatgaatgtgtaatgatcaagtcagggtgtttggggtatccatcatcttgagtatttatcatttgtatatgttgggaacctttcaagtcctctcttctagttacattgaaatatataacagattgttgctaactatagtcaccctactctacttttgaaaattagaacttgtaccctctaactaactgtatatttgtacccattaaccaacctctcttcatcccccctcccacccacacatccttctcatcctctggtatcttatcactttactctctaccttcatgagataaacttcatgagtaaagttcatgagataaattttttagctcccacatatgattgagaatatgtgatactagtttatctgtgcctggcttatttcacttaacataatgacctcctcttcaatccatgttgctgcaaaagacataatttcattctttgttatagccaaatactattccattgtgtatagccacattttctttatccattcatccattgatggacacttaggttgactccatatctttactcttgtgaatagtgctggaataaacatgagtgcaggtatgtcttcaacatatggatttattttcctttggataaatacccaatagtgggattgctggatcatatgatggttctattttttagatttttaacaaaaatctactattttccatagtggctagaccaatttaccttccatcaacagtgtataagagttcctttttctgtgtatccttgctagcatctgttctttctttgtctttttagtaatagccattctaattggggtaagatgataggtatctcattgtggttttgatttacatttccctgatgattagtgatgttgagcattttttcatatacttgttggtcatttgtatgtcttcttttgagaaatgcctattcagatcctttatccactttttaatgggattatttgtgtttctcaaactattgagttgtttgagttccttgtgtattatcttgcatattagttccttgttgaacgagtggtttgcaaatattttctcccattcatctgctgtctttttactcttgtttttcttgctgggtagaagctttttagtttcatgtagcttaatgtctctattttttgttgttgttatctgtgcttttgaggtcttaggcataaaatccttgcctagactaatgtcctgaagtattttccttatgttttcttctagtaattttatagttttgggtcttgagttgatttttgtatatgtatggtaagagataggggtccagtttcattgttttgtgtatggatatccagttttcccagcaccatttattgaagagggtgtcctttcccaaaagtatgttcttggtgcctttgtcaaaaatcagttggctgtaaatatgtggatttatttttggattatctattttgttccattgatcaatgtgttagtttttataccaataccatgctgttttggtttctatagccttttaatatatttctaagtcaggtagtgtgatacctccagctttgtcgtttttgctcaggattgctttggctacttgggctcttttttggttctatacaaattttaggattgctttttctatttctatgaaaaataacattggccaggcatggtggctcacgcctgtaatcccagcactttgggaagctgaggcaggtggattgcctgaggtcaggagtttgagaccagcctgaccaacatagtgaaactccatctctactaaaaatacaaaaaactagctgggtgtggtgatgggtgcctgtaatcccagctacttgggaggttgaggcaggagaatcacttgaactcaggagatggaggttgcaatgagcctagattgcaccattgcactccagcctgggcaacaagagtgaaactctgtctcaataaaaaagaaaaagaaaaaaacagaaaaataacattagtatttttgtaggcattgcattgaatttatagattgttttgggcattatggtcattttaacaatattaattcttcccatccaagagcataggatatctttccatttgtttatgttctcttgaatttctttcatagttttatagtttttcttacagagatctttcactttcttggttaaatttattcttaggtatttttttgtggctattgtaaatgagattgtcttcttgatttctttttcagctagtttgatatttatgtataaaaatgctactgatttttgcatgttgattttgtatcctgtaactttactgaaattatttatcaggtctaagagtttttttggtggagtctttaagtttttctagatataagattatatcataggcagagaggggcagtttgacttccttttttccaatttggatgtcttttctttgtttctcttgcctgattgctctggctaggatttccagtattgtgttaaatgggagtggtgaagtggacatccttgtcttgttctagttcttagagaaaaggctttctggttttcctcattgagtataatgttagctgtgtgtttgtcatatatgggctttatcatattgagttgtgttcttctatgcctagtttgctgagaatttttgtgatgaagtggtgctgatttttatcagatgcgttttctgcatgtgttgagattatcatgtggtttttgtcctttattctgttgatgtgatgtgtcatgtttattgatttgtatatgttgaactattcttgcatccctgggataaagcccacttgaacatgtatattgtttttttgatgtgctattggatgtgatttgctagtattaagatgaggacttttacctctatgttcattaaagatactgcctgtggttttctttttttgttgagtctttctccggttttggaatcaggataatgctgatcttatggaatgaattagagataattccctctgcttcagttatttggggtagtttgggggaaaattggtgttagttcttctttggaagtttggtagaattcggcattgaagccatttggtcccggacttttctttgttggaaaacttgttactactgactcaatctcattatctgtttttgtctgttcacattttctgtttcttcctcattcaatccaggtaggttgtatgtaccagaaatttattaatttatctcctctaggttttctggtttgttattatatagctgtttatagtagtctctgatgatcttttatatttctgtggtatcagttgtaatgtctcctttttcatttctgattttatttgggtctttgctcttcttttctgtgttagtatagcaagtagcttatcaattttgtttatctttccaaaaacaactaaatttccattttgttgatcttttatatgttttttagtttctgtttaagttctgctctgatttttattattttttcttctcctaattttgcgtttgttttttcctgcttttttagttccttcaggtgtattttcagattatgtatttgaaatctttatactttttaaaaatttttattttattttaaattcagagggtatgtgtgcaggtttcttatgtggatatattgcataacgtttgggtttgggcttctggtatttccatcacccacatagtgaacattgtacccaataggtaatttttaaaccttcacccccttacaccctctctccttttggagtccccactgtctattatttccatctttatgttcgtgcatacccattgtttagctcccacttataagtgaggacatgcaatatttgattttctgttcctgagttattttacttgggataatggccttaagttccattcatattactgcaaaggacatgatttcattcttttttttctttttctttttttttttttttgagatagagtcttgctctgtcaccagactggagtgcagtggcatgatctcggctcactgcaatctccgcctcttgggttcaagtgattcgcctgcctcagcctcctaagtagctgggattataggtgcacgccaccacacccagctaattttttgtatttttagtacagatggggtttcaccatgttggctaggatggtctcgatctcctgacctcatgatccgcccaccccgtgtcccaaagtgctgggattacaggcatgagccactgcgcccggccaatttcattctttttaatggatgcacagtattacatgatgtgtaggtaccacattttctttttccaatcagttgttgatagaccctttggttttttttttttttttcttgagacgatgtctcactctgtcgcccaggctgaagtgcagtggcgcgatcgcagctcactgcaacttccgcctcccaggttcaagcgattctcctgcctcagccttccatgtagctgggactacaggtacgcgccaccacaccaccacacccgttatttatagtctttgtttctttctttttagtagagacaaggtttaaccgtgttagccaggatagtctcgatctcctgacctcgtgatccacccacctcagctcccaaagtgctgggattacaggagtgagccactgtgcccagcctgatagacacttaagttgattcaatcactttgctattgtggatactgctgcaataaacatgagtgcaggtgtcttttttatatgatgataaactctttctacctttttgatgtaggtgtttattgctataatgaacttccctcttagcactgcttttgctgcatcccataggtttgatttgttgtgttttgatttttaattgttttaagaattttttttatttcatccttgaccgagtggtcattcagtagcacgttgtttaatttctatgtgtttgtatggtttcaaaagttcctcttgttattgatttatggttttattttgatgtggtctgagaaaatacttgatatgatttcatttttaaataattagttgagacttgttttgtgtcctaatgtatagtgtattctgctgagtgttccatgtgcttatgagaagaacatttattctgtaactgttggatgaaatgttttgaaatatctgttaggtccatgtggtctaatatgcactttaaatccaatgtttctttgcaaattttctatctagaggctaattctgagagtgggatgttgaagttcctaattattattatactgaagtctttctcactatttaggtctaatagtattttctttatatacctgggtgctccagtgttgggtggaaatatatttagaattgttatattctcttgtggaattgatctctttatcattttataatgatgacctttttttttctttttactgttttgacttaaaatctgttttatctaagtatagctactcctgcttttgcttcttattggcatggaatatattttttccattcctttcctttcagcctgtatgtgtctttacaggaaagatgagttacttataggcagcatatagttgggtcatgttttatttatttatttatttttaattctttgaacctgtctatattttttaagtggaatatttaatccatttacattcaaggttgctattgatatatgaggccttattcctgtcattttattaattgaagtcattgttatttatattctttgtttctttcattctctcttattgtttatctttgtggtttggtggttttctgtagaggtaatatttgagtctttttatttgtgtttgcttcaccagtggtttttatattttcatatgttttcatgagggtagatttcattcttttgcttctagatgtaggactcccttaagcctttattggaggatgggtctagtgatgatgaattttctcagcatttacttatctgggaaatactttagttctctttcatttatgaaggataaattttctgggtatagtatacatggctgtcagttttttttctttcagctcttgtgaatatatcatcctaaactcttttgacctgtaagctttctgtggagaaatctgctgttagtctgatggggattcctttataaatgattagatacttttttcttgctgtttttggaattttctctttgtctttgacttttgacagtttgactataatgtgctgtggagaagtcccttttgagttgtatctgtttggggatctgtgcacctcctgaatctggatgtctaaatctcttgctagggtagagaactttttatctattatttcactaaataggttttctgactctctcattttctcttcatcttctggaacaccaaaaatgcaaatatttggtcactttatggtatcctatgtcatctaggctttgctcattctttgtttttcttttttctttatttttgtctgactaggttatttcattagacctgtcttcaagttctgagattccgtcttctgcttgatttagtttactattgaagcttttgaatatattttgtatttcactggttgaattcttcagctccagaatttctgttttattcttttttatgatatgtttttggtaaatttctcatttatatcccaaatatctggcttatttgtattgtttttcagagttcttctgtatctcactgagtttctttagtatacatattttgaattatttttctgggattttgtaaatttctctttggggttgattgctagagaattactacattcttttggaggtggcatatttccttctttttcatgtttcatgtgtccttatgttgctctctgcacatcttgtgtaacagttgcttctttcaacttttttgagtttgctttataggggagaactttttttttttgaagatgtatcatggtattggttggatagggcacttggctttgattctgggtgtgtgcagtagtacagcttctatgtaatttctttggcgctaaacagcatcagtggtgtctgtgatttctttggtggcttagggtgtgattgttaatggaagctgtggtgaaattttgctggggactgggatgccaggtgggccagttttggggccccagtggtggcagcagtgagctgagtgtgcctgtccttgggccttagggtggtgtatgctggcactggcagtgggtccagaaaggcctattcttgagcctccaggtgacttgcttaggtgccaggaatggcagtgtgggtcaggcaggtaggcaggttctcggtcccctgggcggctggcatggagtgagtgatggcagtatcaatggtgggacaattgtctgggacaaaagtagtctgtgctggtgttggcagtggctgtgacaggctgggtgggcctgtctccagggccttaggagagtgtgtgggtgggtgccagctgtggtggtagcagcaggttgggtgggcctgaccgcaggctctgggaggagtacccgggtgccagtgatggtggacttaactgtttgatcaccaggtccttagatggcacgcttacttactggaggatgaatcttcaggtggggtttgacgcatctgtactacagccctgctactgaggagggcaagatgcctttcagtgggagcaactgtaagcaggcggctgggacgcatgcactttgctcatgctttggccttgcagtagcccatagtggcagtggctgtgggcatttgaatttgtccttggggtgtgtgaaaatgcatgacccttctgctgctggggtgaggttgctgccagtggctcctgcattggccctggcagaggctgctgcaggcagcgaatgtaaatggcactccagggatgtggggatgcaggggctgttgggacccagggaatgatgcagtctgatgggggctgagttctcaaaatggtgctgtgccatgcctgtttaggactcagggtttgtaggactcagtatgagctctctctggagcaatactattgcacagtctccaggcagctctctatgttggtctcagggcctgcaggggtcaagtcttttcctgtgtttctcctatgactaggattgcaggagttcacagtgggaacgtggactgctgggggatctcttacttatcatttccccacattagggagcctctccaggctcccagctgatctcagtcaagcaggctgacttgcttccctttcctttcttgctttaggtgtttctgtcacttccctgttgaatgccagtgttctttcttagaggatctattttaagtgtgattaactacttgctatttgggttcttctttgtggaagagaagagtaccagatgcatctagtcagccatcttgaacttgctaccttctactttcactgacattcaaattataaatctttagagaaataatggagatacttatactttttctttcctaacattgaaatgtgttttgattaaagacaacaatgccttgtatagcagggatatagcttatttatgtttgtcttcttagtgcctgccacagaatggctactcagtaatttagtgaataaaagagtaaatgcattgatggatgaatgaaaatccctcggttatcagtgtggaaatttttaatcattagctatgttatcctgcctgtttggccttttcaggaacctatctctactaggtaagtcctcactagggcattaggctctaaattctaatctctagtgttactgttaccatgattttcagaaaggaattaacttcctcccattttaatgaaacataaaatgctcttgcatatgttttaatagaattaacacagtatgatttctggttgaaataatcttttttcatttttgcttattaataaataatgtatcaatagtgaatgatttatcataagtaaatggtaaaatacaattcacacagattgtcccttgaggtctaatatcttttgtataaaaaaagtttttaaaaataaatattttgtgatggtcataggcttctgaagttattagaaagggatatatggattataggaaatattttcctgataatatggtagaataaaatttttctagtttttatggtgattctttactttccttttagacaattccgtgtgtgtatgtgtgtgtgtgtgttgtgtgtgtgtgttatacttgcatctgtttcttcatctgtgcccaaaaagtgggttctcaaattttcagttagctttctattcttatctctctgtagacagcttctcctttggaaaatagcatctattttcagggattcaaatattacttctttcaagttaattcaataatatttctctttagttttaatccacaactgagctccaattctaatatcatcaaattatgtaatgtacatttccacctggaggtctcccagacagtccaggttcagcatgtctgaaatcaatttttttcacttttatcattctccctagcttcagagacttgggctcaccttccatcccactctctgtatctccctccctgcagttttttcttttcttttcctgggaggtagcttttgtatcatttcccttctcattgttcctctcccaattcagccatttatcctattgtcccataatagatttccttatagctacttaacttttcttctagtctactcccacctccctgaacaaatataaactggatacaactgtttacttcagcatattgctttcctctaaataacttcccatgccttatatactctgtagttaatatctaaactcattagcctggaattcaaaatctgaattttgccccactctgcatttctggttttggttccagtccttcagcttctgaaatctacctcagcaggtcagcacatgtactctttaacatgtcttgattttctgttttttttctcatgtcccttttttatctcagttttcttttcatgaatctatcccatttcaggaagctaggtttttgttgttttggactcttctcagaattcctgtagcacttatataagccatttatttaatagttaattgttgacagtgtgacattttctatatttttgtcctatgttatttatttcaagttttctcatttttttcacatgattatatgcttcttcacaaactaactgtgaagtcctaaaatagtctttaagatcagagactatatataatatctttaaatattttttttgttttttttgagacggagttttgcttttgttgctcaggctggagtgcaatggcagggtcttggctcactgcaacctctgcctcctgggttcaaatgattctcctgcctcagctttccaagtagctggaattacaggcgcccaccaccatgcccagctaatttttgtgcttttttttttagtagagacagggtttcactatgttggccagcctggttgcgaactcctgacctcaggtgatccacccacctcggcctccaaagtgctgggattacaggcgtgagccaccgcacacggcctaaaatgtttttataatactgaagtaaaacctcaaaagacccataatttcttaattataattaagcttttattgagttatatcttttgtaatactttctatgtataaaatattatttcaaaaaacattgaaaactttacgaagactctcctgtgtgccaagaacaagtcttaggagctgctaactctgttcatctcaccccagtatagtactgtataaagcgtaataattggtaacattagttgataaagcaaaaaaattaactcatcagtcaaaagaaatatccaattaaagttgagtgggccctatttgtacatgttttagtgactgtactcatagtaatctataaaaataattccaggagtctccttcagagaggacattaatctattaagatattaagcttatacaatagatgattcataatctctaaatatgaaaataatgtaaacattttcaaaaaggagtaaaatgacatagaggaagttatacttgtaaaattatgagtgagtaagtgacctacaaacacataaatattttagcattaaatgactgaattaatgaatgaattagagaataaatgaaccaccatagagatattattgtcaattcaaagataccttctaagttgttgcagcattggaaggagaaatctagaaagagaaaataatggatgtcttttaaaaaatcaagacttttttttagagcagttttaagtttgcttaaacacttctgcttaatttttaaagaaaaatggagcagaaaacccagttttcatatttccccttacatacccctacacagaggtttccatgttattagcaccttgcattattgtagtacatttgttacaatattgaaccaatattgatgcattattattattaactaaagtccacagtttacattagggctccttccttgtgttgtacagttctatgggctttgccaaatacataatgttatgtatccactacagtattatacaggatagtttcactgccctaaaaaactcctttgcttcacctacttatctttcccccttgccttttaccaggtggattcacagctgaattctatcaaacattcaaagaagaattgataccaatcctattgacactattccacaagatagagaaagagggaatcctccctaaatcattctgtaaagccagtgtctccctaatacaaaaccaggaaaggacataacaaaaaaaggaaaactatggcccaatgtccctgatgaacatagatggaaaaatcctcaatgaaatactagctaaccaacttcaacagcatatcagaaagataatccaccatgattaagtgggtttcataccagggatgcagggatggtttaacatacacaagtcaataaatgtgatacaccgcataaacaggattaagaacaaaaatcccttgatcatctcaatagaagcagaaaaagcacttgacaaaatccagtatccctttatgacaaaaacctcagcaaaattggcatagaagagacatacataccttaactggaacatgacaggggaaacaaaagctctggttttcattgagtatttaaataattaaactttttctccaataaaaacttatcaattatacttttttttgggggggggcggtggacagagtttcactcttgttgcccagggtggagtgcaatggtgcgatcttggctcactgcaacctccgcctactgtgttcaagcgattcttctgcctcagcctcctgagtagctgggattacaggcatgtgccaccacgccaagctaattttgtatttttagtagagatggggtttctccatgttggtcaggctggtcttgaactcccaacctcaggtgatccgcctgcctcagcctcccaaagtgctgggattacaggtgtgagccactgcacctggccaattatacttcttttaaaaaattttctgatgcccagcgttggccatatacataaataacactatattgctttataagtagtgcaggtattcccaattcctgcctcccatcctttataatatttttgttattcattttacttatccataagctatagtcattgaatacattgttcctattattattttgaatacattgttgtctgtaacattcatcttttctttatataatccaagtttctaacctaagccattatcctctcttcttaagaggttcttaagaacctctgttaactttttttatccccccaagacagagtctcgctctgtcgcccaggctggagtgctgtggtgcaatcacggctcactgcaatctccacttcccaagttcaagcaattctcctgcctcagcctcctgaatagctgggattacaggcgcatgccaccatgcccagctaatttttgtatttttagtagagatggggtttcaccattttggccagactggtctcgaactcctgatctcatgatccacctaccttggcctcccaaagtgccgggattgcaggtgtgagccaccacacccggccaacacttctttcaagataaatttcctcatttatcagttctaggagctttttggaggagtctttagggttttcttggtatacaatcatatcatcagcaaacagcgacagtttgactaactctttaatgatttagatcccctttatttctttctgttgtctgatagctctggctaggacttccagtactatgttgaatataggtgatgagagtgggcatccttgtcttgttccagttctcaggggaaatgctttcaagttttccccattcagtataatgttggctgtgggtttgtcataggtagcttttattatgttaaggtatgtttcttctatgtcgattttgttgagggttttcatcataaagggatgctggattttgtcaggtgctttttctgcttctattgagatgatcatgggatttttgtttttaattctttttacatggtgtatcacatttattgagttgcatatgttaaaccatccctgcatccctggtatgaaacccacttaatcatggtggattatctttctgatatgctgttgaagttggttagctagtatttcgttgaggatttttgcatctatgttcattagggatattgggccttagttttcctttttttattatgtgcttttctggttttggtattagggagatactggcttcatagaatgatttagggaggattccctctttatcttgtgaagtagtgtcaataggattggtatcaattcttctttgaatgtttgatagaattcagctgtgaatccatcttgtcttgggctttttttgttggcaattttttaaaattaccatttcagtctcgctgcttattattggtctgttcagagtttctatttcttcctggtttaatccaggagtgttgtatatggccaggaatttgtccatcttttctaggttttctagtttatgcacataaaggtgttcatagtagccttgaatgactttttttgtatttctgtggtatcagttgtaatatctcccatttcatctctaattgagcttatttggatcttctctcttcttggttagtctcactaacgttattaagtttgttaattaattttcgaataaccagctttttgttttatttatcttttgtattactatttttgtttcaatttcatttacttctgctctgatatttgttatttcttttcttcttctggatttggatttggtttgttcttgtttctctagttccttgaggtatgaccttagattgactatttgtgctttctcagacttttagatgtgggctttagatggactttcctcctagtgccatttttgctgtatcccagaatgtgataggctgtgtcactattgttgttcagttcaaagaattttaaaagtttcatctgaattttattgattgttgactcaacaatcattcaggagcaggttatttaacttccatgcatttacatggttttgagtgttctttttggagttgatttccaactttattccactgtggtctgagagagttcttgatataatttcaattttctttattgagactcgttttgtgggctatcatgttgtctatcttggagaatgttccatgtgctgatgaatagaatgtatattctgcagttgttgggtagaatgttcagtaaatatctgttaagtccatttgttctaaggtatagattaaatccattgtttctttgttgactttctgtcttgatgacctgtctagtgctgtcagtagagtattaaagtcccacagtattattgtgttgctgtctatctcatttcttaggtctaatagtaattgttttataaattcgggagctgccgtgttaggtgtatatatatttaggattgtgatattttcctattggacaagttcttttatcattatataattttcctctttgtctttttaaactgctgttgctttgaagtatgctttgcctgatataggaataggtactcctgcttgcttttggtgtccatttgcatggaatatctttttccacccttttaccttaagtttatgtgagtcctttttgttaggtgagcctctgaaagacagcagatagttagttggtgagttcttatccattctgccattccgtacctttttttttttttttttttgagatggagtcttgctctgttgcccaggctggaatgcagtggcatgatctcggctcactgcaacttccacctcctgggtttaagcaattctcctgcctcagcctcctgagtaggttggataacaggtgcctgccaccacaccctgctaatttttgtatttttagtagagacggggttttgccatgttggccaggcaggtcttaaactcctgacctcaagtgatccacctgcctcggcctcccaaaatgctgggattataggcatgagccactgcacccagccagcattctgtatcttttatgtggattattttaggacattttcattcaacattagtattgagatgtgaggtactattctatatattatgcgattttttgcctgaataccttggtttttttcattgtgttttcgtcttataggtcctttgagatttatgctttaaggaggttctattttggtgtattttgaggatttgtttcaagatttggagctccttttagcagtgctggtttggtagtggtgaattctttcagcatttgtttgtgtgaaaaagactatctttccttcatttatgaagcttagtttcactggatagaaaattctttgctgatactgatttagtttaaggagactaaagataggaccccaatcacttctagcttgtagggtttctggtgggaaatctgctgttaatctggtaggttttcttttatagttacctgatgcttttgccttacagctcttaagattctttccttcatctttagataacctgatgactgtgtttctaggtgatgatctttttgcgataaattttccagattttctttgagcttcttgtatttggatgtccagatctctagcaaggccagggaaattttcctcgattatcccctcaaatatgttttccaaacttttagatttcttttcttccttgggaccaccaattattcttaggtttggtcattcaacttcttaaagtctttgttcatttttcttttcgtctttgttagattgaattaattcgaaagccctctctttgatctctgaagttctttcttctacttttttgatgttattgatgagactttctggtgtgttttgcatttctctaagtgtgtccttcatttcgagaagttgtgattattttttatttatgctatctattgcagtgaagatttttcacttcagatcttgtattatttttaaaattaaatttatttggacttcacctttctctggtttccctgattcacttagtataatcgaccttctgaattctttttctggcaattcagagatttttatcttggtttggatctattgctggtgagctagtgtggtcttttgggagtgttaaagaaccttgttttgtcatattaccagaattgtttttctagttccttctcatttgggtagactatgctagagggaagatctagggctcaagggctgctgttcagattctgctgtcccacagggtgctcccttgatgtggtgctttccctcttcccctaaggatgtggcttcctgagagccaaactgcagtgattgttatttctcttctggatctagccacccaagagagctacgaggctctgggctggtactggggagtgtctgcacagtgtcctgtgatatgtgaaccattttcaggtttctcaaccatggataccagcacctgctatgattgaggttccaagggattgaagtggactctgtgagggtccttggttgtgtttttgtgaagtgtactggttttgtgttggtttgcctccagtcaggaggtggtgctctcaagagtgtatcagctagggttgtatagggaggatacaagcttgccctagggttgccgttggataagtattcaggtttctcaggtggtgggcagagccctagagttcccaagggattatgtcctttgtctttggctaccagggctggtagacaaagatcatcaggttgggggaggattagacatgtctgatctcagactcttcttgggcgggtcttgctgtggctgctgtgggggatgaggatttggttctcaggctaatggagttatgttcctagggggattatggcttcctctgctgtaacatgcatgtttccagggaagtcagggaaagctagcagttataggcctcacccagctcccatacagcccaaaaggctggtctcactcccaccatgcccctccaacagcactgagtttatttccaggtagcaggtgaacagggctaagaacttgccccaggcctcccggctgagaaagcaagtggggctttcaagtttcatgcctccccacctgccatggcttctgtgctgtgtctatacacgtgatttgcccccttcccaaggttttgtccaggaagctttgtgtgcagttgaaattgttacaaagtttagctggaagtttccttcttcctatggtcttttcccagttcctttggcagcccttcccatggacccctgtgagacaaagtcagaaatggcttccctggggaccaagagtgcccacaggactctttctgctgcttcttctaccgttgtatttcactcagttctctaaatttgtctcagctccaggtaaggtcaaatccttttcctgtgatctggaacttcaagttcctcagtgagagtgtgtgttccagggcagatgattcccctttcacactttcacactctgggcactagcagtttttcagctgtctcttggggcctgcaacagcaatcttccttcttcaaagggtctctggattctcttggttttcctggtatgttcctgccatagttcttggaggaaaagttcataatgtgaatctccacatgctgctctgtccatctgagtgggagctgcaaggtagtcctgcctcctatctgtcattttttcccacatcttagcctacattttcttctactgctcttgtttatgtttcccctcttgtctttgggtttccctaaagactccttcttaaataggacctatgacttgcagttctttcagctgtaatccactgttattattcaggaacctaattgctgtgctaatgaagtgtggagggagggaaagtgttctgtgttcctatgattaggttttattttgtgctaatgaagtgtggagggagggaaagtgttctgtgatcctatgattaggttttattttgtatatgagtcggtttccccagtctgtaaccttcacaagtgcttctactccattgcccctcatgtgagacaggaagtctagaggtgtttgaagttaggcattcctcttcaccagtgtcaaagacacagggtgctagagttggatattttcctgcccccaagtgagttaggctctcataaatcacagatgagataatctctggcaaagtagtttctttttaatttgatttttattattaatatctgctgggaaaccgatcacaacttgttcaaattgttcctaaaatcagagcaagcagatattgggtgacagcttcaaaaactgtcttctgaattatgaatgtaaacttaataacataaactttgagacatttattaattatctttcagggttttggcatttggtggatgagattgccaacctaatgtcttataggcaaatgaggtttaatcttgttgtcctaatttttcatgcattacttattaaaattaagctccaaacaaatataaatatagttcagcattagtagggaatccagcgatatgtctcctgtaaatgttactaacggttgttagctgtatttgtaagtttacattgatcttggacttcccaatgccattacctaaaatgtagaatccagaatgaatctaacttgaacctatttttcttcctggtttattagagatgtttatctgagagattactatgaatcataggattgtgagattgcctgtggtgacagaaggcatttttccaaatgtagagcttctgcaagtcttcaaaataattaaaattcataaaacacatgtaacagatggcataagtgtttgaactaaatgtgtgtgactttttactacttagttttacataataatgtgtttgtgcagttaaggtggtgacctctcatgataacttctacagatacataaagtgaaatgtgctctctggagttgctaaaatgtgacaattttagaatagatatgaaagtacttttctaatgatttttctataagttcaccattgtaatatcaaattacaaactcctgtcatttggagtttcttttctttgatatttagtcctttccttcaccaaaatggcttgagagaattaactggcagttagtgctgtgttctatagcattcagtttttcctgttaaaccttaaaagccatgtgtatttgaaacttttaattatgttttaaatatctctttgaatataagaagaaatgttatgctcttcatttttatcttggttttgaggagctaaaatcagttcttatccatcaactatcccctttacctcaaaataatacaaccataattctgacttgattatctgtgggtaatggtagatttgtgttaactcatctgtttcgattatatattgctgtgtgagaaaccattcccaaatttaggagcttaaatcaataaccattcctgttgaaacaaagatcaaatccttaagaattagtttagtgagaaatatgcaaaacctgtactaggaaaaagtttaaatactccagaaacacataagtagagttgaaaaatagagacttcccctctttgtatacaaacactcaacattattaagatgttagttctccttactacattagtgtacaaacttaatgcaataccaacaaatgtcccaagaaactattttatggaattagatcctatatttgttgatcatgtatttgtattgttacaaacatgtaacaaaagttaggaaaaggccaaaaaagagaaaactacaagtgatggctagccctatcagacattaaaacctagtaaaataggagatatcttctttttttttttttttttgagaaggagttttgcttttgttgcccaggcttttgttgcccaggctggagtgcaatggcactatctcggctcactgctacctccacctcctgggttcaagcaattctcctgcctcagcctcccaagtagctgggattacaggtatgcaccaccacgcctggctaattttgtatttttagtagagacggggtttcttcttattggtcaggctggtctcgaacctccaacctcaggtgatctgcccgcctcggcctcccaaagtgctgggattgcaggtgtgagccaccacgtcaagccgagatttcttctataactaaaacaccgttatactcatgcttgtatcgaccaatgaccagtgaaataggatagaatgtccagaaataaattcaactacatctggaaatttagcatgtgataaatatagcatctcaaatgactgggctaaagacagacattttagtaaatggttctggaagaactagatcaccatttggaaaaagatattttataccatgtcttatattacacccaaaaataatgcactagggatctaaatgtaaaaaataaaaccatacaagcactagaagaaaataaaagtgcatttttctttaaattttgtatagggaaaggctttttaactctgacttaaaatcagaggcaataaaagagaagattgataaatttaacacataaaacattaaaaaaattttatgctcaaactactataaatgaagtcaaaagacaactgacaaagtgcaaggaaatattcacaacatctagggaaaaggctgatatctctaatacataaaggaaaaaggctgatatccctaatacataaaaaactcttaaaaatgaagaggcaaaagatcaaaaagtctaaagaaatcttctcaccacaaagaaatgataaatgcatgaggtgatggataaagtagctactctgattggatcattatactacatagatatgtattgaaatatcaaattttaacccataatcatgtacaatcataatgtaccaattaaaaaataataatttttaaaaatgaggaacatatctatgaatttatttggagtaatttctagaatattctgttatgaaaaaatagcaaagtgcaaaagaatgtctccagggcacttctttcatatgagaaagaaggagatattagaaagtacttttgtgttctgctcatttgtgagaaaaacatatacaggagttaataggtaagactctgaagaaattagttatgtacatggattgagtagaaatgggttggaataaaggagaataacagcagagtagtatggatgaggaaggcataccttttttgtacggctttgactcttagaatcatagtaatattttacacagaaaacaaagtaaataattgaaatcagccaagtcagctttttttttttttttttttttttgaccgtagtgaggagtcatctagaggtttgacttggatgtagagaaagtttggtctctcttccttgtcatgtagtctcacggccttttcagtaacttccccctttatctctgcagcaagatatcctgtacttcttacacgatggttccaaactccaagagtataagagcaaaagctaccaagcattcctaatgtctaggctcagaaatcccagaacatcatttcctccatattctattgtcaaagcagtcataggctagcaaaaaaccaaaggtgtggaggatgacttttacctctgggtgagagaatggtttgtgcatacaggagggaaggaattgatagtgactatctttggagtttagagatcattgactgatatcagactatgtctcatgatgtagcctgactgtagaagagggaagagccaaatgactcacaaaggagcatagtctcttgtgggatgtcatatttacttttttgaaaataactgagcagtcattagattatcaactgaaatctttctgattgtaagaagatatgttactatttctgagattttctttgtaactgaaagtagatagctagtattgcaactacatagtgtaacataataaatctttttacatggtaggtcatcataatgttgattattcttgtgcccttgctaagttttctatttttaatcttcatacttttcaactattcttcattttcattgttagcagataaatgtactattctgtctatctactgtggccattctccaatttgccattgattgattcactcatttatttacttaacaaacaaatatttgtttgattacattagaaacacaaagatgagtaagaaatcatttttgcatcaagattagtctaacaaaggggaaagactaattaaaacacaatagacatatgacacaaatatgttggaaataggcttgtttggggacgttttaccaaagatatgatatttgtgccagaatttgaaggatttattgttcttcaagtggtggaagtacagtagagcattttaaaaagactcagtagcccaggccttggctcaaaggtctgagagtatgtctgacaagatgggatgctcagactagatagtgtgtctagaatattagtgtaaaattagaaattgttttacattttaaaaaattgtagtaaatataaataagatataattttccattttagccattttaaagtgtataattcagtgaaattaactccatttacattgttgcataaccatcaccactttccatctccagaacttaccatcccaaaccaaaacgctgtacccattaaacaataactttctattaccccttcctcaacctctggcaaccaccattctgctttctatctctatggatcaaattagaaattgaaaatttctgttctctagactgttattgggtattacacagtaggtaagtagcagtcctagcgagggagaaaaaaaaaaggatggagagtttgttgcttattatagctgaatttctactgcttggatggaaacatatgacccccacaggtttaatgcagagagtgtgttttagaagataaacttctagttcattatgtaaatattttttgatacattccaggttaattcttgcttgatattctatggtgagtgcattgagatattactcccaaactggccacttggttaaactagaatagtatattatttagtggtataataaagagtataattgctgagattttcatctgtttttattcttttgttgcagttttcttttttaaaaacttatacgaattttttaaattgcctgaggtgttgttcaggcatttagattatctttcttttcagtctaagagtaattatgaagcaataaaactgccagagaaaagtaaaagttgaagtaattaatattttattattttcttttatcttatttttctgtttatgttagtttgaaatcattgatttatatatgagtgtagtgatcagtagtagaataaaagtgccactttgtttaattcttacaatatcttaaaagaatgttaatagtaaattgctcaaatattagacattgtgcaaagaaattacaatacaaatcaagtgtcttgtgtttcatattttaaagttattttttataaatatgtattataaagtagactagtaatttagtaaggatatatgtgttaatcatactttgacttggaagaaacatgtattcactatctgaaaatttatacagaaagattgcttatctttctatttcttttctgtagtttcagttaattaattttgttagtaaggttgttattctgtcattacattttttttttttttttagacagggtctctctctctgttgcccaggctggagtgcagtggtggtgatcttggctcagtgcagccctgacttcctgggctcaagtgatccatccacctcagcctcccaaatagatgagactacaggtgcacgccaccacacctggctaattttttattttttgttgaaatgggatctcattatgttgcccaggctggtctcaaactcctgggctcaagcattccttccgccttggcctcccaaagcactgtaattataggtgtgagccactgtgcctggccctctgtcatttcttgactatattatcctcacaatagagtgacgaaaatgatggggaaccatcattttgctaagcactgattattttttttgcttcagatttaaaaaaatcaagatacagttcacgtaccataaaacttacctctttaaagtatatattttgctggcttttagtgtatttataaatttgtgaagccatcaccactatctaattccggatctttttttttttccccagaaggaaatcctccacccctcaactttgtcacatcccatttcccctcctccagctcgtagcagtcactaatttacttttcatctctataaattggcctcttctggacatttcagataaatataatggaaatatataatctgtgacctttcgtgtctggcttcttttacctagcataatgctttgaagagtcatcaacattgtagcatgcatcagtacttcattctttttgatggccaaatactattctattatatggctataccaaaatttgtttatacattcatcagttgatagaaatttgagttgtttctattttctggctattgtgaataattcttctgtgaatatttgtttgcaagattttgtgtggatatcttttcagttctcttggttagatacccaggagtggaattgctgtcatgtgctaactctatgtttaaccttttgaagaactaccaaactttttcccacagaggctacaccattttacattcctaccagccatgtatgagggttccaatttcttttcattcctgctaacacttataattttccattaaaggaaaaacctatagccatcctagtgaagtagtattacactgtgtattttatttttattttccaaatgactaaggatgaagagcatcttttcatgtgcttactgatcagttgtctttggagaaatgtctattcaaattctttacccattttttgttgatttatttagtcttttttattattgagttgttaggttttttcatattataatactagacctttatcaggtatatgatttgtaaatatttttttccatcctttgggttgtcttttcactttcttgatagtgtcctttgaagcacagaacttattagttttgatgaagtccaatttatctatttttaagtgtggttgcctgtacctttgttgtatataagaaactattgcctaattcagggttatgaatatttacccttatgttttcttcttagagttatatagcatataaatgtagtgttttagctcttatatttaggtctttggtctgtcttgagttaaattttatatgtgatgaaggtccacaaatgttagtttttaaaaatactcttaagtgtgagatgaaaaagcacttacagtttgggagctttttttctcccgggtcactttctcctgtttctttagcttcaatagaaagactctggactcagtgcttgcactgccttttgcctggactgctcttttccaggccttttgcttgactggctccttctcatcattcacactgcagagtgttcttctctaacttttctagctagatcagctaaccctttcataccccaccgagtttaattcttcacaactaaatatatctagttaattttaactttaagttcagtggtgtgagtgcagtttgttgtctgtatgacaaacccccatgacacaagtttacctatgtaacctatttgttacataggtaaacttgtgtcatgggggtttgtcatacagattatttcatcacccgggtattaagcctaggcttaataaaattggttatttttcctgatcctctccctccttccactctcctccttctgataggccccagtgtgtgttgttcccctctatgggtccatatgttctcatcatttagctctcacttataagtgagaacatgctgtatttggttttctgttcctgtgttagtttgctaaggataatggcctttagctccatctatgtccttgtaaagcatgtgatcatgttgtttattgtagctgcatagtattccatggcatatatatactacattttctttatctagtctatcactgatggcatttaggttgattccatgtctttgctattatgaatagtgttgcaataaacagacacgtgcatgtgtctttataatagaaagatttatatatttttggggtatatacccagtactgggattgctgggttgaatggtagttctgtctttaggtcttggagcaatcacaaccacagtggttgaagtaattaatactcccatcctggacgtataaattatacagtgtataagcattcctttttctctacaaccacactagcatctgttattttgtgactttttaataatagtcattctgactggtgtggtatagtatctcattgtggttttgatttgcatttctctagtgatcagtgatgtggagcttttttcatatgattgttggctgcatatatgtcttcttctgaaaagtcctgttcatttcctttgccctctttgtaatggggttgtttactttttccttgtaaatttgtttaagttccttagagatgctggatattagacctttgtcagatgcatagtttgcaaaaattttctttcattctctaggttgtctgtttacttttttgatagtttcctttgctgtgcaggagttctttagtttaattagatctcatttgtcaatttttacttttgttacaatttggcatcttcgtcatgaaatctttgcttgtgcctgtgtcctgaattgtattgcatatgttttcttccagggttttgtagttttgggctttgcatttaagtctttaatccatcttgagttgaatttgtatgtggtgtaagtaaggggtctagtttcaatcttctgcatatggctagccagttatcccagcaccatttattgaatagggaattctttccccattgcttgtttttgtcagggttgaagatcaggtaactgtaggtgtgtggtcttatttctggtttctctattctgttgcattggtcaatgtgtctgtttttgtgccagtaccatgctgttttggttattgtagccctgtagtatagtttgaagtcaggtagtgtcatgccctcggctttgttctttttgcttaggattgcgtaggctatttggtttttttttttggttccatatgaattttaaaatagttttttttctagttctgtgaagaatgtccatggtagtttaataggaatagcattgaatctacaaattgctttgggcagtagggccattttcacgatattgattcttcctatccatgagcatggaatatttttctatttgtgttctctttgatttctttgagcagtggtttgtagttctccttgtagagatatttcaccttcctagttagctgtactcctaggtattttatactttttgcagcaattgtggataggattgcattcttgatttggctctcagcttgactgttgttggtgtataggaatgctagtgattgttgcacactgattttgtgtcctgagatttgctgaagttgtttataagcttaagaagcttttgggctgatactatgggttttcctagaatatatctagttaatttgtttacttgttgactattcattgcatttcactaggatataagcttcatgaatatagacatcttgtatatctataccccatacctagaactgtagggtgcctgaaacatagtagatgtgcctgaaactgtgtgtgtagatgctcaataatgatttgttgaatcaattcaatgcattgtagtacagggaagaatctagcatttaccccctttttatgagggagacctcttgaaatcataactttagtatctagaaatcagaaaaccatcaattaaagtagctatgctaatctggaaaagaagtgcttcattttcttaaagtttttatatgttctgacgcactctcagatattaaaatgcccttctttcatgttccttggaaggactatctacacctagggagagctacgtttctcctcagtgtgttcttggaaatcataaaggcaaacttaatcccaaatgttgtgcatttgctctaagatctaacattaatttaattatggatatgaccaacaattaattcaaggagtatttattgaaagttcattgtgtgtaatacactgctggatgctgaggatggaaaaataggtaatatgccattaaagcagagttataactatacatttcattaatctttaagatagtaaaaatataaaatataaagtaaaataatataaaatgcaaaggtctgtagtagagtaattcagaggatcaaatttaaggtcagaattactgaatgcaaatttcaactcagctacttgctagctttaagggcttagatgagctaatctttttaactttcagtcacctcctttgtaaatgataacaataatattacctgccacacagggcttttatgaagattaaatgagaaaatgtataaaaaccacttagcatacacatagtaagtgtgcaaaatactacattatataaatattagagtttcaaatctgcaggtattttttttgaaacttttaaaaacttccttacttagctggcttgctttcagagtgtatcccaatttactggcaagcctagtacataggcatgtgctatcttcttaccagcctttcttccccaggtgtatagctctatccctggcctttttgatgcccaacccagctagcttctgacagatgttttcaatactgactgctttcctgaatttccatagtgtgtatttataatacacatatacctaggttctatagagaataaaatgtgccttgaaggcattccctagtgaacacaaataaaattagttgttaccagattaacacaacttctatctttgcctatcatatcaatgtttttgccatttacttggtggttaaggaatgtggtacttctcaaaagaagacatacatgtggccaaaaaaatagatgaaaaaatgctcaacatcactaataattagagaaatgcaaatcaaaaccacattgatataccatctcacaccagtcagaatggctattattaaaaagaaaaaaacagatattggcaaaaatgcagagaagagggaacacttatatactgttgatgagaatgtaaatttgttcagccattgtggagagcggtttggtgatttctcaaagaacttagaactaccttttgacccagcaatcccattactgggtatatacccaaacgaaactaaatcattctgccaaaaaaagacattcactcatatgttcattgcagcactattacaatagcaaagacatggaatcaacctagatgcccatcaacagtggactggataaagaaaatatgttacatatacaccttggaatgctacgcagctatagaaaagaacaagatcatgtcctttggagccacatggatgcagctagaagccattttcctgagtgaactaacacagaaatagaaaacaaaataccacatgttctaatttataagtaggtgctaaacattatgtacacatggacataaagataggagcagtagacacagggcactggggactatttgagggcggagatgggaagggaggcaagcattgaaaaactaccggaagggtactgtgtttaccacctgggtgacagggtcattcttatactaagcctcagcagcgtacaatttacccatgtaacaaacctgcgcgtgtaccccgaacctaaactaaaagttgagaaagaatgcaaaagtttaaaaaaggaaaaaaaaaaaaaaaaaagaaatgtggtagatgtgttcatactttttagttgactattccagacctgaaagaatacaatgtaaattgaccataaaaaatagaaaattttgagaaagagacagattttgtgacattggtgtaaatgacattggagaatctattgaatcccagtaaaaccactgatacgtgaggatttgacagtttacaattgaagcagaaaaattatcaagggtaataatataatgatgcttcaaaaggaactgattggaagaacaaaggattaagagaaactatttggaaaccagataaacccttgaatatacctgttagaagatatctgttacagtcttctaggtgttaaatgtgaattgacagatactatatcagactatcatgaagtaatttcagaaaaatcaacaaaggacatataactggtttattctttgatctaaaagttagtccagagttataattacaactaaaattttgttaaatatgacataaagcagcttacttttatatttctccaagttccttttcaagatgaaatcgttaataagtggatcaagttaactttgtaaggaccaattagtcttagccaaagtagtatctctgtactactggttccttatttgcctgtgctcagcctatctgttgggatacttcacttaggattgctttgaatctgaggtctgtattaagcccaatgtctattaactatttttttgtatcccatgatccactggtctgtactaagctggactttaactggtctgtactcaaattgtgatattaatacaaaggattgaggaggttcagattcagactttgatactcagcacaaaggtaagatggaagtaatgagattcaagtgactgaatttggtagttcatcctatagaatatgattgaaaggtagagtaaaaccagattatgaaaaactttgtcaatctaaagggtatatgctttaacctacaggttagagtttctcaaattgtggtccacagaccacttgcgttgaaatcacttgtgatatatgttaaaaattcaaatttctgatccccatctatgaatcagaattctggggctaaatcctaggaatatccagttttgagatatctttatgtacctcttacgtacattatagttttagagttattgttaaacctaagtagtttgataaattttcccctgcattttattttttaagtgttgatgatggtgtaacttttgtcacaaaaaaacttagaagcgatgccatatttacctggaattttagcttcattaattgtttctttagataatattccaaagcttattctaaagataaatatgttttatatgataattctgtatatgaaatagtttaaagagagcattagcacttaattccatgctttcaggattttcttataaaaacaaattttctttgaaagtgatatctaaattttttcagtttccccacatggaaactcctgctgttatgcaacactgaaataacaacattgttttcacccattaagataccgctgcaagatattgtgaattggctcatttgccttaaattttttttaacaaataaggcagtgttttgagttatgccagatgtacaaatgagagatttgagtgtacttgtagaatttaaattggaatgctaatgagattctgacaggcagaaaaaacaacacagcctacattttcatctgttttattaaagtcattatttaactggaaaaacacattatttagagctatttatttatgtggcatttgtaattcagctcttaaattttatccaattaaagtgcttctcattctatttcacttaatgcagtagattgttttgtgcattcatctttttctctgtttcattcagtggtagagtggcagtaactcaattgaatgaatgaatgtgccttttttttaactaatgcttacatgtgctgcttcatgctgtgatgctacattgacatctttattttttgtttgcagtaattccattgaaatttaatggtacattattatacaagattgcttatggttatttcatgctttggttactttactaaaattcccaatatgtgaaagaaaaacataatgttaaaaaaactccacatttctgagaagataaattgatcttagagataattgaacataagacaccaagccttaaaagtacttatttcaacaaagatatacaatgccataccaaaaatattgctttttcaaaagacttttatttattatttatttgcatttttccatttgtatagttattttaaagaaaggctttttgtgaatgtttgagattgcttaattacagcagctttttggtttcctttatttatatttatctatctacctctcagatgaggtttaaattagagtttttaaggttataggggtttaaaattttatgtacatgtacaaaatctgtactagaggaagaaatactagtgcataatttcaagggatagcgtgaggctggctgaggtcagacccatgatggaatgcagaaattatgagagggtatagaagacaatgtgtttccttgaaaaggcaacttctgtgaagagagtgaaatatgtgagtccagaattgtacagatgtcatcatgaatgtcagatctctcaactgtattctatagtgggtttaggattcttatattgtaagaaggctttatatattttaaacagcctgatggtattcttatgaaaatctaaggtaaaagaagctcattggcatagaaactatttcagttaatgttcaatgaataaaatctctatattaactggaaattgaacatgtgactgttggtttcctgacatttacataaagcttcactcaagagggcgccattaagcagcattaaggaatttcatacacaactgtatatctctaaaacttccataagaggtaggctcttgaggtgacaaaaaggacagcaaactaggaatcaagaaactgagttctggttcagactctggcactcatgaactctgtggacctggatatgccactttacttctttaggctctaattcttcatctgcaaaatgaaaagtttggtgatggtttctaagagtactactaactctgtaactctgtgattttacagttcttttatttaccaatgagaagcccagacacaacatttaaatgatagattttatcacatctctatgccttcttaatatggtgtccagaattatttttgaagatacagtatttaggctgaatttcctaattagtgtttagaatacttacagaaaatagcttttgtaggtatagctaacttttgattatccatgctaacatgggataacatgtgtaattgaaatgtgtatgaagtcttcactcctcattttctcttcaaatttgtctccttttggtaaggagacaaatttgaataaagttgctgaaaaatatgggtttgagtttcattttcagcctgggcagaaaactgcctttagcatctttgtatagctttattttacccacaccactttgctgaggaaaagaaaagtattcattccatatatatatatatatatatatatattttttttttttttttttttttttttttttccagagtcttgttctgtcacccaggctggagtgcagtggtgcgatctcggctcactgcaagctccgcctcccaggttcatgccattctcctgcctcagcctcctgagtagctgggactataggcgcccgccactacgccgggctaatattttgtatttttagtagagacagggtttcaccgtgttagccaggatggtctcgatctcctgacctcatgatccgcccgcctcggcctcccaaagttctgggattacaggcgtgagccaccgcgcctggccataggattcattattaaaccataggaatgagcctcattttatcctggttggttttttaaatctcagaggcacattacattcgtgtgcatactgtccacatctactttacatcttgtgtacgtattgcttcatatatgtgcctcaggctcttgtgcctccatacctttacttgtgttcttcctgccatattttttactcctgttgccctcagacacagaagctctactcatcttataaagcccagctcctcagcccttgatattttccctaagcatgtgagccttattatccaacagattgattccagattctagtgttaaaattcactagctctctgatcctgagaaaattaccacagtctgaccatctgcaaaatgcaaacaattcccaaatctcaggatcgtttttaattttaaatggtatataatccggtcattcaataaatatttaagtagtgatatcacctatctgtagaacaaaatagaccaaaaactctgccctcacagaacctataccctcgtggagataggtaaatacataaaaacaaaatatatattttgagaaatagagaagggtagaggagagggagagtagagaatgcagaaagtggagaaactattttaaaataggatggtctgaaaaggacttcctgagaagatggcacttgagcagggacctggaagagccagggaatatttgaaggaagagtattccaggcagagggaactgcaagtacaaagtctctgaggtgtgtgtatgcttggcatgtgccaaaacagaaaagaggtcagttggctcatgcagagagagatgaggcagaaagaacaagccagatcatatagggtcttttaggtcaattttagtgaggactttgccctgaatgagatgaggagccatcagagggtttttgaagagataagtcacttgatctgacttacctttttaaaatactgtgtggcttctgtatagtttgtgggggagggggagggggaggggcaaagtaaatattgattaagctattggttgtaatataccaggtgagagctacacatcactacagagtctttcagaggatctagacactagtaggcattctataaatgttagtgccttcattctcactttctcttcttcatattcctagttggaagttttctcttcttctttgggattatctattatgacgcataccattttagaactagagttatctgtgtatttttttttgtttctcctactaacctaaacatttcttgaggataccttcttgaggctcagttttatctgtctttataaatggatcctatcccagctcaggatagggttatataagtagcaggttgagagtgtgtttgggacctgatgaacagcaacatccaagaggagaaggttagcaagtgtgggaggatagggaagtaacacttcaggagacacacgggaggtgtatcttaggatatattagcaaggaatagtgggatactttaagtaagatagatgtgggaagaggcactggtcctacactacatgtgggagatgccaggacagatctagttaggcatgctgtttagggactttggccatcttcatttgtgattcatgaagatgtgtagctggggtctgaggtgacatagtgaagtgcccaaacaggtggataatgcaggcaaaggagtctccccacaagggccacttgggagtatagataaactgctcgttgatctctgggccatctgtttatgcgtagtaatttcatagccttcacagggggattgaggtagatttggcaaattactggactgggaacttgtgatggtgctgtaccctttaggatttttgcttctgcaagtggcagattacccaactcaaaggagctgaagaaaaaatgatccttggtggctcatctgactgaacaattcatagggagttattgtcaaacagtttaacttgatccagctgcacaaataatgtcactaagggcctggattctttgtaattctctctgctttgcctttgcctaggagcatcctcatctaaatagggggctcctggcaccttcagcctgacatgttacaaatatcttatcttcaatacaatcttatctggtagaagaaagcctttttggccatcacacagaaactctggacttcagtctaattgaaccatcttaaagtgtgtacccattcttaaccattcatttctagtgagctaggattacattgatgaacacaggcttcagcctcttgcctaatccacagagccagggatagaagaagttaccccaaaatatgtgggctttgtattgtggatgtataaacctaactgaaaattagctgcttttattaagcactatatgaaatgggatgtggatttgggcccagcaaaacagtagatgtccactatgggtattatattatcagggccccagaaggaaacacagttcagcttagatagctcaaaagaagagactttaatgaagggactacttacaaaggaatgggcagggttaagggcacaaaacaatggctggtgagcctcctagagaccagtatcagtaggaaggtattaccaaccctaggacctagggatcaatgggaagaagtagtgttgcccgggtcaagtaagaacttgagtcctgcaggaggagctagagctgtagctgcggagtgcagctatagtcagagatgaaacattgattgaagcagggtgggaaagagaaaaaaataccctgacccttttctcttttcaactcctaatcgcctgctgtagtgcccattggctcaattggaacgaggcagaaatctctaggggtcagcctcctgagacacatagtggagcagaatatggatcttagttgaggccaaatggaaaataatgagcacagaaaacaaattagagtctcagtcttataatagggaaatatattgggaaggaagatagggatgaaaatttaggggacagaattttattggaagaaggtccaattgaaggagtgctaacctttcacacagcgcagattaagagagttaaattgttaaaggggttctgagctccaggtcagtctactggagggactgatttggttgtaactcctccttgtggtggggaataggtacctactcactcttaatgctccatatcagaatttgcctgggaactggaatgtggctgctcctgaagacatggatctcagaaggtctgtgggtgggtaagtggcttatgacgggaacagaacaaatgatacattgttgtgtatcaaggcagaaaccattactacaacatgtagctgccctgagttcagttgcttttgtttatgttcctgcccagccaagattgggatcacttcctgctgagacctgacttgaaaatgatgggcaaatcttggcccaaatagctaactagaagtgaatgagggtagccctaccagtcttcatctagaagccatgctatagggataggggataattgctctcaccagctgctgagacaaattcataagtgacactgtggcgaggggtcaaaaacaacccaggataaagcaggaagctcaaattgtggctaacagtgaggaggcacacaaataacacagctctaactccactgaagacagggtaagtgacagcttcccctgagtcagatggagcggggataagtgtgccttgatgcgaagtgggaaaccagaggaggacctgactgagcaataaaactcttggctgagactaaaatgatttcaaagcagaacaagggtgggactgtttggtagtggaaaagaaagcttggtttgatgcctagagagagaattacatgatatgaagaaaggtcattatttattacctaatcaagcagtgtaaacataccaacaagcttgagacagtctttatctagcattattagatgtgcaattcaggtgagagaatattaccaaatctaacctgcttatcaacacttgtgtaatgagaacataaaagtgaatgaaaatgtatctagtctgcaatgaagtggtaatataagagactcagaagatccttttttcctactttgtgggattgagcctaaatttaacttgaattatttttagaagggacttcttatttagcctttttaaaagaagaatttatctattaataggaaatatgcattttattattaaaatgagttttattttggagtagttgggaaatgtggaaaggagaaaccagttgcaaaaagggatataaaaagaaagttgtcaaaaatgtttaaagatagagtatagcacaccaaaccccacagccatctgcccaggaaactctccttgttgccttgttttctctttcatttgtgtgggctgttctctgcttaggtgcttggaatgtccctctgatacagaaatggggaagggaagtgctgggaagggaagggcatggtccctttcaatgatacggaaggggagaagggtgtggtccctggctagggctccgcctccaggcctgtgcccacaggtctagttgaggacaggcatttttgttttcctgcccaaaacatttcctaagaccaccttggtctgccacgcccgcatcctgtgcctataaaaacccccgagaccctagcaggcagacacacacacacaagcgactggacatcaagaagaacacatcagaagtagacagaagtggctggacattgagaggacattgaggggagcacgccggatgctagcaggctgccgactggcagagcatgcgaagtttggctggggcagttgagggagagccccggctgccaagcagctcgactctaggggaaaaccaatctcctttctggctcccccatctgctgagagctacttccactcaataaaaccttgcactcattcttcaagcccaggtgtgatccgattcttccaggacaccaaggccagaacctcgggatacagaaagccctctgtccctacgataaggcaggggtctaattgagctaacacaagacacctacagacagctaaactaaaagagcaccgtgtaacacacacccactggggcttcagctgtaaacattcacccctagacactgctgggggtcggatccccacagcctgcccgtctgtatgctcccctagaggtttgagcagtggggcactgaagaaatgagccacacccccatcacactgccctgtgagggggacaagggagtttttcctgtttcacctcctcccctctctccaggccaagtcttccttgtactttaagattttaggcaatttgactctcataccttctaatatcctcttcacttcaatgccaccccagatagatctgtgatatgcaaatccgtgttgtgatgcacttatcacagtgtactgacatgactttctgatctgtcttctccattagactgtcagccatttgagggactgaggcagtaaaagagtaggtatttatatggccagaattacattaaaattacgtttgttataatgaagtagaatatttctgtgctttgccctttccactcactatcagatggcttcacagcattcctctggaatgttctaaaaatagtctgacaccaaatattagtttgaactcttgattataagcaatagaaacccaattcaaaatagcctaaataaaagggagagtgtagaatatcttggtgtatatttcagcatgactgaggcatgatggaggcaggcatacagctaggctttggaaatacggctcacatgcttttgggactctggctattttttattttggcttcttcatctatttgggtctcctctttctctgtagaacagctttctaaattcagaaaatatggttgctgacagctcttagttttacataataaagctttgccactacagaaaaactagaaactgatttgagtttcctatctccaaagttcatgggtcctaggaaatgtaccagtttgggccctgcccaattatcagatgctctcattgtaatcagatggagagggtgagtagttcctgcagccaggcaaaatagtacatgctgtacacacggcatattagtattatgggagaattacatttagagggctctgtttgccaggacatatagttaagtccaggccatacatatttatgggagaagacaagtgctccaaacagttaaataaacttttattttggcatttgaaatgcataatatcattattcttatgggacatttaccatctttattatgttctctattggctagcattaagatgcattctttgcattcttaagcataaactaacaggagcatcaagaaggaaaagtagcctggataatgaaaaaagttgacttgggagcaaaactatgctgtggttaattgataaagcagaggagtttctgactaaccgaaaatatttttagtcttccaaaaggtattactaacatcttgcaagtgaatttttaaatataactttcaactgaaattttcttaccagcttactgtactgatccaagggtatgacagacattaaagtaaaagaaactggcatggttgctcatgcctgtaatcccagcactttgggaggccaaggcgggcagatcacctgaggttgggagttcgagaccagcctggccaacatggtgaaaccctgtctctactaaaatacaaaaattagccgggtgtggtggtgggcgcctgtaatcccagctacttgggaggctgagacaggacaattgcttgaacctggtaagtggaggttgcagtaagccgagattgcaccactgcattccagcctgggtgacagagccagactccatctcaaaaaaaaaagaaactggcatgtttgctactcttaacagagaagtaggaagtagatgtgtttaaagctaaacaaccttttaaaaacatcatgtttacagtgttaaaatttgtgtgcatgtgtatagcttatgtacgctaaaggccgatcttagatgtaaatcaaatgggtatgattttagaaatgacacattacattacaaaaaaaaggtaggtatgtaaaatgagcttaattattttcccttttgtacttcacagggtggggaatggtggagaatgctgagtggtgatttggggccataagtccaacattctgcctactttataacaactttattgcaggctggagggctgtgtgtttgtgtgtgcgtgagagagagaggggagaagcgagaaagagagagagaaggtaagagggagagagagagagggagaggaaaagagagagaagagagagcccttggtttagttattagggaagagcaaggagatgctggtaatttgatatctaatagtttactgacttttctctttgtatacacattttataggagtaaacaatggagaatgatgtgagatggattacatgaccaaacattgcttctaatttgaatctatgagcctttgaagccagatataagttgatgtatcaattatattagtccagagccaatgtataatttctgtatcaatcactgtgtttcttattattcggttagaaacttgattttaccgctttcagaatctaaaactctggttattcatcaaatggacacaaaatattaaaagaaatagaccttttccatagtctatgttaataaacccaggtcatcaatctttgttcgcatatattatgtagtcccctggtggacagtgtgttatttctgtttctggtttggtaacagacaataatcaatctctctcccttgcccccacctttttcctttccagtctctgatccttttcctccttttctttcctctctctttctcttcctctctccttaaaacatgcttatctgtaagtattcatgaagacaaagtaccctttgtattacctttgtaaataatctaaatgagcattttctgcagtgatggggattgctgacctcaaatataattgcttttatttcgacatcttaaagctaaaagatttcttttttatcatcataatgcaatttaaatttctctcttaccttctcgccttttctcttttttctatatgtctttctttttccctttcttgtcctccctcccttccttcctttcttccttcctttccccctcactactctttctttaaaaagcatgacatttgacctttggttggtactaaagcttatcttcagggagaatgtgactttgaaaattagttatcatacatagaatacatacagctttttgcctacataaaatgatggttctcttcaggaactcttgattccagtctgctaatattgcaaatctaactaaaatggacattgtctttgttgtacgtcggtgagtgacaagggttctgcacttagagcttttgctagaaaacctggagggcagccagccaagagctctgtaatagacttgaagaagttggaatctgtaaaaaatgtttcaggaagaaaatctttcagattagacagctgcatagttaacaatcagtagctccagagaactaataattagttctagtcaattaaaccaacttttagccttatgacagagaagatagcttgcatagctaaaatgcacagtatactcttaatttatgctacccaattccttaccaaaatatttttgatttttgtttgttttgtttcattgttaacattttgttgtagttcctgttgtgggttgtttggtaggttactatgtaccatgttatagtatttttctttttcatgtagtattctgttataagccatttccatgttcttaattttaaatgactgcatataattttacagtaataattatgtaccaggctaattattttacatatattaattattttagtctttataacagttttttgaggcaggtactattattatcctcatttaaaaatgaaaaacaaaaatgagatacagggaaggtaagtggactgttgaagattccagtgccaatacatggtagaggactgaatttgtgatggtttacttacttccttcttatccacctattcttagatattatgtagtttcttatggtatttattgtaaatatcataagaaccaatgtcatgattagtaaagtgtttcccaatagcaaagacattcttgcaaggcagaaattgagaattgaattattgtgtttttatcaataaattatagttagactcataaacctgcatattttggaatcaacctaaatgcccattaacgatagactggataaagaaaaatctggtacatatataccatggaatactatgcagccataataaacaacatgatcatgtcctttgcagggacattgatggagctggaggccattatccttagcaaactaacacaggaacagaaaaccaaatatagcatgttctcataagtgggagctaaattatgagaacacatggacccatagaggggaacaacacacactggggcctatcagagggaggaggttgggatgttgggatgagggagaggatcaggaataataaccaatgagtactacgcttaatacctgggtgatgaaataatctgtacaacaaacccccatgacacaagtttacctatgtaacaaacctggacatgtacccctgaacttaaacaaaaaacaaaaaacaaaaaaagatttcctcctctttaagagtatttccttaggataggttcctagaaataaaattactgaatcaaagttttaaaaaaatttaaggctgttgatacacagtcccttaatagctttcttaattgttggttacatttctgcaataatttatgtgtgcacagtttggtaaatcattgtcatctcttgattttatgtttttaaatctttgctaatgtgacagctaaacatggatttcttttacctttgttgtaatttgcttctttgtatttgaacttcctcttgtgtgaattattcatgcctttttgcctgtttttctcttaaagttctagtcttgcttttgtatctttgtataagtcctttaaccaagatactaatctttattatatttgctggtaatgtttttttttttttagcgatttgtctttttttggactattcctttttacctatgaaggatgtttttgtttatgttttttaaacacaattttacttcttttgtgattgctgctatttacaaaggcctttcatttatgagattaatgctaaattatctttttctctacttgcactacagatgttttccttttgtgttaaatttttaacgaatctggaatttattttttatggcatcagttatgtatcagaattacaagttagtagaaaaatgtttcaagttacattcttctctttcaatgaattgattaaaacttggaagaaaggccttggataatctataaactatgcaatcagcttcttaaatattcttttctctttgaaaggcagaaattgagaattgaattattgtgtttttatcaataaattatagttaggctcataaacctgcatattttgtgctttaaaattataatattttgtcttttgctttcataaagaaatcttacaaagggaaactagaatctagccttccttgttctttgaggttctatgtgcctcactgatgatagtttattatctctggacttctgcctgttatttaaaactgagaacaagacaggcgtggtggctcacgtctgtaataccagcaccttgggaggccgaggtgggtggctcacgaggtcaggagttaaagaccagcctggccaagatggtgaaactccgtctctactaaaaatacaaaaattagccaggcgtggtggtgggcacctgtaatcccagctacttgggaggctgaggcagagaattgcttgagcccaggaggtggaggttgcaatgagctgagactgcgccactgcactccagcctggtgacagagtgagattccatctcaaaaaaaaaaaaaaatcaatatgtattaggaacaaatattaaaatctaaaagtgggatggatatatatatatgcatgtcacatataacaatatataatatatattgctaataatatgtaatttaatatttcaagaaaagcctgaccatataaaagtgttaaaatattggactataatactgagactcctaaataatatgtaactactatttccaagatgatataaataggagtcttttatcttctggaataattcttcttttcgtcattttactactaattatttgataacccttatttgtgttttagctgcatattaaaatgagtggcaaattaatatagatataatgatttggcagtgttgaataaggctttttcttttcttcacccaaagtgattgtatttaaaatgcatgttaatcaaaattcagtgactcatctttgaggtttgtttattacctagattcattggtgtcaaaactgtttgcttaagatttgatccacacccaatttgtacagtgtcttttgaaatacaggaatttggaaattttattagattagaagaaacacttctgttttatagcctactttccttctactttagttatttttactccatgagaatttttcattaaaaaataattgcagtccttgacacatcaaagacaacataattactgaatgaatctccataattatgtctcttttgtaacttacttttgcttatttatttttattgttcaaaagagcacactacttagaagggaggcagaacctctaaatcagaagtaaacaagaatataagaagaaaagaagtgctataataatgtaggtattctacagactacctagttgcagaaagcaatggattcttagttcttgaggagctaatggaagagatctaaaggaggtagaaattctcaaacatctgggcatttgttagaacttcctttaaacaagggtagtactttgggagaccaaggtgggtggatcacttgaggtcaggagtttgagaccagcctgaccaacatagtgaaaccccgtctctattaaaaatacaaaattacccggatgtggtggcacatgcctgtaatccagctacttgggagactgaggcaggagaatcacttaaacccatgaggtggaggttgcagtgagctgagatcgtgtcattgcactccagcctgagcaacaagagcaaaactccatcttagaaaaaaaaaaaaggcactaactctattaaattatttattttttctttttgttgtgtgtgtgactgtgttatttcaaagattgtcttcaagttcagaaatttcttctgcttgatcttgtctactgttgaagctcaattgtattttttaatttcattcattgaattcctcagttttaggatttctaatgggttcttttaaacatctatctctttattgaatttcttattcagattgtgaattgttttcctgatgtctttgcattatttatctgtgttctcttgtatctgagttcctttaacatcattattttgaattccttttcaggaatttcatagatttttttttctttgggttctgttgctggagaattattgtgtttctttggaggtatcatgttttcttgcttttttgtgtttcttgtgtccttctgttgatacctgtgcatctgatgtaacatttatttcttccaatttcatggattggccttcactgagaaagatttttttctataatcatatccatagtgtttgttgggtagggtgctttggttttgattctgggtaagcacagtagtgtagtcttcatatgatttctttagctgtaatcagtgtcaatggtgtgagttccttagaggcttaggctgtggttgttagtggaggctgtggtgaggctttactggggacaggaatgccaggtgggctggtccttaggcacccatggtggcagtctgggcatgccagtcctcaagcccttgggcacccatgtaggtggcagtggtggcaggtccaggtgggccagtccttgggcctccaggtgatgtgcttgggtgctggtggtggcagggtgggctaggcgggcaggtccttttgcccagtggtggcagggtgggttaggcgggcaggtccttttgcccctgggcagtgtgtgtggcatcagtggtggtggtagctatggcagcttaacccttgggcccctgagtggtacatgtaggtgccagcaatggagggactgtcctaaggcccagggatggtgtacagttggactagtccccaggcttcctgaaggtgcatggcagacctgccactggagggggtggggttgctgtcaatagcagtggccctggtgggcaagtagctctcaggctctggagaatgcatgcttcaacttcctttgtcccaggggcaggctccctggtgtcctgcaccagctgttctcttgagtatcggatactgtgtgggctagagttctagggacccacatcactgtgtctagctggtgttgaagcctgcagatttggggtaaatgtgaggggatgtcagcagtgctccagagatgtggagatgcaggagctgttgggtcctagagcaggacgtagtctggtgggggctgagctcttaaaatggtgctgtaccatagctgcttctgtctgggtatgtgtgtgtgacccagtgtgaactcctctctgaaacaatgccatcatgtggactccaggaagctccttatactagtctcagggcccatgagggccaataagggtctgcaatgggaatgtggactgcttgggaatctctcacataccctttcctcatagtggaaagctccttctggctctgaactgatcccggccaggccagctgtttcacatccctttcctaccatgtctcagaggtttcttgtcacttctgtgctgaattccagtgttctgtcttagaagctttattcaaaatggggttatctactcactgttttggtccttctttgtgtaggaggcaagtgcctggaacttctagtcagcctcttgaacccttacctcaattattattatcattttttaaagaactgtagagtctcataaggcgtagaagtgacacaggacctagtactctacataactatggattagagagaggaatttcttcaagaagtagaaatgatagagaaggctgtagagagaggaaatgctgtaactagctacatatatattctggacttaaaaaactgtttcagatttcaaaaatctcagggaaaagatagatttgatcaaatatctggaacaggaaccctgattggaacaggaatctgtattgtggcattatttatttctctggtgcccatagaagacattatttaagtgacctcaataatctctcatttttcctgaaaacatctctggaatccttcttaagataatactctaggtagttactactgatgcaggatgttttgctcctcagctcagctaggtttggtttcttgtctcatgaccaggaagaaataggcaagtggacattgaagaatgagtggagtagaatgtattaagcacaaaggaaacccctcagccgaaagaggagttctgaaagcaggttgccggttgccccccttcacagttgagtaccaatactttgttataaaagctgatggggctgggttccctatttgtataaggtgcaaattcctggtggctccaccccacccttccggtgcgcatgcgggcccttagtctgacccacttcacattgatttatttcccttactgtgcttgtgttaagggacagaattttttactgcaggcatatttaggcaagcctcctgtgctaatgaacttggtgggttggaggttctcctgggaccctgccctatctgcctaggagagttctctgcctcctgtctctgtcactaccatttgattgtctttgcaggaagtggagcctgacaccctagtgtaggagaaaaatagctcaaaatgatacagctttgaatggcttgcctctctgctatagatctattcatcaacactcttggatccaatagttaaatagatacaaagccttctaattcttttattattgagcccatatttttattttatccatgaggaaagcttgagaaatgttgtataatgttcagttaaaatctagatgacagtgcttataggagtaactaggtctgttagtttagtaaaccacccaaaaaggtaatctgtgtaatgtgtagcattggttctccatcaggggcaattttgtccccctaggggatttagcaatgtcggggggtgggagtggggttgtatgctattgacattcagtggacagagcatagggatattgcaaagtatcttacaatacataggatggcccctcacaacaaagaattatccagtctaaaatgtcagtcataccgcagtttagaaattctgatctagatcactggttcttgactgggaacttgttagaaatgcaaactattgcattccgctgtggaactgatggggcagaaactctagaggagagtctcagcattttatcttttaaccaacccatcaggtgattctgatgtaccttaaagtttgaagaccagttgtgggaccattttggcatataaaaacgttcaggaaatatttattgagcatcaagcttggaccacgtgcttctctaagtgctcaaaaaacagtcttttcatagtttgcttttgccatcttacctatgatcttgttatttcttgtagttctcaaattcttctgttgtctaacatgttgtttgatatgtttgttaaattgtattaaatcgaattggtagctggtctttttcatcccaccatcccatgaggcttttttttttttttaagtcagttacttgcttgaagatgtagtcgtcatggttatcaatgttttaggcctcataaagatggtagggattggatgatagaggcaatctttgattcttaatagactagcaataacatggtcatatttctaagttccaaaattcccattatatcaattttaccaagcatttcctacttgctaatcagaattaggaacatatttcttaactgagtacattgcatacaagaagagatttttaaaatttgtcgaattgaatcaaagacaactcctaggtaacttggaagaatgatagtgataataatagaaaaaggaaatttaagagaaagatgggcaatatgctgagttattttgtacttagcgaatatcagatggtgatacacactaaagtaaatatattcatccatcaatggaatcaaaagcacaggtagaagggacacttttttttttttgagatggagtcttgctctgtcactcaggctggagtgcaatttcagctcactgcaacctctgcctcccaggttcaagcgattctcctgccttagcctcccgagtagctgggattacaggcacatgcccctacgcccagctaatttttgtggttttttttagtagagacggggtttcaccatgttggccaggatggtctcgatctcttgacctcgtggtccgcccgtcttggcctcccaaagtgctgggattacaggcgtgagccactgtgcccggccagaaatgacacttcttgactgacgagggaagaataaaaggaaagtgacataccaatacaaataaattttgttgtaggaagcagttagaggaacttttaaataatggtttcagttgtttctggaatactttggcacgtcagtatctgctacattgccaaacttccttagcttatatgagaattctgtgaggaattccttgtgaaaactcgactgagggtaaaaaattacagataactcagaaagctattcggttatgaggcagaaaagaactgctacaccatcacaacccctatcaacagtgacagcgaagaacattaaataagagaaaaactttgaagacatataactttaggcagtaagtctcattatccacttagcctggaaggagagatagccgtgggtcatacaattccaaggtttgggttacccctctgggcaaaaaccttatcaggaagcattttttgaatgcaaatgcaaggtacatgtagtgagtcctggaggaaggaattttcaaatgccagccaaggtagaaatacagccttattttctatttgcatttgtttattgctaataattgtcttcttttttcctttttaaaataggagttgaagtgaaaacaatttctctgttggaaattgatatgttgatagtgtgtggttactgctgaactagaggaattctgaacacttcttgaggattctggacttgaagaagagtaggtccatgatgttgatcctggatgtagttgttgaaggtgatttggggtcagcttcctttggggagagtagtgattatattgtagttgtagtggaatagatggattacagggtcttgggtatattgaatcatctccctttgtggggagtgattatattgttcttgtagctagatagttggattgtgacatctttggatatacaggaaatagtggatgttcatatatggggcaaggccaggggttggcatgttgtgggtacctttctgggatagtgctcagtgcatggccattttctttctctaggacttttccctgaaacccagggtggagttcagttggccgttagcaccatatagctacaactcagttgtcacaactgaagaacccaagagttcagaacagattaaagctgcactactcagactctcatgtggaaatctgaaattgatagtagtgttacagagagtaggttcccaaactacactgtagagtttcctatagctgatttggcttctgttttaacaaaagtagttgttgatctctttgtgcatttccatcgagactgcccagtgttctatcaataaagttccctgtttgtgctgattagagttggttttctgtttcttcctaccaagagtcttaacttaagctggtcatatgaggtggtatgagcctcaaaaagggctgaatacttgaattatgacagtagactgtagatacagaagtggcagcaaggagcaagatacatgttgatccattctcctaaaagtagaagaaaaaatgccttttattggagagagtggggagggatatggctcattttttaaaagacagttttctcgtactatgagaagaaagaagtagtgtgttaaactcaggctgaggatgttagctagtgtgctcctaagagatttatgatttctggaggaattgagtaaggattatatagcaaatgttctgtaaatatttgatgaatgtggaaacaaataaattgaggagaatgatcccttctcattataacctcagtaaagaatgctgtgtgccacaattggcctgggcttcccaaattatagcttacttgcataatcatttccatggtaaaattgccaaagctgccattctctctgggttcatgttcttttccctgccactcatttttggtcaatacagtactattttagtattgaagtttagttagaggaatttgagtaacttttacttttagggagaagagtttcaaggcctctatctcttccctctcagaagctccaggagacaggcaattttttttcatgatttcaccaacaaatagcaagccctctctctaagaaatgtcaatgatgctggaaaaaaaataaagttccattttcatgtgatataacatgtgatattaattagggtaatactagccatgaaaagaatagacttcaaaatataaaatggcttaaaaccaataatttatttcctgctcattacagggaaggtaagcagattactaggtggcccttcttgtgggtcatttagggactcagatagggaagcctaccataatcagaatgtggtttccaaggttaccctaggtactgtagggcatccgagccagacataagaggaatgagcatggggggttttgtctagagtggaacatagcacttctcttaactttcagttgactagaattcagtctcatagccacttagtcgcaagggaggcttggaaatgtagtccactttgtgcccaggaaaatggaatatatactgtatttggatggtcaactaacaatttttatctttgtggctactcactattattcagacctcactttccagaaattctgataaatacaagtttactgtattttgaaaaaaagaaaaagttggtaaacttgcctttcttcacagtttctgtaaattccatgacttaaaaataaagctcatattgagggaagaaaattaatagatttgaattagctaaattatatacatatgtcttttgccacatgtactgagaatcgctaaacacatttttcatattcaggccttgttatcaagctgtaaaattctaagctaacaaaaaccatccttcataaaacaattctaggaccaggaaggataagtcaaactgggatttgcagattgtgagtaagtacttaagtgaattggactagagaaaataccaggaagctagcagctggggtaatgtcagaggtagaatccacatgtgcagctaaaagtaggaacctatgtcggcacccaaggtgagagacagttggaggctggatgccttatttatagggactttgaatacacttcctgctgggcagcagtgaagcccatggtgtggacagctgacagagaagaaaagcaggtagataggctcacctagatgaaggcaggtttgaagagatggaggccctacacagcagtcctgagaagaattttttttactaattcaggattagcaaattgttttcctggtggtttttggttttgaattactatgttgcaaagttggtaatcttagtgagaatacaagaaaacataaggttattcacattcaggtttattttgttttgtatccactgtgatgattaaaattgggattaaatattcaagtgtacaaatacaattaaaattgtaacctgtgcccaataagagtggtaaaagtgtaactcagtcaaaagaaaagaagctctaagctttggtgctgtgtatcacctatgaattaaaagatatttttcagatgattggctgattggcgactctggaactgggaacaagttaacgctgagaacaccaagtacagtgcgtcatgtaaggggagggagacgcttaggattacatggttagctaagaccatatgcattgaggtttcaagtctacaagcatgatacttttctttcagagtttgttgatactgtgtaagggtgtcaatcattggtacattcataccagattgcatggttttacaagatgaggaattatacagcaaatgaggtaaacgtatacattgtggattcctttataatactgttctatcaggaaagtaattgggcaaagaagagtggttagcaattgaggttctagagtcagaactgggctcagatcctgatgttttcatttcctagctttgtgaccttggacaagttatttcacctttgtaagcctttgtcatctttaaaatagagataataactatattcaaagcctctgaaaatcaaaagttttttttttaactcatttggcagcaaaacttgatgtggaataatgacaatttatttgttgtctttatctcatttaatgtgcatctttatacattttgtggcagaaatattgatatatttgattaatgtatgctactccagaatctactcagggaaaatgctagatagctttcatttatacctccagattcactgtccacctttctccatctagctatgtgtccaggagtctgatagtatagattgtaagtatgcagtctgtgtttacaggctctctgctatctgctttcccattagctctggccgatggaagtcactggcgagatattggagtgaggcagcagagtgagagaggtatttaattcacctagttctcttcatgagtggtcaccgtagtgtgtctctagactgaaggtctcagcatgtgaaaggtaccacccctcacaaggcctcttagtcttcagctttcagtaacagctcccttcctttacccattatgacccagaggtggtaatagtcactacagtgctagcttcaggttatcaagctatcctttgtggtttctctacaccttagcaaatagtgcctttattaaattttcctcaatttatcctaagttgaccatgtacctacttacttctcagaccctaaaagatgcatagtactgtttaatttatgaaatatttactaaattactgtctgaatacatacacatgcagaggcacaaacatacacacctgaaacacatcttgcttcaagggttttggatgaaggattgtagatctgtattctaattatattagcataggaattttactgtattttataaattattactgttcaaaaaattatattaatgttcagttaaacacagagcatgtaaatggcctacaggtaacaccaccaacatctcagttctaaaaatatgaaaaatgtcattgagctaccaatttaaataaatctcctaaagtgagtatagtatatggagcgcagtttcacaattataaacttgcctttgttacttaagaggaaaaaagcagcagcaagattagaccttaattccacttgatcacttgttcatcaacaaatggtcttctcacaaattccaagacgccttaagaagagatgcccagccggtagcattaacataactttatctaaattatttcgccttctctcagtgcttcaacaggaataaattcagcttctgaatttttgccagtgtatgacaatgtattttctagttagctgttgggtggtggaaagaatgtagaatttggagtcaaggaagctagtttgggtctcaacattgataccgttcttgagtcactgtgagcttgatttctgtagtccctgtctctaaaattggggtaaaaccacatacctgtcaggatcatgaggattaaacagagtaaatataaattatctagtatggagctcagctcatagtaagagcttgagtgtttctcaaacttgaatcagtttgtgaacatagccactcaatagaggaaggtttgttcctggggctgatccatgactgcagctgtgtgactgctgttgtggcatttggactgttcatggatggaccagaacctccagattctacatgtgataaccgtggctgagtaaaggctgttgtcagtatacatcacgcaacaacagaatgagtgtggggtagtatttgtgtaatttgccagagaagtgaggaactgaacagaatgagttttttcttgtttgtaaccacacatttagtttatgcttccattaattcataagtattatatttagcactgtaatatttaatattgatgttaccaaatgtgggtcaacatttaaagtctataaaaacatgcatacagtcttgatatttttaaaactcactatagtaagcttcacttttttctaatgaaattcactaaccagtttaagaaaatggtaaggttagtgtgaagaattccatgccataatactatagaattgctagagatgggccacatagttgattttgagcttctagtggcaaaaaaaaaaaaaaaaaaaaaaaaaggccaattataagatccctagagtcttagttgctttttggtaccaagatctgagagggcttcataaagtggcatacaagattgagaatttacacaagcagttttgaatagaataacagagactttagtaacaaatttaaacccaagcatagcaagcaaccttgttgaaccaaatagttctgtgagagttggcaaatcttaccgggatatagcttcaatagtgatgatggaatgataagaaataattgcctttttgttaaattttttatttgttaaaattagtaatcaactctctatggactgggagagctcaggaacaatatagctttaaaaagtttttcttcggcagtcaaaataaaatattacatttaaaattaattgaatctgtgaatatgattattaagataaaatgttatttccaaattaaattaaaagttttctttattttttactatcattcttctcctcaaattaatattccatctgagaagcctgaaaagagaagattaaaaggagtcattaataaaaggaagtgcatttaatgggaatatgattatcatgtagttcaaagaaaatttcattgtgcctcatactaattgctattttgtgcacctacttgccttgcttatcttaagatggttttggctttaggggaagtataaaaaattaaggtatacatatattatttaaagtagaccaaagttaaggcataaataaatagttaataattgaagcatgtgagtcagttaactttaaaactgtacttattaaagtctttgttacttttaagaagactatcctacgctttgagaaattgctgagtcatggtcatgatcacatctgtgttgtagttgtagcccccctgtatgggaactatgattcctgccttcaggctaaaaggcattaaaagaaaacaaaaacaaaaacagagagaccatgtagtgccatccccttctttcaagtgtgaactccagctcaatttccccctgctcatgtaaattatttagagctttcaaatagttgttttaaaatttttcttcagagtttgtagttgttatgtattgaacacaatggaagtgggcataatcttttctctgcctaaactctttaaagtttttgaaatgaagacatttaatttttttaacatttaacctgatataattttaactgtttctacctgagaagttatccagcaatgttcttttttttttttttttaaggttttttttttcccataagttataggggtacaggtggtatttggttacatgagtaagttctttagtggtgatttgtgagattttggtgcacccgtcacccgagcagcatatactgcaccatatttgtagtcttctatccctcgctcccatcccactctttcccccaagtacccagagtccattgcatcattcttatgcttttgtgtcctcatagcttagctcccacatatcagtgagaacatatgatgtttggttttccattcctgagttacttcacttagaaaaatagtctccagtctcattcaggtcactgcaaatgctgttaattcattcctttttatggctgcctagtgttccattatatatatatatattccatcatatacatatatgtttatatatattccatcatatatatgtgtgtgtacatatattccatcatatatatatattccatcatatatctattccatcatatatatctattccatcatatatatctattccatcatatatatattccatcatatatatatattccatcatatatgttccatcatatatatattttccatcatatatattccatcatatatatattccatcatatatatattttccatcatatatatattccatcatatatgtatattccatcatatatatatgttctatcatatatgttccatcatatatatatgttccatcatatatatctatgccatcatatatacacacacacacacacacacacacacacacacacacacacacaccacagtttctttagctacttgttgattgatgggcatttgatttggttccacggttttgcaattgcgaattgtgctgctataaacatacatgtttaagtatctttttcgaataatgacttattttcctctgggtaggtacccccccagtaatgggattgctggatcaaatggtagttctgcttttacttctctaagggatctccacagtgttttccatagcggctgtactagtttattttcccaccagcagtgtagaagtgttccctgttcactgcatccatgccagcatctactgttttgtgatttttttgattatgtccattcttgcaggagtgaggtgctatcgcattgtggttttgatttgcatttccctgatcattagtgatgttgagcattttttcatatgtttgttggccatttgtatatcttcttttgagaattgtctattcatgtccttagcccactttttgatgggattgtttgtttttttcttactgatttgagttcattggatattagactggatatcagtcctttgtcagatgtatagactgtaaagattttctcccaccctgagttgtctgtttactctgctgactgttccttttgctgtgcaaaagctctttagtttaattaagtcccagctatttatctttttttttattgcatttgcttttgggttcttggtcatgaaatcgtaagccaatgtctagacaggtttttccagtgttcttttctagaatgttaatagtttcaggtcttaggtttaagtcctcaattcatcttgagttgatttttgtataaggtgagagatgaggatccagtttcattctcctacaggtggctagccaattattccaccaccatttgttgaaaagggtgtcctttccccactttatgtttttgtttgctttcttgaagatcacttggctgtaagtatttgggtttatttctgggctctctattctgtttcattggtctatgtgcctgcatttgtaccagtaccacactgtttggtgactatggccttatagtatagtttgaaatcaggttgtgtgatgccttcagatttgttctttttgcttagtcttgctttggctatgcaggctcttttttggtttcataagaattttagaattgttttttttaattctgtgaagaatgatggtggtattttgatggggattgcactaaatttgtagattgcttttggcagtatggtcattttcacaatattgatttcacccatccatgagcatgggatgtgtttccatttgtttgtgtcgtctatgatttctttcagcagtgttttgtaggtttccttgtagaggtctttcgactccttggttaggtatattcctaagtattttatttttttgtttgcagctattgtaaaaggggttgagttcttgacttgattatctgcatggtcactgttggtgtatagaagagctactgatttgtgtacattaatctcgtatctggaaaatttgctgaattcttttatcagttctaagagctttctggaggagtccttagggttttcaaggtaaacaatcatattgtcataaaaaatgacagttttatttcctatttaccaatttggatgccttttattctttctcttgtctgactgctctggctaggacttccagtactatgttgaagaggagtggtgagagtgggcatccttgtgttgttccagttctgagagggaatgctttcaatttttccccattcggtattttgttggctgtgggtttgtcatagatggcttttattgcattaaggtatgtcccttgtatgccgatttcactgagagtttcaatcataaagcaatgttggattttgttgaatgctttttctgcatctattgaaatgatcatgtgatttttgtttttatttctgtttatgtggtgtgtcacatttattgacttgcatatgttaaaccattcctgcatccctggtatgaaacccacttgatcatggtggattacctttttgatatgttgttagattcggttagcaagtattttgttaaggattttagcatctaagttcatcaaggatattggtctgtagttttctttttttggttatgtcctttcctggttttggtattagggtgatgctggcttagtagaatgaattagggaggtttccttctttctatatcttgtggaatagtttcaaaaggattggtaccaattcttttttgaatgtctggtagaattctgctgtgaatccgtctggtcctgaacttttttttgttggtaatttttaaattaccatttcaatctcactgcttgttattggtctgttcagggtatctaattcctcctgacttaagctaggagggttgtatttttccaggaacttatctgtgtcctctaggttttctagtttatgtgtgtaaaggtgttcatagtagccttgaatgatctttcatatttcagtggtgtcagctgtaatatctcctgtttcatttcttagtgaggttatttggattttctctcttcttttcttggttaatcttgccttttatggcctatcatatggtctatcttggagaaagttccacgcgctgttgaatagaatgtgtattctgcggttgttggatgaaaatgttccctatatatctgttaagtccatttgttccaagatatagtttaaatccattgtttcttttttgactttctgtcttgatgacctgtctagtgctgtcagtggaatattgaagtcccccaatattattgtgttgctatctcatttcttaggtctattagtaattgtcttataaatttgggagccccagtgttaggtgcatatatgtttagaattgtgatattttcctgttggacaaggccttttactgttatataatgtccctctttgtctcttttaactactgttgctttaaagtttgttttgtctgatataagaatagctacccctgctcacttttggtgtccattttcatgaaatgcctttttccattcctttaagtttatgtcagttcttatgtgctatgtgagtctcctgaaggaagcagatagttggttggtgagttcttatccattctgcagttctgtatctcttaagtggagcatttaggccatttacattcaatgttagtattgaaatgtgaggtaccattgcattcatcatgatctttgttgcctgtgtactttggttttttgtttttttgtgtgtttgctttttaacttgtatttttgttttataggtcctgtgtgatttatgctttaaagaggctctgttttcacatgtttccaggatttgtttcaagatttagagcaacttttagcagttcttgtagtggtggcttggtaatggcaaattctctcagcatttgtttgtctgaaaagactgtgtcttttcttcatatatgatggttagtttccctggatacaaaattcttggctgataattgttttgtttgaggaggctgaagataagtccccaattgcttttagcctgtagggtttctgctgggaaatctgctgttaatctgataggtgtttctttataggttacctggtccttctgtctcatggctcttaagattctttccttcaccttaacattggataacctgatgacgaagtgcctaggcaaagatctttttgtgatgaatttcctgggtgttctttgtgcttcatgtgtttggatgtctaggtctctagcaaggccagagaagttttccttgattattcccccaaatatgttttccgagcttttagaattctcctcttcctcaggaacactgattatttttaggtttgattgtttaacataatcccagacttcttggaggctttgttcatattttattattcttttttctttgtctttgttagcttgggttaatttgaagacctagtcttcgagctctgaatttctttcttctacttgttcaattatattgctgagaccttccagagcatttcttattgttaaaagtgtgtccaaagtttcctgaatttttttttttctttaagctatctatttccttgaatatttctcccttcacttcttgtatcatattttggattttcttacattgggcttcgcctttctttggtccctccccaattagcttaataactaacctcctgaattatttttcgagtaaagcagggatttcttcttggatccattgctgatgaactagtgtgattttttgggtttgttgaagagccttgttttgtcatattaccagggttggttttctggtgccttctcatttgggtaggctctgtcagagggaaggtctagggccgaaggctgttgttcagattcttttttcccacagggtgttcccttgatgtagtactctcccccttttcctgtggatgtggcttcatgtgagccaaactgcagtgattgctctctcttctgggtctggccacccagagagtctgcctggctctgggctggtattggcacttgtctgcacagagtcctgtgataccaaccatctgtgggtctctcagccatggttaccagtgcctgttccggtggaggtggcggggtggggggtgcaatggactctgtgaggcttcttagcattgatggtttaatattctatttttgtgctggttggcttcctgccaggaggtggcactttccagagagcatcagctgtggtattatggggaggaaccagtggtgggtggggcctagaacaaccaagtttatataccctttgtcttccactaccagggtgggtaggaaaggaccatcagctgggagtggaactaggtgtgtctgagctcagactgtccttgggcgggtcttgctgcggctgctgttggggggtggaggtgagattcccaggtcaggggagttgtttacctaggaggattatggctgtctctgctgagtcatgcaggttgtcagggaagttgggggaaagggggcagtcacaggcctcacccaactcccatgcaaatgaaagggctggtctcactcccccagtgcacctcccaacaccctccagagcatttccaggctgagagcagtaagggcttgaaaacctgccccaggctgtatgcctcctagctttgaaagataagagcttggttcttcccctgcctgtggagtctgcacactgaatttgcaccctccttccagttctggccaggaggcttctcatctcgttcaaatggttacaaagttcagctagagatttccttctccctgtgtagttttaccctctgctcttctcccattggatccctggggtgccaggcaggaatggcctgctagggtacccagcgagctcccagggcctttctgctgcatcctctacccctgtattttgcttggctctccagattgactcagctccaggtaaagttggaaacttctcctgcaaacagaccttcggcttctccagtggggctgtgtgttcaggagaggagggtctccctctcccacttccgcaggtggggcactcgcagttttgggattgtctcctggttcctgcaggagcagtctgcttttttcagagggtctgtgggtcctctcaggatggctggtttgttttgcagtcgatctgatgctaaaattcacagtgcgaggtgccgcccactgctctgtccagagctgcaatctagtcctgcctcctgtctaccatgattgaccttaaaaactatccagcagtgttctgataacaatttgaattcatttacatgctgtcaacattattgctttaggatatattttgtttagctgccaagccacaacagtaacttctttattctttgcatcctttgctgagaataaaacctgttttgttataaatttacttatcttggggtatgaatgggctttggaatgagagagtcttgagtctaatcccactctgccatgtaaacttaaaattgttcccagcttaagttttctcatttgtaaaacagggtaacaagccttacattattgtggtattttgaaatcaagcatgttggggggctgacacaagtgctttgcaaacaataaatgccctgtgaaggataggtattaccccctgcagaaaaatgaaactggatccctatctctcattatatacaaaaaccaactcaagacagattaaagacttaaatgtaagacctgaaatgataaaaatactagaagaaaacctagggaaaactcctgtggacattgctgtaggcaaggaactcatgactaagacctcaaaggcagaagcaacaaaaacaaaaatagacaaatgagctttaagtaaactaaaaaggttttccacagcaaaagaagtgatcaccataatgaacagacaaccacagaatgagagaaagtatttgcaaactacgcatcccacaggagactaatatccagaatttataaggaagtcaacttaacaataacaaaaactaaccctattaaaaggtgggcaaaggacatgaatagacatttttcaaaagcagacatacaaatggacaacaagcatacaaaaaatattcaactcactaatcataagagaaatgcaaattaaaaccacaatgagatatcatcttataccagtcagaatggctattgttaaaagtaaaacaaacaaaacaaaacagatgttggtgaggatgcagagaaaggggaatgcttatacactattggtaggaatgtaaatgagtgcaacctctatggaaatcagtatggggatttcttaaagaactaaaattagaaccatcattcaatctagcaatcccactatggtgtatctactcaaaggaaaataaatcattatatcaaaaagatacctgcatttttatacttatcacagcacaatattcacaatagcaaagatatagaatcaacctaagtgtccattaacatatgatttaataaagaaaaggtagtatctatacacaatggaatactattcagctataaaaaagaatgaaataatctcttttgtagcgacatggatagaactagaggccattgtcttaagctaaacaactcagacacagaaagacaaataccttgtgtccttacttataagtgagacctaaataatgtgtatatatggacgtagaatttagaatgatatgcaatggacactaggaagtgtgaggggatgggaggagggtggatgactgggagttacttaatgggtacattatttgggtgatggataccctaaaaaccctgatttcaccactatgcatgcagtccatgtatataataaaattgcacttatacctcatacatttatacaaatttttaaaaaggcaaatataagcccattttcttttaaaaaaagtaaaataaaaggtggatattattgttagatgcgattattgttagatgctactttctgacttattcccagttcttagattgggggaactcgatttttgactctacagttcacagttcaacctttggatttctgaaaaaaaaaaaaaaaaaaaaaaaaaaaaagaattgagaagcattttgtagaacagattggagtttatctttaaataatcaaattaagcctttgtaatgggaacaagactaaattcagctctctaaattagccacaggaaagaaacaagaaggacaagtgatattattttaggtgctcagatatttgtataggctttgcttgctcacataaggaattgaggagagtatatcagcactgagctggtgctgtagtcccagctactggggagactgaggtaggaagatcactggagtccagaagttctgggctgtagtgtgctatcccttttgggtgtccacactgtttggcatcaatatactgacctcccaggagtgggggactactagtttgcctaatgaggggtgaagcagcccaggtctgaaatagaagaggtcaaaactcccatgctgatctgtatatcagcaatgtatacagtcttgaggaatcacacaggacagaaagtacctgaatcttaatctcagatatgtctaaaagggattgttaattttctgctgtgtgtcaggccctatctagtcatggtgtgaaagacaaagatgaagaaggcaaggctcttatgcaattgatggatagctccaggaaagacatcctggtgagcaggactgtgtgaaatagggaagcagctcctctaaattctttttttttttttttttttgagacggagtctcaccctgttgcccaggctggagtgcagtggtgcaatctcggctcactgcaacctctgcctcccgggttcaaatgattctcctgcctcagcctcccaagtagctgggattacagacgcccgccaccatgcccagccaatttttgtatttttagtagagacagggttttactatgttggccaggctggtctcgaccttgtgatctgcctgcctcagcctcccaaagtgctgggagtacaggcgtgagccaccgcgcctggcctctacattcttcatattgggactgtattagttagggttctccagagaaacagagctaacaggatgtatatatagaaagaggcttattgatggctcacatgattgtggaagcttgacaaatccaaaatcttcagggtgggccagcaggctggagacctgagaaagagttgcagttttagtccgaaggtgatccgttggcagaattccctctgcctcaggggcggtgagtcattttctgttaagacctttaattgattggatgaggctcacccatattatggagggtaagctgttttactccaagtcaactgatttaatatcaatcacatctaaaaaacactttcacagaaacatactatttgatcaaatatctgagtacagtggtctaggcaagttgacacataaaactatcacaggaacttgtttttggaatctgccttgtaccccatagcagattcaatcttatatagtatcccagccctaggccttaagcctccatcacttagttccatcctttgtttatgactgtgcttcaagcctactttgattgatggcactgctaagaccgtgtgcctttctgatcataccattagcttcagtcttgtcaacatttttatctgttgcagactgctgcctgggcctggcctcttcctataaccctaagctccactttgatcccagcctacttcagtcttctgcacagttgatttggcctacagactgctgaactgaggcaggatactcatagctcttagggggccattagtgtcctgacaatgtcatatcttccccttagctttgtatactatctagaagttacgtggcttcctgggattcttattacaaacttcagatccttcttgtttagaggtcatttattgtgaggctgctcctgccctctttgttctctcatcatgttttgtagggaggagaaattattaaatatactgccattttttaaataattgaatgcatatggtatttatgacctgcataccagtactgttatttcgctccattatgacttttattctcagaggcctatggttttcaaatgccactgttgtgaatagctgtctgtagaattgctaccatggtgcttgaatccttatacactagccattctacctgataccgtattccagtgagcactgtgcttgctgcccagcatttcagattggatctgatttcctgggattaaattccagacgttattttccaatttgtcatctgcctgtttgggggaagtttctttcaggttgtaggtcagatgggtgttcactgacatctttagatcctatttattgggtcttcttgttggtatttttttctataatggcagaataatttgttttcctcttcagaataattgcaaggtgaaaacaaataattctagcttaaaaatgatatcaaatgacttcattggttatattttagtagcttggaatattacagaaaagaagtacatattttcttctgctttgaaaggggaaatttaaatcaggatacttttagtctgtaaacatgactactttttaaaaacatatatgagaaatattggaacaataaaatctgattcatctaatagctttccttgatactttttatttttaactatgatagatatgtattaacatgtagttattctctttgaaaaagtatattcattttctaaaatgtacttagcttttcaaatatgattctcacagtgtcctgtgtattgttaaaaataattactgaaacagtttcactttgaagtacagtacttgaaatcttcagatcaatatcgccttttaaacctttaatacaaccttatgccaatcaagtcgcaagtgtagtttgctaaggtagaaacttcttgatttcagtacaattataactgaccaatctatatttcaaaatagaggcttttataatgagattccatatggatattgatttcaattttctgtgttaatataaaagtgcaagtggtctcaagcttaggtgatccaaaatatttttttaaggtagttgtttgaaacttagaatgttttttctaaagaactagtgttatacatgacaggtttccaggcccacccacaaaaggctgctcaaaccatagtgtaagctgaaaatagtgtcctaatggtggctgtaacttcttacttccctgaaaccactctaagtcctgattttctttgtgttcctagtatttgagtgtgagagggaagttggtagaagcaggtaggttgtatctggttagggtaaaagtgagaaaaagggttgttgatcagttcaggtggggtttaggtatagaagcttcatgaattagtgagttgctaaatatcagggaatgtaaagggcaaagttttggcctctggggtctagcaatagcaggaatggtgcccctgtctttagcagaggacctcagtgtttccatagggtctgtgatggcgcagtaagggtgtggcccttagcagaggtattggcactggtagctgtttgtatacataggattttcgcaactgtttataaggattgaatgctggtgagaggtgacagcatgctggcagtcctcacagccttcgctcgctctcggcgcctcctctgcctgggctcccactttggcggcacttgaggagcacttcagcccaccgctgcactgtgtgagcccctttctgggctggccaagactggagccggctccctcagcttgcagggagatgtgtagggaggcgcgagcgggaaccggggctgcgcgcggcgcttgcgggccagctggagttccgggtgggcgtgggcttggcgggccgcgcactcggagcagccggccggccctgccagcccgggcaatgaggggcttagcacccgggccagcggctgcggagggtgtactgggtcccccagcagtgccagcccaccggcgctgtgctcgatttctcgccgggccttagctgccttcccgcggggcagggctcgggacctgcagcccgccatgcctgagcctcccacccactccgtgggctcctgtgcggccaagcctccccgatgagcgccgccccctgctccacggcgcccagtcccatcgaccacccaagggctgaggagtgcgggcgcacagcgcgggactggcaggcatctccacctgcagccccagtgcaggatccactgggcgaagccagctgggctcctgagtctggtgaggacgtggagaacctttatgtctagctcagggattgtaaatacaccaattggcactctgtatctagctcaaggtttgtaaacacaccaatcagcaccctgtgtctagctcagggtttgtgaatgcaccaatctatactctgtatctagctactctggtggggccttggagaacctttgtgtctagctcagggattgtaaaggcaccaatcagcgccctgtggaagcagaccacttggctctaccaatcagcaggatgtgggtggggccagataagagaataaaagcaggctgccggagccagcagtggcaacaggctcgggtcccctttcacatggtggaagctttgttcttttgctctttgcaataaatcttggtactgttctctctttgggtccacgctacctttatgagatgtaacactcaccacaaaggtctgcagcttcactcctgaagccagcgagaccacgcacccaccgggaggaacgaacaactccagatgcgccgccttaagagctgtaacactcgccgccaaggtctgcagcttcactcctgagccagcgagaccatgcacccaccagaaggaagaaactccgaacgcatctgaacatcagaaggaacaaactccggacacgctgcctttaagaactgtaacaccgcgagggtccgcggcttcattcttgaagtcagtgagaccaaggacccaccaattccggatacactgggatttagatgccaactttactttttttagggtctgctgggctgagcctttaaaatttccctttgcttttagaaattaatttatggaccatacttgtatttgacccattatcccaagaaaattcttaaagcaaacataaaatacatggtccaggatttaatctagttgtcatatcattttaggttttcttaatctgtaacagctgttcagtctctctttgtctttcatgacaataccattttaaaaaattaatagactttatttttaagagcaattttaggtttacagtacaattgggcaagataatagtattatgtcaatgtaaattttctgattttgatagttatacatggttctgtaaaaaactggcttgtttttaagaaataaactgaagtgcttagggaaaagagcatcattctgcaatttactcttaaaaactatatatatagttttttctatgtatatatatagagagagagagagagagagagtgtgtgtgtgcgtgtgtagacaataaagcaagtgaagtaaaatgttaacaattagggaatctggaagtctgtgttctatatatctttatatccaataattttacttaaaataatgttttaaggaaatggtcataaatatttttctttttttttttttttttgagatggagtctctctctgtcacccaggctggagtgcagtggcgtgatctcggctcactgcaagctccatctcccgggttcacgccattctcctgcctcagcctcccgagtagctgggactacgggcatgtgccaccatgcccagctaatttttgtattttagtatagtcttaactgtaatagcaaaaggttagaaaagacctaaatggctatcaatgaagaattgcttacataagttagatttttacttaatggaatattatgtatgtatccatgaaaatgatgtaaaaacgtatagtccttgatttaggaagatgtctgaaatattttcttaaataaaaattgtcacagaaaaaaagacattaatttcggccagctgaggtggctcatgcctgtaatcccagcactttcagaggccaacgggtggtttacttgaggccaggagttcgagtttagcctgggcaacatggcgaaaccccatctctactaaaaataacaaaaattagctgggtgtggtggcacacgcccataatcccagctactcaggaggttgaggcacaagaattgcttgaacctgggaggcagcagaggttgcagtgagccaggatcatgccacagcacaccagactctgtctcaaaaaaaaaaaaaagaaaagaaaaaagacattaaatgcaaagaacagtgtcagtattgctaggatgtctgttctttccaactatatgttcaacatatcccaaaagtaagttgcaaaactataaaactttaggagataacataggacaaaatataggtgatcgtagtttgctgatgagcttcttttagatacaacaccaaaaacactgtacatgagagaagaaattggcaagtgagacttcattacataaaaaatttctgctttgtgaaagacactgttaagagaacgaaaagacaagccacaggctgggagaaaactttgtaaatatatatccatctgataaaagactggtatctaaaatatacaaataattcttaaaacccaacaataagaaaacaactcaagtaaaaagtaagggaaagatttgaacagatacttcactaaataagatgtacagatggcaaataagcacatgaaaagatgctcagtattatatgtcattaaagaattgcaagttaaaataacaattagctatcataatagctaaacccaaaactctgataacattgaatgctgacaaggacgtggaacaacagtaactctcattcattgctggtgggaatgcaaaatggtacagctgctttggaagacaggttggtaggttcttacaaagctaaacttagtcttactgtatgatccagcacacatgcttctagtatttaccctgagttgaagactgtccacacaaaaacttttacatgaatatttttagctactttatcataattggaccaaagtagaagcaaccaagatgtccttcagtggaaaaatgcatagacaaactatggtacacagatataatggaatacagatataatgcggagacactgcagttttggtttcagaccaccacaataaattgagtatagcaataaagtgagtcacagaaattgtttgctttcctaatgcaaataaaattatgtttatactatactttagtctattatttgatagcattatatctaaaaacatgtacataccttaatttaaaaatacttaattgctaaatattgctaatgatcatctgagtcttcagtgagttacagtctttttgctgatagagggtcttggctcattgttgatcagggtgatggttgctgaaggttagggtggctgtggcaatttcttgaagtaagacaacagggaagtttggtgtggttaacttatcctttcaatttctctgtagcacgggatgctgtttgatagcattgtacacacagtagaatttctttcaaaattgggttcagtcctctcaaacagtaccgctgctttatcaactaaatttgtgggatattctaatcctttgtagtcatttcaacagtctacatagcattttcaaaaggagtagtttccatctcaagaaaccactttctttgctcatccttaagaagtaactcctcatctgttcaagttttgttgtgagactgcagcaatttagttatgtctttagggttcacttctaattctagttctcttgctatttttaccacatctgcagtgatttccttcactgaagtcttgaagccctcaaattcatccaccaggcttggaatcaacttcttccaaactctcattcatgtttatatatatatatatatatatataacacaggctgggcctatatatatatatatatatatatatatatatgggcccagcctatgttataatttgacctccttttacaaatcatgaatgttcttaatggcatctagaatggtgaatccttttaagaaggtttagaattactatctgtggcagttatagccctattaaatgtatttcttacaagaaggcttgaaagttgaaattagtccttgatccatggactactgaagggatgttgtgttagcaggtgtgaaaaaaacattcatcttgtagatcagagcttttgggtggccaggagcattgtcaatgagcagtaatattttgaaaggaatcttttttttttttctgagcagtaagtctcaatagtaatcttaaaatattcagtagaccatgttgtaaacaaatgtgctgtcatccaagctttgttgttccatttatagagcacaggcagagtgcatttagcatcattctttttttttcttttttttttaaattatactttaagttttagggtacatgtgcacaatgtgcaggttagttacatatgtatacatgtgccatgttggtgtgctgcacccattaactcgtcatttaacattaggtatatctcctaatgctatccctccccactgcccccaccccaaaacaggccccagagtgtgatgttccccttcctgtgtccatgtgttctcattgttcaattcccacctatgagtgagaatgtgcggtgtttggtttttttgtccttgcgatagtttgctgagaatgatggtttccagcttcatccatgtccccacaaaggacatgaactcatccttttttatggctgcatagtattccatggtgtatatgtgccacattttcttaatccagtctatcattgttggacatttgggttggttccaagtctttgctattgtgagtagtgccgcaataaacatacgtgtgcatgtgtctttatagcagcatgatttataatcctttgggtatatacccagtaatgggatggctgggttaaatggtctttctagttctagatccctgaggaatcgccacactgacttccacaatggttgaactagtttacagtcccatcaacagtgtaaaagtgttcctgtttctccacatcctctccagcccctgttgtttcctgactttttaatgattgccattctaactggtgtgagatggtatctcattgtggttttgatttgcatttctctgatggccagtgatgatgagcattttttcatgtgtcttttggctgcataaatgtcttcctttgagaagtgtctgttcatgtccttctcccacttgttgatggggttgtttgttttttttcttgtaaatttgtttgagttcattgtagattctggatgttagccctttgtcagatgagtagattgcaaaaattttctcccattctataggttgcctgttcactctgatggtagtttcttttgctgtgcagaagctcttgaatttaattagatcccatttgtcaattttggcttttgttgccattgcttttggtgttttagacatgaagtccttgcccagcctattcttaatggccctacgatatttagaatgttaaacaagcattggcctcaaactaaagttacaagctgctgtagctcttaacaagagagttagcctgtcttttgactcttcgaagctaagtattgacttctcccctctggctatgaaaatcccagatagtgtcatcttccaaaataaggctgttttgcctacacaggaaatctcttgtttagtatagccaccttcatcagttatcttagctagatctagataacttgctgaaccttctacatcagcacttgctacttcatctttcacttttatgttatggagatggcttctttccttaaacctcaggaacctacctccgctagctcccagcttttcttctgcagcttcctcacctctgtcagccttcatagaattgaagagacttcgggctttgttctggattaggctttggtttaagggaatattgtggttggtttgatgttctatccagattgctcaaattttctccacatcagcaatagggctgttgcactttcttatcaaatgtgtgttcactgaagtggcactttcagtttccttcaagaaattttcctttgcatttacaattcagccaactgtttggcacatgaggcctagctttcagcttgtcttggcttttgacgtgtcctcctcactaagcttaatcatttctagcttttgatcgaaagtgagacacatgtgactctttctttcagttgaacacttagaggccattgtaggtttattaattggcctaattccaatcttgttgtgtctcagggaatagggaggctggaggagagggagagatatggataatggctggtcagtggagcagtcagagcacacacatttatagattaagttcattgtcttatatgggtgtggttcatggtgccccaagacaattacagttataacatcaaagatcactgatcacagatcaccataagagataaaataataatggaaatgtctgaaatgtaagaatcaccaaaacctgacacagagacactaagtgagcacatccgcttgggaaaatggtaccgatagatgtgcttgatgcagcgttgccacagaccttcaatttgtaaaacattcaatatctgtgaagcacaataagtaaagcataataaaatgaggtatgcctgacttatttagtgatataaagaaatgagctggccgggcgcggtggctcacgcctgtaatcccagcactttgggaggccaaggtgggaggatcacgaggtcaggagattgagactgtcctggctaacatggtgaaaccccgtctctactaaaaaaaaaaaaaattagccaggtggggtgtggtggcgggtgcctgtagtcccagctactcgggaggctgaggcaggagaatggcctgaacccgggaggcagagcttgcagtgagccgagattgtgccactgcactcccgcctgggcgacagagcgagactccgtctcacaaaaaaaaaaaaaaagaaaagaaaagaaaagaaatgaactaacaagtcatgaaaagacatggaggtaccttaaatgcctattactaagtgaaagatagccagtcttaaaagcctttatatactgcctgatgccaactatatgacattatggaaaaggcaaaactatagagacaataaaaagatcagtggttgataggagttgagtaggaggagtgaataggttgagcatatggcagttttagggccgtgaaactattctgtatgatactctaaaggtaaatatatgatattacggatttgcaaaacccgcagagctgtacaagaatgaaccctcatgtaatctctggactttaataaataataatgtatcaatattggtaaatcagttgtaacaaatgtaccacagtgatgcaagatgttaataatagggccaactttggacaggggagagagggtatatggggactctgtactttatgaccaatttttgtcaaaacttaaaactgcactactaaaaataaaagcaataataaaactcactaaaaatgcatcaatttaaaaaaagttaaaaaaccatgtattctattgattgttcatatatccttttccataattctccagtgacttaatatttgaatttaaacaatttaaaaatgatattcatataattccaaggttttccacacattttttatggactctcaattgttcttgggtgtaccttagttattcttagttcatctgttattttcctgtaagtacatatttcctgaaggtatatggttatactttgaaacaaaattagaaatgatcttacattaaatattatcctatttaaactattttaatagttttagatgatttaagttctcagcatgctttttctatcttctgtgctatatatgctctatttttatatcctttgtttctttgcagatgaaatggtttctattgttctagttctttctgtcttttgccaatagcccacctcatatctctgtacatgcacacccatcacaaacagacagacacacacatgcatacagacttttgaaccttagagttaagctgcattcttgtcaaaaagatctagcactccaagagtggatgcctctccctttctttgggagatcagcattactcatcacctcaaatattcttgcttcactatttgctcattgttttggatatacagagcacttaaatatttgctattttagtgcatcattaatgaaccgtttattatgttttcaaagtcaaatatgggtcaaagtaatttttttaactaagttttactcttcaggttcttttttaatgtgaaaaaaagaggcccacactgtttctgtctatttataggtggtaattggaagttggtacaagagtagtctaaacagaggagtcatattgctccaggcagattaaaaaaggtatctagttatataagcctacataaagccacatctccagactaatattttcaaacgtgaaggggataaaatttatattatgaacagctgtagatttaactttgtaaagcctaaaattatagtagaaaatatttcaattatagttcttaaaatatgaaagagatgttgattgtacattgaaatattttgcataatgacatctatttttcacacacatgcatacatacacacacattcccattttgtagattataaaacagaggcacacagtagttaagaggcttgtataagcttacacagctagcagggagaccatgattcaaacatcaggcagtagaactcctgagtaccctctctgaactgctaagctatgttacctctcatcttaactaacatgactcattttttgcccttaaaatgccttgaaaaatactatgaagaaatacctcatccagctgtagaggaacaaccaactacatttatttttagaaatgataaaggaattgttttgctctgtacatagacttctacaactagagcagttgcataacgtggtctgtgtagattacacttttttcacgattcatttaactacttgaatttgatatcatttcctttcaaactgaagcacatctgatgcagatttactgggacattcgcactccattttggttttaaaagttgcagacctcatttacaagagcatgaacaacatagctatttgaaattatcccatcttttataaggtttcacttttcttctggaaaggcaaataatacgtggaaaaacatacttaatagtattactgtttttttaattataactgacatactgctcatggactagttgccagttaacccactgatgtgtaaatgtcctaaactgagaggcttgactgaagaaaaataaccaagttacttagcctatatgacgaagtttcctaaaaacccctccatacacatttggaaatattcatattatatgtttttttaaatctctaaatgggaaattcatgtgtatttttgaaatcaaatccagactgctttgatttgcttgtgcttacgtcctataatttcaatgtcaagatgcaaaattgtactagtcattccttggagtggttaaaaatgaaacagtagtttgatttcatattcatgatcgattaagtgagaaatcaactgtgcagtagaacttttccagtttatgtaattcttgaagctttatgagctttagaatcaaaacgctttcatgatctttgcttaagacattatagtagtgttgcttagaagacaaagcaaataaaaatacttttatactcttcgcttaataccttgtagtagtcttgcttacttaaaaaaaaagcaaaaaaaactacatctgccaccttgcatttaatatttagaaaatacgaaaatgaaagaatcaaattaacaaacatttatttactcaacataaataattaacatttttggttttttgcttaatatattttattaaaaatttgacgtcaaagataaggttgaagtccactctgttacttctttagttccagcaaccgccctctcttttcagaggctactgcatttatgaatttggtgtatattcatttagttcatacttttgtccattgcctctactagtttaatgctttaaattcaatctgccttcttgtatcaaccatcatgtttagcattttagatacaccatattttaaactatttccaatcaaaatgtcagttattaaaaaaatcagtgtttattataaatttctatgataaatatttttcttggatctaattccttctttattgccaaaatttgtttttaatgagtgtaacaaactgttaatttttgtatgtctgaaaatttctttattttatccttactcttcaataacttagattcaagtatagaatcctgggtatagaattcctgctggatggttagtcttcttcaataattagaagataatatttcataatctagtagcatttgttgttgctgatgagaagtgttagtataattgctacctctataacaagctctcatatctctctgatagctttaaatattttctttttgtctttgttgttatggaatttcattacaattatgaatacctgtcgatttatgtgtgtatatataaatacaatctcccatttcttcaatctgatgattcttttttttgttagagaatatcagccacatactttgtatatattatcatctctgcacattctctttttttcctcacttagtgggactcctatgagacaaatgattcatcttttcattcttatacctcaaatcaatttctctttcatagtttttatcttttttctttccatattgtgtatctgcctcatatatctctttagctaagtctaatttatagttctattaattctttatttatttattttattattattattatactttaagttttagggtacatgtgcacagtgtgcaggttagttacatatgtatacatgtgccatgctggtgtgctgcacccattaacttgtcatttagcattaggtatatctcctaatgctatccctctcccctcccccccaccccaaaacaggccccagagtgtgatgttcccctttctgtgtccatgtgttctcattgttcaattcccacctatgagtgagaacgtgcggtgtttggtttttttgtccttgcgataatttgctgagaatgatggtttccagcttcatccatgtccccacaaaggacatgaactcatccttttttatggctgcatagtattccatggtgtatatgtgccacattttcttaatccagtctatcattgttggacctttgggttggttccaagtctttgctattgtgaatagtgccacaataaacatacgtgtgcatgtgtctttatagcagcatgatttataatcctttgtgtatatacccagtaatgggatggctgggtcaaatggtctttctagttctagatccctgaggaattgccacactgacttccacaatggttgaactagtttacagtcccaccaacagtgcaaaagtattcctatttcaaaagctaatccaccacgatcttgtaggctgtatccctgggatgcaaagttcatttaacaaatgcaaatcaataaatgttatttattacataaacagaactcaaaagaaaaaaacacatgattatattattatcttaattaatgtagaaaaaccttttaatgaaattcaacatccattcaggttagaaatactcaacacaccaggcgttgaaggaacataattcaaaataataagaactatgtatgaaaaacccacaaacaacattttactaatgagcaaaagctgcaagcatcccccttgaaaattggaacaagacaaggatgcccattctcaccactcctattcaacatagtattggaagtcctggccagaacagtcaggcaagagaaagatataaaaggcatccacattggaagagaggatgtcaaactattcctttttgcagacaatatcattctattcctggaaaatcccacagtctctacccaaaagctccttgagctgataaacgacttcagcaatcaggatacaaaatcagtgtacaaaaatcagcagccttctgaccaggcccagtggctcatgcctgtaatcccagcactttgggaggccgaggcgggcggatcattaggtcaggagttcaagaccagcctggccaatatggtaaaacctcgtctctaataaaaatacaaaaattagccagacacagtggcatgaacctgtagtcccagctacttgagaggctgaggcaggagaatcgcttgaacctgggaggcagaggttgcagtgagccaagattgcgccactgcactccagcctgggcgacagagtgagactccgtctcaaaaaaaaaaaaaaaaaaaaaaaaaaaatcagcagccttcctatacaccagcaacatccaagttgggaccccaatgaagaatacaatctcattctcaataggcaaaagagaataaagtacttaggaatacagttaactatagaggttaaaggtctctacagtgagaattacaaaacactgctgaaagaaatcagagataacagaaacaaatggaaaaacatttcatactcatggataggaagaatcaatattgttaacatggctgtactgcccaaagcaatttacagattcaatgctattaatatcaagttaccaatgacattcttcaacgaattagagaaactgttttaaaattcatatggaacaacaacaaaaagcttcaataaccaaggcaatcctaagcaaaaagaaatgctggagacattttctacctatctttaaactattctacaaggctggagtaactgaaacggcatgatactgtcacagacacacagacaaatggagcagaatagagagacctgaaataatgccatatacctacaaccatctgatcatcaaaaatgttgacaaaaacaaccaatggagaaaggactcattcaataaatggtggatatgcactagaccccttccttacaccatatacaaaaatcaactcaagatggattaaagtcttaaatgtaaaacctgaaactataaaaaccatggaaggtaatctaggaaataccattctggacacaggccctaaagatttcatgacgtagatgccaaaagcggttgcaataaaaacaaaaattgacaaatgggacctaattaaactaaagagcttctgcagagcaaaagaaactattagcacagtaaagagactacctacagaatgggagaaaatatttgtaagctgcacatctgacaaggctcttatatccggaatctataaagaacttaaacaaattaacaagcaaatgaaccccaaacaacttcatgaaaaagtgggcaatggacgtgaataaatacttttctaaagaagacttacatgtggttaagaagaacatgaaaaaatgctcaacatcacgaatcattagagaaacaataatcaacaaccacaatgagataccatcttataccagtcagaatggctgtcattaaaaagtcaaaaaaataacacatgctggcaaggttgtagagtaaagggaatgcttatacgctactggtgggaatgtaaattagttcagccattgtgaaaagcagtttaatgatttccaaaataacttaaaacagaactatgattcaactcagcaattccattattgggtatatactgaaaaggaaaataaatcattatgcaaaaaagaaaatgcacttgtatgtttatttcagtactctccataattgcaaagacatggaattaacataaatgcccatcagtggtagactggatacagaaaacatggtacatatacactatggaatactatacagccccccaaaatggatgagatcatgtcctttgcagcaatatggatggagctggagttcagtatcctaagcaaagtaacataggaacagaagaccaaatactgcgtgttctcacttataagtgggagctaaacactgaatagacatggacacaaagaaaagaacaaaagatacccaggcctacttgagggcagaaggagggaggacatgaggatcaaaagctacttaagaggtactatgcctattacctgggtgactgaataatcagtacactaaatgctcatgacatgcaacttacctatatgataaacctgcacatgtatccagaacctaaaataaaagttttggctgggcgtggcggctcttgcctgtaatctcagcactttgggaggccgaggtgggtggatcatgaggtcaggaattcaagatcagcctgaccaacatggtgaaaccccctctctactaaaaatacaaaaaatagctgggtgtggtggcacgtgcctgtaatcccagctattcaggagaatcacctgaacccgggaggcggaggttgcagtgagccgagattgcatcactgcacttcagcctgggtgacagagtgagactccgtctcaaaaaaaaaaagtttttaagaaataaatacaaaagaacacgaagaagtatttgctaacgcatatttttcttttggagcttagtatattaataggtatgtgatgcatattaactagcataatctgagatatttataaaggaaaatatcatcttgctaagtggttatatctcagccaaaaataaatttacatttgttataaaaactgaaaatttatgtggtttatgtgtagaaggcttatagaatcagtatgattttcattcagattggtgtgtgattttttttatcagtagaaaattttatgataacaacatgaaccactgctgggaattcaatggaccgtaaacataggcacataacagacatggaaacacgtacattgtgaaggataagtagatatttatcaaattatatatatatgatacatatacatataagcatatatgtatatatatgtaaaacattgtaaccatggccaccacctttagtaaaggtacatggtgatatgagtgcttataatagggaattaccttgtcagggaagttaaggaaggctttcctgaacaactgatgcttgaactccaacctgtgggatgatgtgttagaactggctagtgagtgggaatatccttacaaggaggggccctgtagcagaaggaaaagcagatgaaaatattgtcttcatacttagaatttaattttaaattttactgatgtttgtgttaatatccttgtctaatactattcttttacataagctttaatggagaccacccaattggttccttcagaaaatgtatgttaattaatgctagggacctatagtagatgtcataaaccttatgattaaacattacaactgtgtaaaattacatcttagtaacctcagtcatttgtattatattaaaatgagaaaatgcacagtgatagaagtcagattaaaggtcatgtaactaaaattgtatgctgaatgttgaggaaagaaaatttggatgttctctgttcatttgggttattcaaaataacatgtagtcctgcatacatttaaaaaattaaattagacaatttatcagttgtctaatttaaaatgtttggattcatcttcctatctgataacaattttttgtttttatattcagtactttgaaaaatcacagacttcacgttaacacttaagcattctaaaaaggcacaaaagcatgtgaatatagaatttaagttttgaggattgttcttgtcatttcctgcacacacagtatttgaaaaatgcatatgaccttgcatttaggtaatattagatcagaatgatctttccacatagaatattcatatgccagcagaagtatacatatctactttagagatagtaaacataggtcaaatagtgactgtggaccacatatattcacagcataaagaaattctcacattgaggaaattttatttatttgaatttttaaattgttccattggatgacagataacatttaggtgttaattacccaattattttcctttaaaagtaataaatgtatgtaatttctgtgaaaaggaaaaccagaaaacaggcatctgtttattctcatgtactgctaacttaaattttatgtaatttcaaagtccaaagccaaattatacaccttttctattgcaagcaaataaaaacaatgtaaaaattactttaaattcaagaaacacgagcttatacagttttcattatgatcacatccctaatgttcagagcctttcagaaaaaaggattttcatccattattctaaactattttattaatttgttaaattaaacagatactatcacgtaaaagtaacctcttcccatcttgttttcactaattactttcaccaagatcataataccttcttaaactgaagaaactattcatgtccccaaatacagtgcattggccttcacacacagttattgtatgttttggctcatcatgggccctctttggagatatgcttgaggactcccctttacctctaatgtctacagattcagcttttcagttcattgtgttaactgagttttacatacagactataaactgtctgctgaatctattgagataaaatttgtcagcttttgtgctcttttgcatagggtgaatactaatcttcatattcttatacatttagtttgaaacaaagtgaaattaactggtagtttaatacttcattgccttatgcctttttagctgaccatttgactgtttctctccagtcttgctttttcatctacaagtttactacaaagactctacaaatggttaatttgattgaaaatatctgcctaaactatgtcagtaaagcatttttccccttttttggctagatgccattattccatatatataattatttcattattttctcttctttatatcagattaagattcatgatacacattcttgtattgcctgtacggaaaacacagctccgttattcactttggctaagagccccttgggatttctgacattgggtaaattatagatatagtagacaaactgttaactcaggagtagtgaagaacttaactctttaatgggtagcttatcccaattcaccgctttcatgggaaaccaaggctgttttgaacaacatatgatagaaagtggcaagacatattctgtcatttgacacctgacaatatattatatatctcttttccttagtgtacatgttaggaaaattagcaagcatttataagctcatggaaactctgaaattccatataagttgttttatcaagtcgtagcagtcagttctatcacagcatatgctagacagggccagggcaaaaactacatctacctagacatgttgctggctacacatcttattgaagaccaaattagacagtaaggaggtggtgagtccttactggaacatctaaagataatcatcaaagacatgtactgaatattgttatgtctaggcttctttctaagtgcattttaggtgccagctcatttacttttcacagttctttgaaatactgatattgtctccattttgtagctggggaaactgagtcagagagaaaggttaggaagcattgctcaaggtaacatagaagaatgacagagctaggatttgattgcagatattctggcccatggcacctcttaacctttgtgttatgttgcttctcaggctgacagtgagctcagacgctggaatgttggtcaaaatgaggggacttgaaagtgaacttcaaaattatccagttattttctggggtgatgctaaaaaaaaaaacccatattcagtagtgagcaaaagaggtgtcatgaagaatgtttatttagtggtcagtatgtagatggccaactctagaaggaggtgtgacattgtggtgtccaggctgcatgttatgaatagatttggaacctggcatgaagatccatagcagcccatgggtggatctatacagaacaaaggccctaacccaagaactagtatgtcctttttctggcctccttttaaaacaacttcttggtatgggtatataatgtgggcagaggtgttctgttctctaaagcaggtacaaatgatggccgctgagcgctggagcctccagggccatcacatttttaacagataaattacttaaagcttgaataaatggaatcttgtccatgctgtgatattacttggctctttgtgggtcctcagtaaacatgaaataaccctgaccttttaggaaaagattaatctggttactagccgtaagtgttaatgtaatattcttgtagcaaataaaaccctaagcacacagttgttgtttggtaaacattttgtttattgagcctgattttcctgctttcagccatagagaaatttaagcttcatatattattctttcatgggtaaattgtacctgctttttgagggtgagtagactgaaactaagactacggaagctaacagtttcatatgcctaggccgggcgtagtggctcatgcctgtaatcccagcactttgggaggctgaggtgggcagatcatgaggtcaggagatcgagaccatcctggctaacaaggtgaaaccccgtctctactaaaaatacacaaatcagccgggcgtggtggcgggcacctgtagtcccagctacttgggaggctgaggtaggagaatggcgtgaacctgggaggtggagcttgcagtgagccgagattgtgccactgcactccagcctgggtgacagagctagacttcgtctcaaaaaaaaaaaaaaaaaattcgtatgcttttgctaggcattataacatttaatcctcacatcaaccatggaaattaaaatatattcattcccattcttcagtggagaaacttgaagctcagagaggatgagtaacttgcacagagttgcatagttagtaagcattaaatccagcatagaactcaggtctgaggaactcccaatccattgcttatgttacttcatccacaagtattgtgaaatatacaactttaacatttcaaagagcagaattaaagaatctgccagcttccttttgaataggagaggggtattccaaggtcattagagaactggcctggagctcttaatgctataactcctaccaacactaaaggagagagtgggatcattgtcctgttcccattgccatcacctctacccctaaagcatgcagacatactttatccagagagttgaaaattcacagacaccattcctctcattccttccaagctgctgtggcttagatccaagcaagctccccatgtttcccttaattccaagggctattatctcaggttctgcacatcttacaaagtagatgtagtattgcaagtattgttttatctcaggctaacctatccatttaaagctctggacagtcatgttggtatagtttatgaatgtaaaattcttccttaaacataaattctagcttgaaattattcctaaccaccatctactccaaggccacatgaaattaatcttttacatatgatttttctggaaagtaagtttttgcttctacctgaaggagtacatctttatctgttcagggctcattaatgtttcctctaagatcccacagcagccatttgtaacacttcatggtgcttctcatgcaggcaggcatggatttgctctgaggacaatcaggatatcatcatcatcttcattgtagtgacttctatccctttctgtagtactttgatgtagtattggagtattagatcaggataatacgggatgaaatcctcccaaaataaatcatgcttgactctccgccgaggaaattcctccctctatttaataacggagaaaaatccagtcatctctgagtctagctcaagtatctccattgtgtgaagcttttcctaattcctcatttaaattagtctgtttttcctcttctttgtatagactacaccatgctgcctcctagttctgcttctgattccttttctaggtagtctcaaccttccggaatgagagatattaaggatacaagggtgaaacaggtagaagaagatgtgattttataatttcctttatttactctggttcttaccaaacaacaggtttatcagaatcagaatttttgtagcattcagacccagtttaaccctttttaaaatataacaaacttctttatcctgttgtaaaaacccctcccaaactcttattcagccttccctcaaggtgaagctccatttgccgctacaaagtacttgattcatatctgttatttcatattataatataattatcaaaagttaggggcctcatttccatggcaaccagggtgaaattttgtctttatgacagtcttaaccctacttgattgaattccagaatatccttttgtctcctctcatttttgtgattgaaagcatacaaaatgtctacagttcacctgtctgctgctcccagttttttctgtctaaccataaacgaatctgtgcattcataactaaatcactaactttggcctccagattattttgatagttttagaaataagtgtatataaatatataaataaattattaacaatagagaagcaaatctacaggattgaagtaatatacacaaggtgtgacatcacatacagacagatccaaaacttggacctgatcttcaggatttccagtgcgaggctccttccactaatagatggaagggtggaaagatgccttcttatgccagcgctaacaaaacatgttatgcattgtcattgtcaacatctcactggttgttgtggttatgtggacttttgcagtgtttatattcagaatatggctacgtaagaattagatgaaatataaggaatgactcaaagttggttgtaatatttgaagtcatttcctttattttatttagcatagccacatgttatttggagatagagttttaaatatattgttttacaggttgggtgtccctaatctgaaaatgtgaaattcaaaatgttccaaaatccaaaactttttgagtgccgacgtgatgccacaagtgggtagtgaagatgacgtttttaacactgcagaagaagtgcctataagtgacatggtgaaaatgtgtgatgggattattgaaggaatagagcagcacacattcataacagaacaagaaatcatgtcagtttataaaatcaaaggaaggtttctaagacaaaaaaattcatgaggcagatgactctgaggggaacatttgaaaatcgtatccagcagaattcctcctcatccctataggacccatttccactgcttcttatgttttttcttacctaaaaaaaatgctgtttacagtagccttttaatcaaaacacagcatcataggtggagactgaaagcctgctgctgtttgttgttgctgtggtctaacagctgctataggtatctggtgatgcaactgtgctgcttagctacacttaacacattactttttcactgtattaatgatacgccatattttttttactgttaagtacttatatctgactaaatataagaaaatgattgcttatcagtagcatataaattcagagtcaggaataagctcatgccaagcaaccacagattgtccgtatgggtggctgagatagtgacacctttgctttctaactatttaacgtacacagactttgtctcatgcacaaaattatttaaaatattgtatatggccaggcacagtggctcagcctgtaagctcagcactttgggagccgaggcaggtggatcacctgagatcaagagttcgagaccagcctgatcaacatagtgaaacgctgtctctactaaaaatacaaaattagccgggtgtggtggcacatgcctgtaatcccagctactctggaggcggaggcaggagaatcgcttgaacccggcaggcggaggttgcagtgagccaagattatgccattgcattccagcctgggtgacagagcgagactctgtctcaaaataataataataataataaataaaatattgtgtaaaattaccctcaggctatgtgcataaaatgcatataaagcataaatagattttgggtttagacttatatcccatctccaggatatctcattatgtatatgcagatattccaaaaatcagaaaaaaatcccaaatctgaaacacttttggtcccatgcatttcacctaagggatactcaacccatattggcatataatttttttttgtatatattcttcttcataatatattcaataagataatccataacttttttcgatatgagattagatttttaaaaatacattgtctctagtttcattggtcacttaggaaacaatagactacactgtgtcatttaaatagcactgattagccaaatggccattttaaattccaattcttactctgatttaatagccaatagaagaagtttttctagaggcaagatcttgtcagaaacaattaatgggttgccctttgtggcttctttgttctttttagggtattcttttctatgatttcaaaggttttttttttttttttttttttggtagatgacacagaaacttctcagtttattcccctgtgtcatctaaaatactataatttgccacagaaatttgctctgatgcagtcccctgaaatcattctaccaccctcaattgtggcaggaaatatgtttaaaatgttgtctcagtataatgcaaaagccagagttaagagtgatatggaaaagtgatccgatgaggtggagaggcaagaatagtagcatgaatctcagttgtgtatattttgacaagaaataggaaggggcaaaaccaaggagaaggtggcagggatggagaaaagagggtggctttccaagagataggcttcgtcttggttctgcctgcatagttgcagcacttgagggttggagagggaccacagggggtcacagagctatgtctccagcatcaaaattagagggcccaaagacataattcagaagtttgggatgcaaacttttttgaagttctctcatgagatctgccatcaagatcctgactgttgtcatattgagtttgttttcatagcaagatttattgttatcaagttctatcgtaccttgtaaagctttttttaaaaaaaacttcagagtgattttgagctatagtatggcaaaatttataccctgctacctttctggagccatacaatatactacgacagaaaatataaggtggcacgttgtatataatacaagtgataatggaggaactgaataattggaagtactctaaaactacacccagacacgggggtgggggatagcagtataaaatgttcatcaaccaaagtcaaagtataaaaggagaagcaggactttggagcaggagtgtaagatctcagggactcatgggtggggtgagggtggatatgggagaataactttacaaaatattgagggtaataattacaaagtttggcctacccagaaagactagatagggatgctgaaaaaggtgaaagcgctcacctttttccagccaagactgactatacgtaggtggcttcattctgaaaaaaaaaaataactgatttggacctcctctgggctgtatgtgggcgcagttgagaggatgtactgtcccacctttctgataaaggaactatgtaaataattgctttgttgccaattttaaggaatgacatgtctgtattgtatttctcctcacctccccacccccagcctgctcatttacatttcttttagttctttgaaaaatagaaatcatcactggaatacatgataaccattattaatttcttttgactttcattttctaagaataatgaatacttacctactaccctccatgctactaccgaaaagtggattggaaaataccctttgaaccagagtcttcagtagagtgtctaggtcaggagtgccctgtttgagccattgtgtcctttagaaaatggcagtttatctggcaaattcttgattggggaattgtagatggatcaggcattgtctgattcccttattttcttttacgcatataatttgccatcttataccttttcaaatatattgaattgtccttagtatatgtaatttatttccatagagtctctagcttgttgtactaataaagtgataataataacagtaatgacaataataataataatgtcaacctttttgccaaagaattatttgaatctgaaaaaatgcaataataggtataactgaaagtatgactctatgaagtgatcttaccttatttaagccagtaattgcattgctatttaaagatttttttttgttatggttcctcatggaacagaaaagttctaattgattgtcagcaaatactgtgactaaaattaatatttattacctaactggaaaataatattttataatagtttgatgacattttaaacagattttgaaatctaaacatatttttattgctggcacttctagattcataaaattaagtgacagatgaattcgaatgtgtttgaggacctatgtactatcagatcacaacaaaacttcctaactgccatacaccaaaaaatagacttagggactaaaccttgtcttactgcactgtacagtgtacttttttctgttttctaattgcatatcctctttttctcttggaaaacgttcgataaaagtactttaagaaagaaacttgaagttgagctcctgctattggaaaatgttctgtgtactcttaatgaattgtttgtatatttgtcattaaaacatttaattatattcttacattacagtctttgttttatctaaacttgtgtttccaagggtatatctgagtaagatttaactgaacacaccacactttcagattggatattttactcaaataagacatgattatattacagatggaatacagtcaattataatatttctacatatgttagaagagcaaaggtgaaacagcgaaaactcattaaggatttaataaaaggagccaaaatattaccactagcatttgttaatctaagtgctaaaaatgtctgcctctgaagccagcagaaaacaattatttaagcaagtggaaaatagacaatgaggaaaatggtgctttcaaatatcttcactatgtttgtctatgcaatgacatgataggaagtagaaaagactgttgaagtgtaaagtgtaccaaacttagacaaatactagaaaaaggtctagaatggttaaaaaccaaaggagtttaaggaagctgaatttccttaagaccatgtatctattaatttaccttcttgggaacttcatctgcccaaatttgcactagttttttcttgaggtttaatttaaatctacagtactcactttaaaaaaatccttaatttggttgtaagcaataatatctgtaaataaaagtgtaaaattttagcactgtctaccacttaatcttttatgtgtcccactatggacacactgccttggggaagatgttaaatatatcggagggtaactgtttctataaagatgagaagtaagaaatggaggaagaaatctagagagctaaatacagaattgcataattaccagaggcaggagaaaattgcacaaatctatgctaagtttatccaaatcaggtctctccaattatattgtgagtgggtgatgtgagcctatctggagacttttctgtttcccagtcactgttcccccctaataattatcctgactatatgggatcagaaaaattttggagtgggctttggttggccacctttccctcatctagaggatttgctgctattcttttattctttcactgtataaaaaccccaaagaggagtctctgttaaaatctactgatttttttctatttattctatgtatccctactttaatattcacatattctatgtattatttatatattttttggtctctttcccctcacttgtatatagcttcatgaagacaagaatttgtgtgttttgtttactgccatattttgaactcctagaacagaatctggcacacaccaaatgttcaataaatatttgctgaatgaatgaatgatgaatgattttagctttgaatattatctcatgttcttgttatttcttgtcccctgtcttgataacaaatttcctctcacccagcatttaaaatggattttttcttcttgcattgtttagtctcttccttttatttaggctgcagcttttaaagctacattttatttagttgtagtattaatttatagctgaagctccaaaaatgttttatttttcttttatcatggtaaaattaatcctttaattttattctcccttgtcattgatcatttctagcataagattaaaattatatacttcattaattttcctcacactgcaaaatttagttttacagtatggtatgaaccctgttgttttgagtgttgttatacttcttgtgctttaaacttttgtcatttgatagaaatggtacatttcgaagggtacatgtaaatggtatatttttaattttgttttctttttagcactcaaggagattctgacagaaaatggtatattttatgagtagtgattttgtgaaaagcatttcagagcttccatttcccctcttgctttgataaataccttttacttcagataacatggtagttttggtctgttgttagtaaatatagtcttatggttttcaaaagaaatgttttaacataacttatttttacttcttcactttatatttctttaatgcttaaagtatgttctcaacaaataactgaggcagaacataggtgattaatcaatatgactagagtgtgtttttatcttcgctaagatatgtatgtgaaagatgatatagtatgttttccccaaatatactaatttctcctactttggatattttctaagattttaaactatatttttagattgttaatattttcataaaagctactttaaaaataatgtccatatatgtttgaattgttattacctccaagcctgttcttattctctacacttccttgcaattgaaatcaagtacaatgcttttgatctacaattagaatgtttatcatcaaggggtgagaatctgaactttttcaaacctctggatttgaaattctgtgtgttttctgagtcaaaggatgagtacatctttgaacttcataggccgtaatgcaaggcagacagcaagaaatacaaatactttcccttcttgtttactgtgagatacagacgtgcatttatttgtttcatatgcccctcactttttcagtctaaaccaatgggtgcaattaaattagaataaatgtaaaacaaaaaattaaagtaaaacatcatttagaaaattcagggactgtcaaatgggaaaagcaaatagatttctaaatgcctgataatttaaaacaaaattaatacaaaaattaacaaatagagcattaaaaaaagatagatatgcaaatatattaacatggaggacatttgtttttctgaaagaatatgtaaatctgcaatctttatgaaacgaatttatttaatacatttattagtgaattattattcaggcctgaattttgtggtatattgaggattttactattatcattttgcttttcagttattttccattgtcctaattctctcaaaaatatttggaaactattttttcaatcaaattttcaatattcaaaaatttgacattggttttaagaactgctaagaatatacacttgaatgtatctacatgattagcactgaagtgtcatttttaataatttagtgaaaaaaaagataaagattgtgtcttagtgtgtggtaatataaaattaagatacaaatagggcctagttttccatatatgttaaaatattttattttatttttatcaggtaaaattgagtctttaattatattctctttagtcatttattatttatttctagtaaaataaggagagttaccttttatctaaaagaaattcagctagttttccctacgaaatactaaacatttccacgaaatagttttttaccagtgttgctaagaagttgcagtaaataattttgttctatccatattttagtgattatgctatagctagccctcttttctaaaaatggaattaaaaagaagtgtaaggttaatattgttatgtgtgaatttgatcctgtcattatgatgttagctggttattttgctcgttagttgatgcagtttcttcctagcctcgatggtctttacaatttggcatgtttttgcagtggctggtaccggttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgagttgaaaattctttaagaatgttgaatattggcccccactctgttctggcttgtagagtttctgctgagagatccgctgttagtctgatgggcttccctttgtgggtaacccgacctttctctctggctgcccttaacaatattaaccttaaatgtaaatgggctaaatgctccaattaaaagacacagactggcaaattggataaagagtcaagacccatcagggtgcaaagcaaagagttggaaccaagccaaatgtccaacaatgataggctggattaagaaaatgtggcacatatataccatggaatactatgcagccataaaaaaggatgagttcatgtcctttgtagggacatggatgaagctggaaaccatcattctcagcaaactatcgcagggacaaaaaaaccaaacaccgcatgttctcactcataggtgggaattgaacaatgagaacacatggacacaggaaggggaacatcacacaccggggcctgttgtggggtgggggcaggggggagggatagcattaggagatgtacctaatgctaaatgatgagttaatgggtgcaacacaccaacatggcacatgtatacatatgtaactaacctgcacattgtgcacatgtaccctaatacttaaaagtataataaataaataaataaataaataaataaataaataaataaaaaagaaaatgtcattccattgtcttctgtctcattccaggaagtcagctgtaactctcattgtagctctttgaaagtaatatgtctctgaatcacattctccctctctctcttttcacctctttaaaacattttttgtctttgtttttcagcagttttacttttatgaagggcctagatgttgtttttttcttttctttttgcagtatttcatagtgcctattaaatctgtggcttcatattttcaattttgaagagttctctgcctttatttgtttagattagttttttcccattttgtctgtcccccaagccctttctttaaatttagttgctcacatctaggacttttttcctaagggtctcttagatttattctctgtattttctttttgcctttttatgcctaaatctgtccgtattctagttttgctattcagtttttagctgcatctaatcagctgcttatcccgtacttgggttcttattttcacttatactttttctagaatttttatttgtttttctttttgtggtgtctatttatcttctgatataaccaacttttaaagaaattcctcacgcatattgatcataattatttcaaagttcatgactgataactctattatatgaattcttgtgagttattttattgtagtatttttctcttagtttttgactatgtcttattttcatgaatacatgattattgatttatattagacatttttttgttttaaaatttagcaaaatgttgaggctctgaaacatgttatattcccttagagaagatttacttttgtttctggcaagtaattggcctgggaatggcagtattccatgattaccttaatgccatcaaaacttgagattattggaagcttgccttcatttcttgagatgctagcctatttaagaccttgcactcttcctaaggtctcctaatggaaagtttcttgtgtctagtctttcctatttgttaggccataaactttcatttttatcccgtttaagccccagaatcttttggaagatctgttcaattttctaacttctcagctcccactgcagattctagatatttggcttagctatctgggatttactctactaccttcatcctttcacatttctttctgctttggtatttctctgatggcttctaataattgtttttatattttcccatgatcttctaattgttttcattattatgttttgtgttacacattctagttcaccactggcagaagtagaagcaaagatctggtttggttctatgcttcttagtcccagcctctcatgcataccaaagacattacaagggagacaatatttgtcaccaaaaacaaaataaaacaaaaaacaaatacaaaaaaattcaccatagcactagtggtctttaccctgcaccaataaggtacattcagatgcaagagagacttgttaatgtaaacctcccatgacgatgatgattggtacatgagtggtcaaaatttaaatcagagcttctcttctcttggctaggcaccaaggtctagaggaataataatattagatatcatcttcctgaggaaaaaaccattaattctttatatagatgtcagaattttaagatgcagattactttaaatttgttttacctatttttactccttttagttttttaccttcattttaaacctaaaagtggataatttttaaggtttatatatagttaccaggtttttttaaagtacagtaaaagaaaaagtatagtatagctttatgttgtatgaaaactctaaaagggaattttttcactatagatgaaatcttttaaacataatacttattttctgttaagattacttaaaaatctgaggtaccccacatggtggcctcataacccaattaagattacttaaaaatataaagagagacaaaatgtatgcataacttttaaaatttatttttatatgaaggagttctgtaatttagtgatgatttataaatcaacttgcctgtcctttatttatttatttaaatagtttttggggaacagatggtttttagtcacatggataagttctttagtggtaattaccgagcttttggtgcacgcatcatctgcgcagcatacactgtagccagtgtgtagtcttgtattccttgcccccttcttcactttccccagcatccccaaagtctgttttgtcattcttatgcctttgcatcctcatagcttggctcccatttaaaattgagaacatataagatttggttttccatttttgagttgctgcacttagaataatggtctccaattccacccaggttgctgtgaatgccattattttgttcctttttatggctgagtagtattctatgatgtatatatgccacattttctttatccactcattggttgttgggcatttgggttggttccatatttttacaattgtgaattgtgctgctataaacatgcatgtgcaagtgtcttttttcatataatgacttcttttcctctgggtagatgcccagtagtgggattgctgggtcaaatggtagtcctacttttagttctttaaagaatctccatactggttgtactagtttacattcccaccagtagtgtaaaagtgttcccttttcaccacatccttgccaacatctattatttttttattatggccattcttgcaggagtaagttggtatctcattgtggttttaatttgcatttctctgataattagtgatgctgagcatattttcatatgttttttggctatttgtatatcttcttttgagaattgtctattcatatcatttgcccactttttgatgggattttttttcttgccaatttatttgagctccctgtagattctggatattagtcctttgtcagatgcatagcttgcgaatattttctcccattgtgtgggttgtctgtttactctgctaattgtttcttttgctgtgcagaagctttttagtttaattaggtcccatcgattcatttttgtttttgttgcatttgcttttgggttctttgtcatgaactctccctaagccaacgtctagaagagttttacctatgttatcttctagattctttagtgtttcagatcttagatttaagtctttgatccatcttgagttgatttttgtataaggtaagagatgaggatccagtttcattcttctaatttttaaaattagttaatttattaatttgttttttcccagacagagtcttgctctgttacccaggctggagtgcagtagcatgatctcagctcactgcaacctctgcctcccgggttcaagcaattcccctgcctcagccttctgagtagctgggattacagccatgtaccaccatgcccagctaatttttgtatttttagtagagacggtgtttcaccatgttggccaggctgatcttgaactcctgaccgtgtgatccacccgccttggcctcccaaagtgctgggattacaggcaaaagatttctttaatgtcacctcccttaacttgagcagttagaatggtttgaaaaaaatgagaaatattttgaaccttgtaaatttacaaattcatatataaacttagggtgctaaaacaaatagttctttccttttaaattttataatttgattttaatactctttctgtgtcaattatgtatattagcccaagttctatcctttgggagctattttgctttgtttctgtagctcatacttaccctcagcttttcattctgtgaaagtatgctatttactgcaagggattgtgaatttagtttcaatgtaactggtaaaaacaaaaaaacagaaagatgagctgtttatgtaccattagtcaaatatttattaagcagctgctatgttttaagcactgtgctaggtgctggggacccaaaaatgaatgaaacagccttttcttcagggagctgctggcctaatggggatgcagacaagaagaaagagagttatttatggtgtgataagtgcaactgtagaattaatggagtatactatggaatcacattcttttctaacagttgctgaacagtgtcttggtatgtagagaagtagtagcctctgctgtctatcctttgtttatgggatatagaggggaggcggggaaaactcatgaatcaatcagttgttacagaacagcattccaatgagttgtgtaaaagaattggaaacagattgaagttccttaattcatgaatctctaaaagtggttggggacaagtgtgctttgctcttgccaaagtgtagtgcatgaaagatagtgtgtcattttactgacccatatccaccctcaaattaagttactcattgtgctctcatcagattttaaaagagaaatgcaaaacatggatattagtagaaatgccacaaaatacaataatcagataaaacagtcttaagaagaacactgttttgtgtgtgtgtttgtgtgtagaagtatgagtacatatgtgtttgtatttttgcatggacatacatttatttgtgtatagtgagtatttatatgaaggtacataacaaaatgaactatggttaaacatatttatgccactagtgggtagtgttagtggagactgtcagaattaacttcataggatttctcagtgcaaaaaaatgtcatgataatgtcatgtctgcctttctcaaagataaaggtactttgattaaccctaagctccctttttttgttttaagagacaggatctggttttatcacccaggctggagtgcagtggtgcaatcatagctcatttcagttacggactcctggcctcaagggatcctcccaccttggcctcacaaaatgctgggattacaggcatgagccaccacacccagcccctaagctccttttaaagaggcaatgtgatgtagtggcttaggacacagtctggacagactgcctgagtttaaatcatatatctatcatttgttatatttgacacattccttaactttttagtgtcctggtttatttgtctataaaacattttaataatccctatcttatatgctcttgtgagcattaaatgatatatgtaaagttcttaggtgaataatgggtatgcagtaaggaatacataagtataacaaacactgatggttacactttatgtggaaggcctattccatactgagaattggttatggcagacagatttgtggtattctttctttgctctccatttccttcaatggcttaagagtacttgggacaggatttagggagatctacagagtaccatcataataagatgtaaattacatgcaaatcagtaggtacatattatttgtccagcatgtacttgatgttaaaagaaaatttggatacatagtgaaaacaagtataattcctcagagattgtttggagtccttccaagtgtttttagtgatcagaaaatactgaggtgtttagctgatgagaaaataaagagaaaaaaaggggaagctattgtcaagtaaaatagagacagtcactttggaacatcagtaagtgaagtttttttatttcattgtagaaatgaggaagcatgttgaaaaattaatttgggttagtaacaaaatcccttttgttgtgatgtttgtattcttaaccaaaaatctatcttttttctactttcgcatttaatgtgacttttttcctatacttattttgaactcactgaaaatatactttatatcatctcttttgttttaacagttatagttcagagtaggtgaaaaataagaataatatattagtttcattatcactacatctgttatctacacatgtgtgtgtatgtgtgcgggtgtgtgtaatctgaaaaaacatagaattgaaaatcaagaaacctatattccagccatagtttatctcacctataagatgtgtgtatgttgaatgagaacgttatatatgcaaatgatttattcgttccttcccctgttcatttatttaatttattgaatgtcttttatgtgtcagatactgacagtacaaaggtgagtaactcatagactctgtctacaatatactttacatatagtagaagactaattcacagtagagcatgtgacccaagccatgtaatcaaagtcttcttgggaatttttgtgggagtcttggagaaacgtgattttttttttccttttgattttgtgctagaaggacatgataaggataaagatgctagtgaccatctcttagaccatagtgttttggaaaatgaggtcaagataaaagaaagcaaagctaaaagctggagaggagacaatatgtttctttggtgatagagatgcaagaaagggaaggctttaccaggtagaggaggcaccacaaacaaggacatggagagatataaaacaatataatgttctaaatgaaatgtaagatgtgcagaggggttgaaggaatggagggaaagttaggcagaggctaagtataaaagatcttttaatcttgcaggtagtggggagccattgaagtactttaaaaataatctggcaataaagtaaggagagagaatctacatgatgtggtaaatgacctaattgggaaggtgagagaataggtggaatgtaggttggcttcaaggtttcttctgatttgggtgtctgattgcattgtgttattattcaaaaagataagaaattcaaaaggagaataaggagaaaagataattactgttcttttggaaataatgaatttgaagttcatttggaagatctacctggaagtgtcttgactaaagttcggcagagggctctcttagttgaccatccgattacagctatcaacacagatgtgatagtggaaaccatgaaagtgaatgtaattacttggaaagagcaagtagttctagaagagaagaaagatggaggcagaactttgggtaggtgaaagaacatgaaaggagactaaaagggagaggtaggagagggagtggtgtcatggaggctagggaaagaaaaggtttaataagaaggcctgctcaataatcaactgcacagagaagtcaaacagcattactgaaaacaatctattggattttgcaattaagaggatatttatattcatccaagagcaatcttttttgagaatagagtgaggaggtaggccaaggtatgattgtagtggattgaagagtaaagagaaaataaaagaaaagagtgatagtagttctagaataacgtaggattgaggaagtttggtttagtttggattgtaagatggaaaaccacttaaatagattttgaagaagaggtcagtagagaggcacagattgaaaataaaggagatggagaaagtgaattatcagtgaatttctggagaatatatcaaggaaccatgtggagggtgacttttcgttaggaatgcacctttttttgatactagaggaaggaagggagaggatacatatggacatggataggcatatcagtcaagttataactatccccaaaagaagccacttaaagtgtttaaaagagaaggaatttaatgcaaataatttgttaataggtcatggaagaattggaaagctaaatagggaattgtaaaccaacccaataattaacaagagcatgaagccaataagctggagggacaaaaaaggaggtagcattactaggagtggaagctagaaccatgccatcctgtctgttaccctttgaaggaaacaagctctggtagagataccatcagaggcagagggtaggggagaggaatgtcctagcttctctccactttctccctttcagtctcctgctggtgccccccagacatccagcatgaagcctccagggtcaagctttgtgccatcttaagcagagccaggaaaaagaacaaaaggctctgagctcaaacaggcccatgactattataatagggttggaagtgtgtgagagaggaaagaaaataagaaacgaagaaaagccaggcatggtggctcatgcttgtaatcgcagcactttgggaggccaaggtgagtggatcagttgagcccaggaggttgagaccagtctgggaaacatggtgaaatcccgactccacacacacacacacacaacaaaaagttagctgggcgtggtggcctgctaacttttactcccagttacttgggaagctgcagcaggaggatcacctgagcccaggaggtcacggctgcagtaagccatgattgtaccacttcactccagcctgggtgacagagcaagaccctatctaaacacacacacacacacacacacacacacacacacacacacacacacacacacacaacacaagtgaaggaaaaagatggtaggagtatgtgcatgaaaattggtaaagctactatgaagaatggttgaaggaaccgagcaggcatatataatacacaatgcaatttggctgatgatccatttcatttctagacaagaagttgctatagcaccaatttgcactactggacgtaccaggaatacatgtccacaggaccagagaagcttctctgagatccaagtaaatatattgtaagtaaacaagtgagaaagcttacaggagaaagagcaactgtgagagactagtatgttgtcatttaagattttggaaggggaacagttctaagtactaggaagttccatgaaaacataagcaggggtgatttctgtgttgcagagagggtaaaataacttgcatactaggtaattgagagctattgacatgggtgttgaagtcagcagtgattataacattttttagggtaaaaaggaagaccaagtcaggtgtccaaatcttcagggaattaagtgatcatctggaaaagacaaggatgataacagtaaagagtagaaagtgatacacttgatatgtgtctctaagagcagagggttttgagataaggttgggaaagtaatggtataaatatggtgattaagagagtgctacccatggccctgtgtcacgtgaggagagaatgaggaatttccttatgagaaggccaggatctagttgaaggaagaaggcttagaagtgttctggaattaggtctaaaatggcaggtaattacaacaaaatgagaatttgagagcaaaatgggtagaggccagtagagctgtaggaagaaaatggcagcttggggaataacactgtttagacaattgatagatgagactgaattttgttgaggggcaaataataaccagaatgcaaaagactggttggatcagctggcttcaaaattcctggtctaggaaggctgaagtccttgtaggttttggagggcccctgtgtttagtagcctttgctcagtgctgatgtttcatgtgctgcttctgttcctccctctgctgttcattcaaatatattacacttggaaagtagttcttgtctcttcattccagcataaccttagggtccagtttttagaagtttgaatgtttacactgggttatcattattcactacagatgcatttccaagtatcacagtgaacagatgatcagctgattctttctacattagcatagaaaagagtccccaggtgtgagaatgggtcctggtaagggttgtatgatggactttcttattttcacagaggaggtattcagtaaaatgtttctgaagatgatcttgatcagaggatggggaggaggaagagaaagaaaataaagggggtaataaattaatgaagtggctaatgaccatcatgtggctgactcaatatacactcttatccatgtaccaaatttcactgaatctaagggacttttttttcacattttttacaataaatttttacaatagtttttttcacattttaatatttgtgaaatgttaatgacattacaattagaattggttatatcttttcttttgtgtcagtccatacaacactctcatggatttagcaaaatctgatgtgtgtttattttcattcttatttgcccctactatatctcacattttaaaaacgcttgttttctttgtgcttattttccttaagttctttaactctactcaaattcaacctgttccccgccttgtccttttttttttttttttttgagacagagtctcgctctgctacccaggctggagtgcagtggcgtgatctgggctcactgcaagctccgccttccgggttcacgccattctcctgcctcagcctcccaagtagctgggactacaggcgcatgccaccacgcctggctaattttttgtatttttagtagagacggggtttcaccgtgttagccaggatggtctcaatctcctgacctcgtgatctgcctgccttggcctcccaaagtgctgggattataggcgtgagccatcactcctggcctcccttgtactttttattgcaacttcatttttcttttggcttgtagttttcagaatattgttttttctccaaatcctcagctttaagaagatagaatataatacacattctctaggcctaactcttttgttaagtatcacatggctcttgggcaagcaattcaacctctttgggccataattttcttatatataaaatgaggggttaagtctaatgataccaatagtctctttctgttttgaaaatttggggtttcttgatcatcagagggctgaaaaatccctactctaagcctttgagaggaatcagggcagaggataaggatatagagaactctgcctcttttcttagactcattccttaaacctgcatattctacatattctctgatctacatattctctgacttttgttgctgccaagctactctggctcaaggtttttatgtctgggcatagacatctagcaacatcatcttcatttatatagatctactagataaaaaaatagcatatgtccctctcttcaagtttagtaaaaagagtcaatattttttataatacataatttggatttttaattttttcctgggaagttattgttttctgttgtctctagcacaaattgaagattaagtctcagaatggaaagtttagaagagactatttgctgtggattactgttatatgtatatgtatttgtatttgtatgtataaagtataccataaaataaggtagcttgctagaagtcagatcattagttatcaggtcacccagaaagtggggattgttttattgcctgttggaattgaaatggtgtttctgtagaacatattgtaatcagtattttttagcatggataaatactggaaaataaactcagttggaagtgaaaatagttgaactccaagttctttttatttgccaagtgatgactttgggctagctaaaatatctattaatttttaagggaaaattaatggtagtgtcaggtcttaattacagagtagatactacattagattatcactagaaaggacaaatgatccaagagaagttatgttagtggccctatatgtaaggaaactagctcggaaggaagctaatagttccttacgatttcctagggaaattgctttaaataatctgtagtttggtagatattcatatcccaaaagtcacttaatgacagcacaggttaagactacaacagtgctgcaaggaagtgtatatagttcatttaggggaataatttaatatgagggctagaatataaaacaaaatgtagagttaacaattgtctagcaaattcaagaatgttggtagggaagcactgacttaaccaatgacgtatacaattattagagagttactttggtcagttaaagcaaatgcaaaaataacaacaaaaactaatctttctcaagtatctattaacattctagatattctctattttaaatttcaagaagggcttagagatagggtgaacatgtaatttatcattcaaaccagggcaataagcataaactaagcttattcctggaaatcaagggtataaagttgctctagttaggtcttaccatgtgtctactctcatttctgattattgctaaaaatgttaagaaatgaactagttaacatgccaactgaagagaaagagacaaaaatctttctcagtaagcctctaatctgttgattctaaccttttggggagaactgatgtcttggaaagtgatgacatggactctctccaatagaagtgaattgaaaatgaaatatgagggattcatagacccctgaaaaccattcatgggcaagaatcttagcttaaagccagaaaaaagaaataggatatcaattttttattatggtaaaagagctacccacaagcaccaccactactcaaacacattttgatgaactgtaacataattaacatttcttattataaataattcaaatatatacaaaaatagaaagaatattataatgaaaccccatataactatcatgtgaactcaagattgcataagatttgtccatacttgtttcacctattcccttttttagttgtggttgtttctgaagcatttttaaacaaatcccagattcatataatttctcccctctatactttagcttagcagaatgtcattatcacaactaacaaaactgacactgattcttcagtatcatctgatactctattcatattcaaattttatcagttgtgtcaaaaatgttattttccattggatttacttgaattggtatccaaacaaatatcacgctttgccttttaatttttatagtccctctactgccataacctttctccctttttgaagcaaactggtgcagttgtgtcatattatggatttgattcttaatcccctatatttcttgtaaacaagaagtgagttgttaggcttgcttagattcagattagatttattttcctttttccaggaaaatttccatagatgatggtatatatttcataggttatgctctataaactgatattttaggaattgctgaatcagaaattagaatcttacgaccaaaagaaacaccaggactaattcttttttctcactttccaaaagtatctgtggtccatccaatgttctttcagccatcaaaatattaactattcatatgaaatatttataaaaagtgacgtcaactatatttccctttaatattcattttaaattattacagtgagcatgtacttttcattcttgtcccttctcttttctggtttcctttatcccattcttttaaaaacaagctatcagttcccatagcagcctttaccaaggtagataaatatcaacatcatggttgaaataccaaagctcagtgccagcaattatcctacaatttgtgtgttggcgtaataacacacagggacttgagcacattactaatagccattgaggggagcaagctagtctctaaacatattaaaatgcctcagaggactttttcagcactacataatcaagatttggtgatacgagctgctttgttaggacttgtgaattttgcattgccttattgtgtgtgtggaaattagtgccgaccttcataaattggcttagataatacacagatcaaccaacaggagacagaactagccaaataaagcatatggcaaatcactggaaaaagagcgtattatgtagtgacttttaatttggaaatgagaatgtaagaatatctccaatttaattggggcttgtctgaaaaatgcgttgatatctgtcatttcagaattgaaatgttttgatttgctgaagttttatttgctttgctgaggacaaggatactaccaggaatggggtctgacaaaaataaattattaagttgggttattcttatttttattctttttcaagatagtattggcaaaatctatcttgttattcttagcaacataaataagaagtattttgggggtaaagagcatattagaaagaagtttaaaaattttctgtcttttgttatatttgattttcaggaaaataaggtgaaaaaacatctattttcatacaatttctttggatttaattatacaaatagtcattaataaagtaagaataatgcatggtttactggataaaatttgaaggatttctgttaacactgaagccattctttaaacatgctggaatttggaagtcagattttcttcagcgtctttgataaacttgtgggttttttttttatcatgttgatttttaaagagtgtttttggatttgtatctccctttatttatagtttattgtgttaaaaccctcctaattgccactcctcatcctaaccctgggaaaaattcttgttattggttactcccattccttagggatattatataagcttttttacctactactccaagaaatctgcattatatgggcattattatgtattatattcaataaagaaattatagggcaaggcagctgccacatgaaaaatgacttgtttggtattgtctgtttttttagagaggggcatggaataaaattaaaaatatataaggctcataaagctttaatggtgtgtatatatattaatttctctcaaaaacaacatatgaaagtgtctatatgcacacaaacatatatacacacacatatatgtctacatacgtgtgtgtgtgtataaaaggagtgattccattgcaaggtggatctaattattagactatgtcctctcaaccgggcacagtggcttatgcctataatcccagcattttgggaggctgaggtgggcggatcacgaggtcaggacattgagatgaacctggccaatatgttgaaaccctgtctctactaaaacacaaaaattagctggttgtggtggtgcatgcctgtagtccgagctccctgggaggctgaagcaggagaattgcttgaacccgggaggctcaggttgcagtgagccaagatcgtgccacagcactccagcctggcaacagagtgagactccatctcaaaaaaaaaaaaaaaaggttttcaagacaagtaccatgtctctcaacctcttttttcaagaccaaatgtcttgcattttctcaactcaactttttttcctatgtcatcctttcaagacacttcaggtgagagagccaagatggccgaataggaacagctctggtctacagctcccagcgtgagtgacgcagaagacgggtgatttctgcatttctatctgaggcttaaaaaatggcgcaccaggagattatatcacacacctggctcagagggtcctacgcccacagaatctcactgattgctagcacagcagtctgagatcaaactgcaaggccgcagcgaggctgggggaggagcgcccgccattgcccaggcttgcttaggtaaacaaagcagccaggaagttctaactgggtggagcccaccacagctcaaggaggcctgcctgcctctgtaggctccacctctggggacagggcacagacaaacaaaaagacagcagtaacctctgcagacttacatgtccctgtctgacaggtttgaagagagcagtgattctcccagcacacagctggagatctgagaacgggcagactgcctcctcaagtgggtccctgacccctgacccccgagcagcctaactgggaggcaccccccagtaggggcagactgacacctcacacggccaggtactcctctgagacaaaacttccagaggaacgatcagacagcagcatttgcaattcatgaaaatctgctgttctgcagccaccgctgctgatacccagacaaacagggtctggagtggacctctagcaaactccaatagacctgcagctgagggtcctgtctgttagaagaaaaactaacaaacagaaaggacatccacaccaaaaacccatctgcacatcaccatcgtcaaagagcaaaagtggataaaaccacaaagatggggaaaaaacagagcagaaaaactggaaactctaaaaaacagagcgcctttcctcctccaaaggaatgcagttcctcaccagcaacggaacaaagctgaatggagaatgactttgacgagttgagagaagaaggcttcagatgatcaaactactccgagctacaggaggaaattcaaaccaaaggcaaagaagttaaaaactttgaaaaaaatttagacaaatgtataactagaataaccaatacagagaagtgcttaaaggagctgatggagctgaaaaccaaggctcgagaactacgtgaagaacacagaagcctcaggagctgatgcaatcaactggaagaaagggtatcagtgatggaagatgaaatgaatgaaaagaagtgagaagggaagtttagagaaaaaagaataaaaagaaacgaacaaagcctccaagaaatatgggactatgtgaaaagaccaaatctacatctgattggtgtacctgaaagtgatggggagaatggaaccaagttggaaaacactctgcagggtattatccgagagaacttccccaatctagtaaggcaggccaacattcagattcaggaaatacagagaatgccacaaagatactcctcgagaagagcaactccaagaaacataattgtgagattcaccaaagttgaaatgaaggaaaaaatgttaaaggcagccagagagaaaggtcgggttacccacaaagggaagcccatcagactaacagctgatctctcggcagaaactctacaagccagaagacagtggagggcaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcactaaacatggaaaggaacaaccggtaccagccactgcaaaaacatgccaaattgtaaagaccatcgagactaggaagaaactgcatcaactaatgagcaaaataaccagctaacatcataatgacaggatcaaattcacacataacaatattaactttaaatgtaaatggactaaatgctccaattaaaagacacagactggcaaattggataaagagtcaagacccatcagtgtgttgtattcaggaaacccatctcacatgcagagacacacataagctcaaaataaaaggatggaggaagatctaccaagcaaatgtaaaacaaaaaaggcaggggttgcaatcctagtctctgataaaacagactttaaaccaacaaagatcaaaagagacaaggaaggccattacataatggtaaagggatcaattcaacaagaagagctaactatcctaaatatatatgcacccaatacaggagcacccagattcataaagcaagtcctgagtgacctacaaagagacttagactcctacacaataataatgggagactttaacaccccactgtcaacattagacagatcaatgagacagaaagttaacaagaatacccaggaattgaactcagctctgcaccaagcggatctaatagacatctacagaactctccaccccaaatcaacagaatgtacatttttttcagcaccacaccacatgtattccaaaattgaccacatagttggatgtaaagctctcctcagcaaatttaaaagaacagaaattataacaaactgtctctcagaccacagtgcaatcaaactagaactcaggattaagaaactcactcaaaactgctcaactacatggaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaattcaggagctggttttttgaaaggatcaacacaattgatagaccgctagcaagactcataaagaagaaaagagagaagaatcaaatagatgcaataaaaaatgataaaggggatatcaccaccgatcccacagaaacacaaactaccatcagagaatactacaaacacctctacgcaaataaactagaaaatctagaagaaatggataaattcctcgacacatacaccctcccaagactaaaccaggaagaagttgaatctctgaatagaccaataacaggctctggaattgtggcaataatcaatagcttaccaaccaaaaagagtccaggaccagatggattcacagccgaattctaccagaggtacaaagaggaactggtaccattccttctgaaactattccaatcaatagaagaagagggaatcctccctaactcattttatgaggccagcatcatcctgataccaaagctgggcagagacatagccaaaaaagagaattttagaccaatatccttgatgaacattgatgcaaaaatcctcaataaaatactggcacaccgaatccagcagcacatcaaaaagcttatccaccatgatcaagtgggcttcatccctgggatgcaaggctggttcgatatacgcaaatcaataaatgtaatccagcatataaacagaacgaaagacaaaaaccacatgattatctcaatagatgcagaaaaggcctttgacaaaattcaacaacccttcatgctaaaaactctcaataaattaggtattgatgggatgtatctcaaaataataagagctactctatgacaaacccacagccaatatcatactgaatgggcaaaaactggaagcattccctttgaaaactggcacaagacagggatgccctctctcaccactcctattcaacatagtgttggaagttctggtcagggcaatcaggcaggagaaggaaataaagtgtattcaattaggaaaagaggaagtcaaattgtccctgtttgcagatgacatgattgtatatgtagaaaaccccattgtctcagcccaaaatctccttaagctgataagcaatttcagcaaagtctcaggatacaaaatcaatgtacaaaaatcacaagcattcttatacaccaataacagacaaacagagagccaaatcatgagtgaactcccattcacaattgcttcaaagagtataaaatacctaggaatccaacttacaagggatgtgaaggacctcttcaaggataactacaaaccagcgctcaatgaaataaaagaggatacaaacaaatggaagaacattccatgctcatggataggaagaatcaatatcgtgaaaggtaatttatagattcaatgccatccccatcaagctaccaatgactttctttacagaattggaaaaaactactttaaacttcatatggaaccaaaaaagagcccgcatcgccaagtcaatcctaagccaaacgaacaaagctggaggcatcatgctacctgacttcaaactatactacaaggctacagtaacccaaacggcatggtactggtacccaaacagagatatagaccaatggaacagaacagagccctcagaaataacgtcgcatatctgcaagtatctgatctttgacaaacctgagaaaaacaagcaatggggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacagacagcctacagaatgggagaaaattttcacaacctactcatctgacaaagggctaatatccagaatctacaatgaactcaaacaaatttacaagaaaaaaacaaccccatcaacaagtgggcgaaggacatgaacagacacttctcaaaagaagacatttatgcagccaaaaaacacatgaaaaaatgctcaccatcactggccatcagaaaaatgcaaatcaaaaccacagtgagataccatctcacatcagttagaatggcaatcattaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtgtatacccaaaggactgtaaatcatgctgctataaagacacatgcacgcgtatgtttattgcagcactatttgcaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactattgcaaggacaaaaaaccaaacaccgcatgttctcactcataggtgggaattgaacaatgagaacacatggacacaggaaggggaacatcacactctggggactgttgtggggtggggggaggggggagggatagcattaggagatatacctaatgctaaatgacgagtcaatgggtgcagcacaccagcatggcacatgtttacatatgtaactaacctgcacattgtgcacatgtaccctaaaacttaaagtataataataataaaataaaataaaataagacacttcattatgctattgtaattccttttaattactgcattttgacactattgtattaatgtagtactgagaccctaacatactaccaggtatggtctcattagaacattaagactattattttctgatatctgacatctgacatgttgtgctgttggtttttccattagtgcaggctaatggatgagataatttttagttgcaaaaccatagaatacttaacagtcacctaatctttatgtcttcttcttcatcatttctttctaacagaaaatactgtcggaccatgtcttcctcatcttatatgtgtttaattgagtctccaagacacattaattctagttcccaggtttacatacacgtgtcagaagagttacaattggctgggcttggtagctcacgcctgtagtgccagcactgtggaagtccctggctagctgatgatttgagatcagcatgactgacatggtgaaactgtgtctctactaaaaatacaaaaaaaaaattaactgggcatggtggcactgtggctcacgcctgtaatcccagcactttgggaggctgaggggggcggatcgtgagttcaggagagtaagaccatcctggccaacatggtgaaaccccgtctctactaaaaatacaaaaataagctaggcatggtggcacgcacctgtagtcccagctactcgggaggctgaggcagttgagaatcgcttgaacccaggaggcggaggttgcagtgatcacgccactgcactccagcgtggtgacagagtgagactccgtctcaaagcaaacaaacaaaaagatacacaaactcagaaaatggtttccaaaaagctagtttacttgatggtttaaaggtatggggagagtaactagtatttgaatagcttaaataaaaaatgttttgattaactaatgaaacatggtgggctgaagatcttatatcaaagaaaagggtggtggagaccattgttttatttattcattcatttattaagtatttatttgtcaccactttagtgccaggcattgtactcttaaaaaaaaagagagagtgagagagagagagagaaaagaaataggtagagaatctaatttaatccgaggtgtgggaggaggaggagaggattaaaatggaagaaggtaatgtcagcctcctgcaaattcttttctcactctgtaattcttccatatggaggaaaggaaagcagagtgctgaaaggatgaagtaaaatctgcagaattatttcaccattcagcattagatttattaaaaaagcatacaactgaaagttttctaggttgaattactaacttgccttcttagaagaatctggatacttagtttgcctgagggaacaaatatttggaaagggcttccaacttcaggctaagacaagtgagaggagttataagatcattcaatcagaattagtgtataagcaaatgtttagaaaatgctgagaatagttgatgaacagtgaatctttattagctgcttgtttacttttaaatctcagagtaattttaaatattaacattgcttaatgttcagcaatttccaaaaagttaataatttcattgaagtattgtttctttcaaaggtattcagatacatacatgggcatagtcatgcacgcacacactgacaacacagtctttgttcactttgttgccagttggcttttttatatggaatgtagctgggcagtggtgagaggcaggttatccactagtggacaagtgaccataatttaattttgaaaggactgaaaattaattgctgtgagtagcctataaataaaacgacactacttgagtacttgtttgagaataataataatatttgctctaagttttagccatctctttttcagcaatattttttcttcttccttaaactaattggttgtgcgaaaacatgtggttggtaccactgtaaagaaatatgtttgcataatataaatttaatctgaaattaactcttaagaaaatgaaatggaatttacttcacattaattgtgtttaggttagccaataattgtattagagaacattagtacttcaaaatactatcattttgaatgaattgctgtcatatttaacaacattttggagtacatgagttctgcctcatgagtacatcagaaaaaataatcagtaagttttaagtaagacttatttaaatttaaatactaatttaaatgagttacttaagtaagagttacatattgttttaaatacagtgaaatgtaagcaagaatctattcttaaatgaagtcattgttactataatacagagtttttgtcatataaagtttgtgaggagctgggggtaatgtagggtagaacgtggagcaagagtctgtgttggatattggaggccattagaggcctttgcatacttccaggcagggcaggggagaatatcaaaatgatgtttgaagaaaaaattctaattgatgtgttgtacatggggtactaaaggcttatcactgagtaagaaataacatttttggagttagagcaaatataatttccccttctagtttcttacgacagagaaggaaaataatttccttttcacagactatcttctctcctcttcctaaaaacaaaaacaaacaaacaaaaacaagtgtgatattttattgaccagcttacatctaggacaatcataccttttcttccattaccattatgcttgatttagttgggtaatagtcattcttctactctgtgaattgcagtaaatttcttggtagatttatgttaccttaagttgatttttttttcttgtgataatagtcataacaactttaataaaacatagcaatatacagattccctgtattttatcagataatttacttgcttttgcataattagtctgcaaagatttgcttctatttttgcagatggagaatttaagtctcagagaggcttgtaacttccttgtggtccctcagttgataagagacaggggcaggatttgaatgacaaagtatttgactcttcatgatactctaatactgtttaattgtaacctatcttttcttttacaagacacatgtatgtaatacacaaaatttacatccaagagatgtgaaagcatagatttttttctttctgaatccacattttaaatgaatggtgtggtacatgaggttctttcctacacttgggaaatgtatggcactaacgcggaaacatttctaagttagtttgtcacatggggattcaatcaggaataactgtgtgacctttaagaaaattaagattggctgtcagagggaaatttctatcctaccctatgggatagtcttacagagaaagagggtatcactttcaattctcaataaagaatggtaacttattaacctagaacatgtgtttattactgaatatagtcattttaataatgggagaatattctatgatatctttcctatttttaatgtctatttagaactttaatttatcacatacagaaaaacatgatctaaagccttcaaggatctggttcactacatgaatgagtttttaaaatttggagaaattcagaaatcaagaagtacatatataatgataggccaaaggatatcataatttagccacattcgtagttacttaaagacaccaaagaaatactgtaggagtttatgattttaatatcttttggaagatatatgcttaatgtgctttttaataggaaattttgaagcttttcctaaggttgaatataaaatattggttcaagaattatgattgtgcaatgcctaataaaaagaacattctgtgaaaaatgagtagatggtagaggaatgccacctagaagaactttgttagaaactagattagcaggtatctgactaggaccaaggatctcttccccaagtataaaggggccaagaaaattatctcaaagttctgaagattgacacaggcacatttagcccatttaggtcatgagtttgtaaagcttgtgtgtttgatgaagttcaacatttttagaaagctctagcagtttataaaagcaataaaacatttcacctttttaagcatctttgtaggaaaaaaaacttccatatactatcatgacaccgaccctctttgggatgacgttattgcattagtcgatcattatttctccttaaatataacccaggagataaagctgtgaagatagcatgttttataaaagctaaaagttattgtgaattcttctgaatcaataattgaaaagaaactgaagggaaaatttttatatagcagcagtttccaagttattacttttaggaaacttttatactttaaaaagttattgaggcccccaaacagctttactttatatgcattttataattaacattttttagtttagaaatgtttaaaatattaattcactaaaatactactagtctttacccaagaaaatcacaaagataattcacacaaaatttgtacacaaatgttcataatttttcataatagccaaaaaatggaaacaaaccaaaggcccatcagctgatcaatggataaatcaaatgcaatatatccatacaatggaattatttgcccataaaaatgaatgaagtactgatatttattacagtatggataaaccttgaaaacatcatgctaaaagaatacagacacaaaaggtaacatattgtatcattccatttacatgaaatgtccagaataggcaaatccatagaaacagaagtagattagttggtgccagggagtggggatagtggagaatggggattaactgtgtatgggtatagcgtttctttttgggatgttcaaaatatctagaattagatagtggtaatacttttgcaactttgtgaatatatttaaaactgctgaattgtatattttttactttatttttttaaaggtcatcttggcttcagatgaattctgtactttacaatggtgaattttatggtatgtgagttatatctcaattaaaaatataataagcagccaggcgcagtggcttatgcctgtaatcccagcactttgggaggacaaggcgggcggatcacaaggtcaggagttagagaccagcctgaccaaaatggtgaaaccctgtctctcctaaaaatacaaaaattagccgggcgcggtgatgtgtgcttgtaatcccagctactcaggaggctgaggcaggagaattgcttgaacccaggaggcggaggttgcagtgagctgagatcccaccacagcactccagccttggcgacagagcagactccctctcaaaaaaaaaaaaaaaaaagaaaagaaaaatataataagcacattatattttatcctaaattatatatttttatgaaaaacaaatgtgtattccaaagaaaaatattaatgagtagcattgctttacattttctacatacctttttgctgtttggcttcatgagaataattggattctatgtttgcttctacattcaatttattgtaatatattgttttggttgaattatataagaaattctcgccataggcacatatatagttagaaaagagaggagtatcgtaataaattattcagataattatagatatttttctttgatattgtgacaaaatttgttgtgtgatgattcttaaaggttagttgaatgtagaatttcaaatctccaaatagtgctgacttgactgcagttattcaaaggttagactgggctaggaagttgaagatgactgactcacgtggctggcagttggagttgactgtctgctggatggtcagtgttttccttggttatgacctctccatgtgacctgggcttcttacagcctgatgggtggattccaaaatgaaatgttccgtgagaaagtgagaaagttgaagctaagccatcaatgttttaaaggcttgtattcggccattcttggattgctttaaataccggagactgggtaatttaaaaataaaagaggtttaattggctcatggttctgtaggctttgtgggaagcgtggtgctggcactcaacttctagggaggcctcaagaagcttacaatcatggtggaaggcaaaggaggagcaggcgtatcacatggtgaaatggagcaagcaagagagagaagtgtgagggttgctacacacttttaaatgaccagatcacgtgagaactcacaatcacaaagacagcaccaggccatgagggatctgctcccatgttccaaacacttcccactaggccccacctctaacactgggcattacaattcaccatgagatttgggtggggacagatattcaatgtatattgaagcccagcctcagaaatcacagtgtcatgttccctacatcatactggacacaactgtagggtcagcccatatttgaggacagtagaaatagaccctgcttcttgatgggaagagtggcaaataatttgcagctagttccatgatacaaccttttctgacattttgaatgccataggcatgtgggagcttgggatatactatgattaagtattatttttatactattgcaacttctgctttgaaatgaacatcttaactggatgcttttgtttgaattatttaaaatttattgtcaaatgcaataaatttagtgcaatgagaactaagagtgcctcatggcttttgattacctgcccttccttttacatttgtgacattattgttcagtttttaaattatcgttgataattacttaagaacaatttttttcaatatggtataaaaaatggaatattaagtgtccactccaatatcagtctgttgttcttagaatgaacatctccacttcctgtcaatgtttattctccaagagtgccttggttttgcacttacaggttatctatcagcaatagttataagaagatatgctagagattaattcatgtatttacttaattacaatctcctttggaagaaattaaacccacaaaacatgaaataaaaatttgttttttaatgtggagacaaaagggagagcacacaatttttttttttatttttagtagagatggggtttcaccatgttggccaggctgctctcaaactcctgacctcaggtgatctgcctaccttggcataccaaagtgctgggattacaggaatgagccaccatgcccagccatacaaaagagaagaattttttaaaactggctacagtcttcaaattgcttttcctgtatcccaaacttaaagtgctgataaaatgccttttaagttttctgttagtttctccaggaaaggtggtatctgacataggcccaggttggaaatgcttacatgttattaagcatttatgtaatttgggaatttttatcattgtcaaagcatgctagaagcatcattctttcagctgcccttagaagttgcttctagaaatctgctttaaaattgccatgtgaaaggcttatttctgctgtataaaaaataaagctttctttccattgcaaaatggcagtgtctgtagattgttagtagaggtgttgggttggacatgactgctgttactgatcaggataggtaatgcactgtgctttcttaaaagagcaatattagaaaactgcagcttgattgacagctcagcatactgaaaatcttaatgctaaatttgtttaaaaatatttggtggaaagacattataaaacttaaaactcagggttcaaaatttctccagaatatttttgtctactctaagtatttgtagtaccaaagcataattggtcaccattgccatttgaaacagcaaattaccttagtgtggtataatggtgtccctctgaaaccctctggatattttagccacatctgaaaactcagcatgtggattttaaatattcttgagaggaagatagaattctgaggcataattttagctgaatttgtattggtaactaaactctcattaagatgggttgccagattagatctgagctagggtgtagctgccacacctttgtaccgtgtgtagcacaaagaggtgcagcccttgtgatcacagagtgttctaaattgcataatactttctaaaggcctgtagcaatctcagtgcatttcttaaattctatgagtgccccccatttactttgattttatgttggcctaactagatggtttgtttctctgtttagttttggttgctggtttattttggagagttcacacttcactgggaaagttttaagttttcttgtatagaaataacttggtaatgttacattattagacattattataacaaactcttgattatatggcatcagataagcttgtttatggattgattgtaaaaactctgaaaaatgtaaattcttagaagtcatcaaaaaataaacacattaaaataaatctgttatttggaactctatagtaaccaacaaagcccagattctctctattgcacagttggcacactctttccccctcagaaaggaaagaaaaaaatacaggtttagtatctcttatctggaatgcttggaaccagagtgtttcagatttgggattttttctgattttggaatatctggttatacataatgagatatcttggggatgagacccaagtctaaacacttaattcatctctattttatacatactttgtaaccataacttgaaggtaattttatacaatattttaaataattttgtgcatgaaacaatatattgaaccatcagaaagcaagggcgtcaggcatcgaattttccacttgtgatgtcatgttggtcacaacaaaaagtttcgaattttggagcatttcagatttttagatttttggattagggctgcttaacctgtatattggaaaggaaccctattcagttattttgtagtgttaacttttgagttaataagtctcctctattaggatgatttcttttaacttgatcataagcatgcctcttaaatggagagtaaaaaacaataaaaaaaactaaacttagaaaaaaaaaaaacttgaggacttttcttcctccctttttcctccatctccagtccctcactttatgggaaggttgtatcatggtttttgggtatggataactttattaacccaccattggtagaatatgcactggagtggtaatagattgtgttgagaccattaacaattatattttctcattcagtccctctcccacaactaccagtgatagttgttgatgtgattagtgacctctatggtcctgctacagttatgtatatctttgtacaaagctgactgtatactgggatggaactttgggatagtgactttgttattatcttgtcactgatgttagaaatagggacagactctgcagccaaaaaaaaaaaaaagtgaaacacaattctgtagaaatggaattttctacacaggaacactgttaggaggtttttcttatatgttcactagcattttgggagtcaattcattatttttgtagaacaggagcgtgaaccacagagggaagaaaaataaacccaattgattccaagaatttaaaaattactatcaacattataatagttttaaaaattgcatagctattctgatgtcttctagcaattaatgccaccaaacttatgggagaagtctttttttctctctcagaagtatgctgtttttagcatttctgtgctttagtttttcattagtttcaagtactttttcctctttataaagtatgctgttttacatgagcttttctataaaaataaacataagcaaaaactacaatgggtttttgttataatagctggctattctactcatattctctctaagattcttgagttgctttaagccaacaaccgaaatccattattagaatgttccccctgccaggtttttattactaatacattgtttatttttaatcatcttttgaattattgactattttatggtgtctcataatagcaatttctatttgttttatgtacttcatagagtagattttgtttttctgcctcactccattatatataatggcttagctttgaaatctttgcttgatatagaggatgttaatttgctttaacacattactatctaaaatagctcaggttttgtatggtcttgtaaaagctttatctcgaaatgctctgaaagatgctttattttttactctctatttaaaaaagaagtttaaatttcctcctgatattcttgtctcatgccaggatattaagcagatgctcagattggctcagctaggtgatattaaaatgtatagattcagatttcaaagcaattaataactttcactctgacattattcttccaatattttattcctactccatgacctaagtcttctaacggttgttttgctacttaatctctagctaattatttcttttctcctcatcctgactgcattgagtgataggtctgttttctgtaggcttgcctgcatttcttaactgaacccctagagtactgtgtcctatcctactctcttcaattcttccccaatgaggcatgaccaagagattgttgtatccttaagaggcaaattcttagaatggagtggcagatggatatataagaatcaccagtgcagtgataatggaaattcaacttcaattagattttaaagttggttgcctccaaaaagtctagaagtgaattgaatagagctatttgccctattaggattttgttccttgctaccaagttgtcaggggaggtgattacaaaattggaggaatccatgattaggaaatgatgatgatgatgatgatgatgatgatgatcatggtgatgatgatcattgcagcctacgtttatcaaaacttattatatatttggcactgagttaattaagccttttatgcactattttgagcatctgttggttgtgcttaatattaataaactagttttctattactatgtaataaattaccacaaacttaggggcttaatacaacccacattcattatcttagtttctgtgggtcagaagtctgggcacaactcagttgagtcttctgtttaggttcccacaaggctgcaatcaaggtttgagccagggctagattctcatttacaggctcaacttagaaaggatctgctttcttggtcttctggtttttggcagtattaagtttcttgtgattgttggactgagagctttattttttgttgactgctagccagaggctaccctcggctcttagagatcaccctcagttccttgacatgtggcattttccagcatggctgcttggttcctcccagccatccctgggagagagaaatattcctgaaggacagatgttacaatcttatataatgtaatcatgtacactgatcatcaacaatctatcatcttttccatattctattgcttagaaataagtcataggtcccacccctacttaagaggaaaggattatacaaggtgtgaccacagggaggtaggaatcaggggcattaccttagataaggtacaccctacaaggtagggtgtaccttgtacaccaccaagagattgctatttgtcttccaatatctttccttcttcttccccacctgagaaatagaactactaattcattattagttaaatatatggtcacctggaatacagagtttattccctagtttccctcgtagctaggtatggccattgtgagtaagtgtggcagaggagtaagataaaagagtctaggactctgaggattttgtgaagttactctatcagttttttgaagattctttactcctgacttctttcaggtgagagaaaaataaacttttattttgcttaagccattgttatttttggctgtcccttgtaggacacctcctttagaccctcctctgctggccagccccagaacagggtgtcttatcctggtcctgcccaagtgtgatcaccctgtgggacaggagctggtctcttcagcccagcctctccatgaggaaaagttcacttcttaacaccatgggaggtgaacccaatcttaactttgttcttttctgtcatctcttctcccctttcctcttttcaagagcccttcatttccattttgtagtgtgtgtgtttttcaaggaacttgaaatcaccccaggtccaggtttaaaccaaccaggacattctgttctctgactcagtggtgaaagcatgacatatgccagtctaatcagagtgaatcttaaaacatttactgagaaatcgtggcaatacttgtatgtagtgatagttctgagtaaccatattttccatgccagccgccaattctgtcctaaggagaaacagactttacctgacccttgagcctgttgcttgacagagatggctcatgggacatataaacaacccagctacttccttatattaaccaatatttagggggtagtctaggggaagcttccacaccagccctgaggttagaaatagcatgtaagggaggactcagagaattgctctgtctccttgactgcaacagtattagtcatggctgactcaggtagaactgggggactctattcagtacagatcttagagaccattgtgtgagtactaagatttggtgtccctgtgcttgtggattcatgcagatgtcacaggatattggaatgctaaagtgattcatcccgttcaagtaacagatccttcctaaattgtctatcagtctccacacctataatcttgaatttattattactttaaaaaattacaaaagtaacccttgctcactgtagtaaattgaacaatacaaaggtgtggcctctgtgtaaaacagatgcttgctttctcaggaagtcttctgcccttcagtgttcctttcacatactccttttagccttacattgataaaatgtttactttttaaaaactaacattgattcaatgcttctcatagtctgtttgtttgtttttgtttttgagacagagtcttgctgtgtcacccaggctgctggagtacagtggcatgatcgcagcttactgcagccttgttctcctgggctaaggtgaacctcccacctcagcctcccaggttgctgggactataggcgcatgccactatgcctggctaatttctgcatttttggtagagacagggtctcactatgttgcccagtctggtcttgaactcctgggctcaagtgatctaccagccttgcctcccaaagtggtgggattacaggtgtgtgccaccatgcctgactctgcttttcctgttcaatatttcaatgattacagggttttaaaatatttttgacctaaacaaataataatttattaattccaaaatagataaagttgtcagcattctggagataaaatcaaagtaaggattcactagtttttccccagtaggaacttaacagttaagttagggcatgaaacgtttaaataagtcaaacagtgagggagaaggtgctaatcatgcactaaagaaagtgaaaaggaaagtgcatctgtttttggtttggcagttaccaccacagctgttttctagtgctgtatgtataaaaagagaaggcaatgatttggaatggtcattacctgggtaacaaaataatctgtacaccaaacccctgtgacgtgcagtttacctatacagcaaatctgcacatatacttctcaacctaaaatgaaagttaaaaaaattaaaagatagatacatagtataaaaaagaagtttcttaaaggagagatgggactgaagttgggtcttacaccaaacaagggaggacagagagaattggggctgctttaagaatcttggcccaaaacagagcagctgtcctcagacctacctgagcacccaggccacagccaacctcagatcaaaagggatggaatctcaggagactgaccaaggtagctgtatttttttttttttttttttgagatggagttttgcttttgctgcccaggctggagtgcaatggcacaatttcggctcaccacaacctctgcctcctgggttcaggcaattctcctgcctcagcctcccaagtaactgggattagaggcatgtgccaccacacctggctaattttgtatttttagtatacacagggtttctccatgttggtcagcctggtctcgaactcccgacctcagttgatccacccgcctcagcctcccagagtgctgggattacaggcgtgagccactgcgcccagctggtagctgtatttttaacatgctctttagataatttcgtctgaagactggcatttaggagtttctaaagcaggtgtgtcttgttattaaataagcacagctgcttgaaaattagtttgggaacataatttatgactaaaagtctttccaaaaaatcaaacaaatggtcatgttcatattagttgatatatttgttattccttaaagacatggttttgtacatgagttgctattctcttaattcttaagattctgtggaatcatttatttgtacaagttgtaccaaaaaggaaaacaagagtccacagaaataacttttttatcattgattgattcattctccatttatttgtttattcctctgacaaatattagataagactagagtcaaaaaggatagaaattagaacaggacattcatccagtcctagggaattttagtagagattatgtgaattaaacacaaattaatgtaaggaaaagtgccagagaagggagggattacttttagctgtgggaatttgagaatccttttagaaacattttgagcttgagatttggacataaatgtgtgtaaaatttgagtatttggacacaggtaaaagatgttccagacagaagatacagtgttaacaaaagcctctgcatgggaaatccgtggcttcccaatagaggaggttgtgctctttgttttgccttaagtgcaagatgtgtggtgaatgagagtgatatgagtttgcaaatttgataagtattatgtatttgccataaaaaagttgaaactgtggctcatgttttcatgatcaacaagttgaaaatcttgaagggcagaaagtagtagcagtagtgagctgccacctttatatgccttcacatttgtccacaccctgttaacattccacatgtaagtactgaaaaagtactgcactgactgtttctgcagaaagcaccacttaataccctgaataaagcttgtctctcatattttaggaatgtacttttaatgcttaagaattactttatttttctccttacctattacgtatcttaggttggattccctagaaatagaccctaaaatggcaatttttaggcaagtggttcactaaaggagtgctctcaagagagtcctgtaagacagtgaggaaagcagaatagcacagggaggaaagctaagcaaaggtgtagttttccctgaagtctagccttcatctgattccaatgggagctgtgaagcacgaatagcatctcagaattgtaggacctacaggcatcttgtattcttcccttttatcactcattcattgcctaaagctatccctggagggagggcataacctcccaacttttcccagaaaggcaactgaagacaattctctgtagaagggtacagctcttactagccaacactcatacagctagaagatgaagcactacaggtaaagggcagtggttctcacctgggggtaattttgtccttgggagacacttaccaatgtctgaagatatttttaattaatgtgactcggggttgggtggaggtggtgttgccactggcagctagtgggtagaggccaaggatgctgctgaacatatgcagaagaacttttctacaacaaagaattatgcagtccaattgtcagtagtgctaaggttgagaaaccctgggtaaagggagtctgagtaggacatcaacagtgactgctgcacctttctttttatgtatgccctgggctatatttgtaaactgcagtagcaggagccattcttaagtattgaccagatcaggtgaaaaaaactaaaagctcattcattcattcatgctttttgttttgttttgttttgagatggagtctcactcttgtcgcccaggctggagtgcagaggtgtgatctcggctcactgcaacctccgcctcccaggttcaaacgattctcctgccttagcctcttgagtagctgggattacaggtgcctgccaccacgcccagctaatttttgtacttttagtagagatggggttttgccatgttagtgaggctggtcttgaactcctgacctcaggtgatccgcctgccttggcctcccaaagtgctgggattacaggcatgagccacagcgcctggcctcattcatgcatttattcaggagatgtttcattaggtaattaaagaacacctgctatgtgccaggcactaggctaagcagtggggatacagagagatagtatccgctcttgggaagctcagaaaattaagaactaagagacatcataacccagtgactttgtcaagtttaaaagagagaatatatattaacacaatttgtacaaacttaaacataaatattcaatcatttacccaacaaatattattgagcacctactagataccatatgctattctaggcactggagatatagcagtgaacaatagggaaaaagtctttgccatcaagtagtatataatccaatgggagaaacagctaacaaacactcaaataaatatgtaataacaatttagataaagataagtgctttgaagaactcagaagaaaaaagtagaatagagagtgaattgaggcaggggctgtgggtgccttatattagtaagaatgatcagaaaaagcctctttaaagagatgacagttcaggtgagaccttaatgacgagaaggagttagccatgtgaagatctgggggaaaaagatctatttcaagaagatgcttggcttcatggagaaaccaaaactgttgctagatgtgcgggctggggagtggtaaggtgtgagttcagagaggtgagcagggactgcatcgtggaagcccactagaccactgtaaagagtgtggactttattcttattgcagtgggaagccattggaggtttttaaggcagcattttggcagatgtgtgatagtccagcaaagagatccaatggaggaaaatgatcaccaagaaggacattatgtgcttgccagctgagtctttgacccttcccaaagtgcattatagagtgtctttccattttatttcataactcactttcctaggtaaaatatctgccattggaagagtatgaaaatatagacataaatttaacattacaccttttccagcagcattgcattatttcaaaaatggtgaatgaatattaggtttgagttttaaagggcagtgaatcatttgttatgcccaagtcccaaatcgggacacatcactagaaagaggaagcccatcagattaatgaggaaagttagatattaggtacctaaactgtatttggtgtagtgtttcaaccaaaccaaatcacttttaacctttttatgtatgtaagtcctcattttgacagatgtagcagcataggctgaacaattattgaataatgtatttctagttagtttgggtgtatgcatgtgtgtgtgttcatgcatgtgtgtgtgttcatgcatgtgtgtatagcacagtgactagaggattgaatttctgttaggggataaataaaaagcctactagatgaatagtttgtagaatgatttttgagagctgcttggaacccagagtttacagcctaattacaatcttctgacagacctttagtgagcagtaatcatgaggataggcttgacttgagtttgaatggtactgttgtttattctgctgttcacagagagcagcatataaaatggattattttgtgtgttagtattcttttatgtgttagtagctaatgacatttttgatacattaataggaagcttgccagaagcccaaaggagcttgaatattttgtaggcaagtaatttatttaaaaattagctacggcataacgtgtatatcatagaagcaaacaacattattccactagtaaagagtaggcattgagatgctcttttgatagaatccttttttaagaagtattttcagagctcataaattataaatttggcaaatatggagctcttttaagttgatttttaaagtgaaccatatgtttagcaggatttctaattgctgtaaatgtccattgatgaataaaaatgagtaagcaagttttcttttttaccatacctggcaattttattaatgtcttacctaactgtaaactcaatagtagctgtttctgacacagaagtgtcagaaacactacttctgtgtcagaaacagccagtcagtggcttcccactgactcatcatccaacttagtaattatcaattcatggccaatgtatatacccatgcaatttcacccttaactatatttttgaagcaaatcccagaaattatatcacttagttcataaattaatagaacctctaaaagataagaattgggtttgtgtgtgcacgtgtgtgtttttactatcacaataccatttaaattcagcttggaaacactctttattactcttggggaagttaggaaaacgacttgtacttctttccatgaaggtttaactgctgccagaatttctttcctgtaataaaaaactagaaaatcaaacacaaaatatgtaacaactgttttcagatagcagacaacaggcaatgtaggactgtgagacctgagaggagggaaatcaataaggccggcccaacaattgtcccagcttcctctctgaggctgatttcaggccaaggggcaggaaggagaactgaaacagagcccagccaactcactgaattgaggaggcggagactggagttaggggaaacccactgggatttgcaagacagaatatcattaggaggggactgtgtgggggggctggggggagtggtaatacctggtgctaccattctgtaccttgctctttttaacttaacaatgtatttatttattatttaaatgttatttgtagagtttccaatatgtgcccaccctgttctagatgttgtggatgcagcctgccttctgatgtattgtcatctcacaagcagtagttccagatttcagtccaactaggaagacactgtgcgactgagtctagcactaagtttactctatagaggataaaacttttattgcacatgttactgtctcctagaacattagctttcaatattcaagaattgtagaaactcattaggtatgctgagctctggtcccaagtcagaacagaattttgaggtactattcttggcctgtcaattactcaggctgattctacttgcacatcaatagagtagtttcataatctactgtgattcaatctgttggaatcgtctatctatatggaaacctagctagaaggacatgtaaataaccatgcattttctcatcataaagccaggaccatgcttattgtagtttcagttgcagaactattttgcagccatgcccatagactatgagtcagtttgaacaaattatcatatttataagcttgctataattaatacttaggatacaatgaccttgggaaaattcgatatcatctgctacatgtgaagatatgaatatctaaagattcagcaattctatccctagatgtgtacccaacatatttatatgtgtgcatgtgcatttagagacatgtacaagaagttcatggctgcattattcataatagctcaaaacttaaaactacccaagtgtccatcagcaacaaatacataaatatattttggtaaatcatgtaatggaacagtacacagcagtgaaaatgaagaaactacgtgtatacataacttatgtgaatcacacaaatgtaatgtttgcgtgaaagaagccacacatgaaaatatgcatggtgggtgattccatttgagtaaagttcaaatacaggcaacattaaagtatagcttgaagagatgcaaatttaggtaaactattaagcaaagcaagtaaataattaccgtaaaaatggggattggaattacttttggtcaaagattgtaattacaaagcagtgtgtgctgcacttccgggagtgcttgcagtgttctttgccttcacctgggtggtggtgtaaaagtattcattctaaaataattgatagttttatatacctatacacatatttcattttattgtccttcactttattatacttcacagttactatacttgttgcaaattcaaggctgatggcaaccctgcatcaagtaagtctattggtgccattttctgaacagtatgtctttccttgtgtctttctgtcacattttggtaattctcacaatatttcaaactttttcattattattatatctcttatggtgatctgtggttagtgatctttaatgttactattgtaactgttacaaattgccgtgaactgagcacatataagatggcaaacttaatcaataaatgtgtgtgtttcttcttactgctccactgactggctgtttccccatctctgtccctttcctctggcttccctcttccctgagacacaacaatattaaaattaggccaattaataaccctgcaatggcctctagatgttcaaataaaaggaagagtcctatgtctctcacttaaaatcaaaagctagacatgattaaccttagtgagaaagccatgtcaaaagccaagataggccgaaagtgaggcctcttgtgccatacagttagccaagttgggaatgcaaaagaaaatttcttgaaggaaattaaatgtgctactccagtgaacacatgaatgataagaaaggaaaacagctttactgctaatgtggagaaagtttgagtggtctggaaagaagaccactagccacaacattcccttaagctgaagcctaatacagcataaagctacaactcttcagttctagaaaggcagagagaggtgaggaagttgcagaagaaaagttggaagctagcagaggttggttcctgaggtttatggaaagaagccatttccataacataaaagcacaaggtaaagcagccagtgtcgttgtagaaactgctgcaagttatcaagaagatctagctaagaccactgatgaaggccactaacactaaacaacaggttttcagtgaagatgagctagccttctattggaagaagctgccatctaggactttcatagagaggggaagtcaatgcctgccttcaaagcttcaaaggacaggctgactttcttgttaggggctaatgcagtgggtagctttcagtttaagtcagtgctcatttaccattctgaatatcctagtgctaataagaattatgcttactctacccttcctgtgctctgtaaatggaagaatgaagcctggatgatagcacatctgtttacagcaggttttctgcatattttaagtcctctattgagacctactcctgagaaagaaagattattttcaaaatattactgctcattgacaatgcacctagtcacccaagaactttgatggagatgtgcgagaagattaatgctgttttcacacctgctaatacaacatccattctgcagtctatgtatcaaggagtaatttctagtcttcgtatataagaagtgcatttttctggctgggtgtggtggctcacgcctgtaatcccagcactttgggaggctgaggcggctggatcacctgaggtcaggagttcgagaccagcctggccaacatggtgaaactccatctctactaaaaatacaaaaattagctggatgtggtggtgggtgtctgtaatcctagctactcaggaggctgaggcaggagaatcacttgaacccgggaggcggaggttgcagtgacccaagattgcgccattgcactccagcctgggtgacaagagcaaaactccacctcaaaaaaaaaaaaaaagaagtgaatttttcttaagactactgctgccatagatagtgtttcctctgatggatctgagcaaagtcaattgaaaactttgtagagaaaggagtcaccattctagataagaacatttgtgactcatgggaggaggtctgagtatcaacatgaacaggaatttggaagacattaattccaacccttatggatgactttgaagagctcaagatttcaggggagaaagtcactgaagatatggtggaaatagcaggagaactagaactagaagtgtatcctgaagatgtgactgaattgctgtaatattatgataaaacgtacatggatgaagagttgctccttatggataagcaaagaaagtggtttcttgagatagaatctactcctggtgaagatgctgtgaacattgttgaaataacaataaagtatttaaaatattatataaacttagttgataaaacagtcgcagggtttgagaggactctagttttgaaagaagttttacagtgggtgaaatgctatcaaacagcatcacatactacagagataccttctgtgaaaggaggagtcaattaatacagacaatttcattgttgtcttattttaagaaattgccacagccaccccagcctgaaattgatgcaagaccctccacctgcaataagattatgagttgccgaagtctcagacatttattggcatttttagcaataaagtattttttaattgagatatatacatattttaaagatataaggcatattgcatgcctaatatacctcaatgtagtataaacgttaacttttatatgtactgggaaaccagaaacgtgacccactttattggcatattctctttatgggtgaggagttgcttcttatggatgagcaaaaaagggtagtttcttgagatagaatctactctttgtgaagatgctgtgaacattgttgaaataacaacaaaatatttagaatattatatacacttagttgataaagcagtggtagggtttgagaggacttttggtggtctagaaccgaacctgcaatgtctctgaggtatgcctgtacatgggaattattttttaaataaaacttaaaaacaaaccctgaccataactacttaacctgggaattttctgaatattaatatttgcaaagtacctttcagtgtagaagggataagattacttgtggaatcctctgaacagaaagaagaggcatctgacccaagatttaatttcttacatagtgaaggacttccttttgatatatacagagaaagaccagttaattgagattctcgtattctaaatttcacattttttttctgtgttagactcctgtatttattccaagaagctcgatagaataatttaggattgtaatgtcacatgcaggtgcaatgtgacatttctgagtcatgccttggagctgacagtacaacttttccccacccccatccatagctttttacctgtttctaaggttttctaaatcataaagatgaggctactgatagtttgagtgaggcttatcaaatcctgtagcttattacatggaagagatggatttcacctagaagtaaaactttcgtttactgataatgataacagctaatgtctgttacaacatcgctacctcagagattttattatgtatcacacattcttttatgtgcatacttgcattagctcatgtgaatctcacaactattcacaagtattatttccattttagtagtgaggaaactgagacccagaggagtgccttgaaaatagatgtgtttgactccaaagcccatgctctttattgctgggatactttataatgctttcgtttagttcagggtcgcaaaagaaacaaagctcttgggtttttgttgttgttgttgttgtcgttaatggtacatttatttcaagtggaaactttagaaaattgacaagcttttcactcatgtctcactgatgtcttccatgtgcctttgagtcttccttggccagtcacttatgtttttaagtaggattcagaatcagaggtggtcacaccacctacctcaaaggctgattcagcttcggactacatttttggactaatgtttaagactcagctgggccaggctcagagtccatcctgtgttttccacatctgatttcttacatagtgaaggacttgcttttgatatatacctagaagcagccattgaataaaagaccttggatgtaatgcaagagaatggggcaagcagaggaaatagttgaaagtttgtagtgagccatcattgtcacattagacctttgtttaaaaaatgtatccattgttaatatttctacttttacctaaagttaggtgacagttataaggaaaagctgtggccgtcttaataatagctaagatatattgagcacttagtatgttccaagaactgttacaagactttttacctattaatgtagttaacactcgccacgatcctatcaggtatgtattcttaattctcctcattttcagaaatggagttggaagcacagagcagttcctaatttacctgagatcacacacctagtaggtggtagacttaggagttactcaggaaggctaattctagaacccacacatttaaccactatgtcatgctgcctcttcttgagttgaagaaagatttgcatgtgaatatactttatatttttaaaaaaatgaaaggtgccatggcatctcaggtgggaaaaaataaagaaaaaataaaaaatgaaaggatatcaagtgttggtggcatattgaatcctttgatttatttcaacataaactatctgcactggtagaaagacatttatagtttggtcgccttataggttataaggcaataaacctcatactgtaagtttataagactgccaagcattttccaaactcctttcatgtctatgaaccactgaacaacaaagatcaagtatgaaaaaatgttcttttgaatttccctaaagcaagaacatactgaaatgaatggtgaatagttggttccttgtcattccttgatcaaataatgaccttcgtgtctattgattctcacttttcttttgaaaatagagtgtttttattctaccaatgatttaaactagaaaattattattgctgtccccttaaagcattacattttttttaactaaaatgtcttgatgttattgatttaacctgtttccctcttttgaaatagctgtgtagtcctcttaatgtatacaacatagatttctggaaagcaattcatatatacttataaaatatgaattctattttaattcagatcttttatgcataactactgtgaaatctgtaagttctcttgatttcctttctttggattaaatctttttcttataaaaatgtagaaaacaaattttacctttattaggatagatagaactatgtacagaaagtacagtatatagttttctgttgctatataattactacagaattactgtcttaaaacaacatgcatttattatctcaaagttctgtagatcagaagtgtagctggcttctctgctcagagtttcacaagactgaaatctagatatcatcatgctgggcttttatctggagtctctggagaaaaatctgcttccaggagcattcagattattggcagaattgagttccttgtggttgttggactgtactccctgttttcttgctgactgtcagcagagagccgcctttagcgtcatgcagccctctccatcttcaaaggcagcaatgacttattaaatcctttttaggcttggatattctctgacttcactttcactcacattcaaagggaggatgttataaaagagtgaaaatcattggaagtcattcttagaattctgcctaccacagagaggtagcaaagtatttatgagtttggtacttccttgagatttgatattgacaaagcctgaaataggcgacttgctttacatgagtgattttaatgtccttatacctattgatttttcaaagggagtacagcacttttaaatttattattattcttgcttatgttagaattcagacttggaagtgttttttttgttgttgttttttttttagacggagtttcactctgtcaccaggctgcagtgcagtggcgcgatcttggctcactgcaacctccgcctgccaggttcaaatgattctgtttcagcctcttgagtagctgggattacaggcgcgcgccaccatgcctggttaattttttgtatctttagtagagatggggtttcaccatgttggccaggctgctcttgaactcctaacctcatgacccacccgcctcggactccccaagtgctgggactacaggtgtgagccaccgtgcctggccggaagttatttttaaagtggtgaaagtataaaattattttgcattcactgaaagattgttaaacattcgtaaagaaggtggtcttctaaccctgattccaaagttccttcctctgatgtcagtggagaggtggagccacttactatggcttatatttatggtaaaggcagaacatgttgagaatgaactgaatttcacagagaacttatcttttcaattttcttgctttagggtcacatagctttgctatgcggcattttttcaatgaaactgaccaccagccatttcttataggaaatgcacaaggcctcaggcagcaagcaacagctgaggggatcagcggatcttttaatctgcctgacgctggccgtagagtccttgcaagcatccaccacgccccagagagcttgttttctgaggtggtagaagggccacatccacagtattcacatcccttagatcctctctctgggaagccacagtggtgataaatgtcgagaagagcagttattctcagggtatatgacctcacagccaccacagctcatctctgctttatttggctttcattcattgaagagacagattttgagcaggaagtacatcttgcaagtactgtctaattactgattaccctctttctgactccaccatgtgagaagcccttcagctgacccgtttcctttataactagtacttaatatgcatcagatttgtgcctttttaagttttatagtcttccagttctgcatagttccaaatatgtctctttagtgaatcaagcctccctgacaccactccctgtgtcttccaacccacagcccccaatgcatttaaaggtacattcagcagaacaaaatttcccaatagagtcatacagtggcttattcatagtgcacactgggggtcttctaatgaaggatagagggcacttgtgtcatggtatcttctatgattcttttgtgtcaaattcaacatctacattagtgcccccttgaaataccatgacctcttagctctacaagtctagtcttttatcatttaccagaatgaacacattttgagtgtctttattattctgtaccactttatttccatgataaagaaatgagaaccccttctttatgtctgagacctttccattctcttactacttacgaatgcaaactttcatgtcatcatacttttcaggtaagaaaatttccattatttctaatagaattgatgtctagattattttaatcatgactacctatccttggacactttatgtttatcagagctctctttcaaaggctcatctgaaccgaacataatattccaaacgtgttctgcccagcccagagcagtctagactgcttcctcccttgatgtgtggattatactttcccaggttcaggtagtatccattctgtcgccagaagacaagttaatgaatgtctaatgaagccaaccagtatttttaaaaagaagtctaagattgccttagaatatttagtagacatactgtgcctctggttcagactgaaattgtggttgactaaactcccccacgctcattttctttggtttgtttatttagatcattatacattgatgaattccacttctccacagctttcagctttaattccttcttgcttcaggttatatccaacagtttattatttcaaaagctctctgttagcctttttaagtactcttatctctgaactcctagtactgggtcaatccagccatctactccacacctaacctcaggctgctgagaactgctgttgaaaaatcacacaccttatttttgtctttgtcttttttatgtttttttttttttggtctgtataaaataagattgattacttttgctagtcagcaccatgatttaaaattttgatttaaacttgattagctgccccatattttcctcctagattgtaagcatgttccttgctctgggactttgcgcttgtgattacctctgtctaatgctcttccactagttgagtaattttcagtcttgactatatattagaatcaatggggactttaaaacagctctgatgctcggccccactccagaccaattaactcagaatttctgaagggtgggacccaggaattagttttgttttaaaagatccccaggtaatgctactgtgcactaaggttaaaagtcactaccctataaagatgcatgctttgccttctcactttaattggttttaagctcaaatgatcaccactttagggaggattttcctgtttatctaaaatatagacctctttcactttctattcccttctcctgccttatttttcttcacagaatgtatcatttatttaccaggtaagctattgttgcttattcatttcatgtgtttgccttcttctcacagaatataaccttcatgagtgcgtacatatatataataatatacacattatgtaatgtattatcaatggtgattagaaccaaaaacacaaaagagtggaagagactgacttggaacagtatatatagagagaagagggcctagaatagaaccccaaggaactaaaacattttgggagcccatgtggtggttactctatttcttgattggtttagttcactgccatagtccaccatctatagtagagcatggcatactattcaacaaagttgttgaaaggagttccccagtacttcaccattttcctcaacctcccaaataaattttctttttcactcttagaatatttttaaattgcagaaaaaaataaaaactgtctaatgaaaattctttaacattctagtccctttgaccaagcttataaagtgcccatgtatcttttttcgtatctcagaaaattgattctcctggtgtttgggggaaagattttgttacatattttttttttgttttgaattcctttattttggatcctgttccattctcttcatcttaagactttgatctattcactctctctcctttattggtgcctttcttcaacgtgagtctacttgtgtttctcccatttaaaactaacattctctcttctgtctctcttgctttctctctctccctgctaaatcctctcatttgtcttatctcttttcatttttaaacctctctatcctctcatttctacccctgatgcttcagcaaaagtgctctgaagtcaataatgatctatttttttccaaatccagtgggcactgttcattattcatctttcttgactttccctctattaagttgggaatgttgttaacttctccttttgaaaattctcttctttcttggtttctgtgatatccctctctcttaagtctgattctacctctaaggtacaatccttggtaagaaagtcatatgtgtcattattcaagttattgataaaaagcttgaaaaaattcaggcttgaggacaggttctgtgttgtgctgttagagacccacgtctaggttgttgctgatcaattttaggggtctgttattcagtctgctgaataacatgattatacagtctgtggatctccatctagtcctggaggatataattaaaaattgttaaatgttttaatgaaattatgataaaatataaatcatacaggattatacctcacagtaacacaaattttaacataaggcaattggcaattgatatttagggggtcttcaagccagcacctcattctcaaacaaggataagctaaaattcctatcttctagggagaggacaagttgtagagggtagcaaaacatcagacagctaggatcttaaaaatagagaggctgagagcaaacaagatcctaatattttctcttttcagtgtccccagattggttgacaaagcaaagatcaattgtatatgaggccattaaattactgcagctatcccaggagtgccagttagccatgacccagcattgtcttcttgtttaattaagctagaggagcaaatgccactatttgataccaaaccatagttggacttgagttgggtgttgattgctgcagctagaacataggtattctatacgcctcaaagtgtgaaccgtggactaaatgtaaacacacacacacacacacacacacacacacacacaattgactgttgagaagaaaaatgaattttattagtcagagagggaggtaaagtacaagtataaaagttatggatgacttactgataattgcttaccataaatttgaaaacttcagcataatctgagaatgagatggcctccatattaatttaataaagttgacattaaacttgaaatattaattcaaaaccaaaagggacctttgtatgtgtggttctgaattttggttggggaatagaaaaggaatctgaatgttgacctaaactcataacatggataggtgagagacagtcacttctttacctttcattttttcttcactatggatttgataaagaacttttgaaattttttttactacattggaggatgttatggacttcattcactttttcttcaagtaaaattttggtaaatattcagttttttaaattggtttgagaaactattgctttggggcaaagtctaaaataacaattgtagatctccttttagagctatgaaatttgaggttaataagttaatgtttcagaggatcataaaacagtaagctgagaagaaaactaagattttccaactttcagaagacactccatttagtaagccctatgttgtcagatgttgcctgtatttctgagtgagaaagaacttttaatattaccaacggtctttgaaatcttttggaaaaaaaagcagacaaattttttctaatttagctttattttgtaattcattttggtaaattattatttgcctccttttctagatttttcttttctagcatttgaattataatctcagaggatgtccttgatagtggaagtatggggttatttgtcatgtcagttgataattactttggatgatcttactgaaagctaaagttgattgtgttcatctgcaaagcaaacaattttgacaattaaggcataaaaattgtgagtgttacatatagctgttccaactataatgtgttgattagagctgtttcatgaatctttctcaggaacagtctgagtgctatatactgcttagaaagaaaatacagagtcagtgtatttgctctcacaatgtgctgattgcggcagcttgcccagagctaaactggctgtaataaaaacttctggattggaacataatgatggcatttatgttatttgcctcctgcactttataaacccaagcaaacagctctcagtttgagaacctcagaaagatctgtcattaggtatggctgagtttccttatgtcgattctttgaagaatatgtcagctgaagtcttgcagtgagcagtagaatatgaatcttacgtagctgaaggtgctagattaaaacagcttccatcttctgactttgtccagatcattttattgaactcagtttgatagatgcctttctgtgagggtgttattatttttaaagactcatagtgagttcctggacctttggatgcatattgccccctaaaatagcatgaaatcaggcaaactggacttattattagcatggtacttaagaaaatttgaaaacagttcaaaggaaaatgactgaacccatcttatacatgcagtatgttttaacaaatcaattgtggattagctctaggaagtggccgtgtttgtgtacatggaaggccacctagatctctgccacatattacagtgtctgttcacaaaattgtccctttttgaattcatagaaccatcactgggaatagcagtgcctctgagtgcctactaaggaacagttgtggagataggccaaagctaaagagagaataggaaagaaaaaataaagatggagggagtgggcaactggagatggaaagggtaaaggatgagtagcagtggttatgtcctgtctcttaataacaatctaatggaagagttggctttcctcttgctgagaaaggatatgcatttttcatatgcatatgccacccttcactgggtttcctgtgtatctttggatcatataccagattaacaggagttcttcattagtaccagtgaagctgttattatcatcacttagccttgctgctgtggacaatccttttgaagatctacatttggaaatggcacgtggaatttcagctcttttataatttatttcttacattattttttaatgaataaaatgaggattacccaagaccgagggacagtatgattcaacctcttcaaggaaaaagtttttaaatggccttactataatattcgaataacttagacccttcacgtaatttccttaaatggaggaatttagtccctagttatgaaaagaatacagtactttctttctagaagactgggaaagtcagaaaagtaaaaagaaaaaagtgcacctataatctcaccactcagaagtaaccagtcaggattagatataatagtcctaaagtgcctttgtattttctaaattcttggggcagtggataactgaaaaacctgaagttttgtgcctgttccctcgggtgatattctaagtaatacctgttatatgttttagtttaactcatgtgtctatggacagtaatatttgaatagctataatgactatgtttaagtctattttattccaaattcacgcatttagccagaaattctctgaccaggagaatagagagaattgcctaatgatttctctattttacctaatgatttcactgtattaactcgtatcttaaacagtaataactatacaaataaacaaaaaaatggacagatacataacttcttgaccacgttggctaatgaaattaataatgaactatgttgaaaactgtaaacatttgctatgctatagtttacaagtgttctccatttagtagaatatcagtgctatttttatgttattgtgctagtatttcctacacaattgttttgcgtgtgtttctactagcatatagattccagactcttcagttttagaagtttcagcatgtatggggtacgtgtgtggtgtgagcatgggggcttgctggaaaggaagttatttcctcttatcttttcttgaaaaaattcagatccatgcttgtgctaattttactcaaactataatttgtttctaaaaactaatgttcagaaggatcaaggaaaagtaatgattataccctttaatttttgtagttaatttatttgaatgttctaaaattgttagcatttttagcccgttaacaatgacagcagtgttgtaaataactgtaacagagctcttgaagaaccagacctcttgattaacaggacccttgatcctacacttaatgaactcctcaggataaaaggtaccataaaattacagtcatgtgctgcataaggacattttgaccaatgatggactacatatacaatcatggtcccataagattataatggagctgaaaaattcctatggccgtcataaggtcatagtgcaacgcagtactcgcgtatttgtggtgatgctggtgtaaacaaacctaccatgctgccaggtgtataaaagtatagcacatacagttatgtacagtacatcatccttgataagaaaaaatgactatcttactagtttatgtatttactatacttttttttatttatttatttttaagttaactgtaaaacagcctcaggcaggtccttcaggaggtattccagaagaaggcattgttgtcataggagatgacagcttcatgcatgttatttagtgggacaggatgtggaggtggaagaaaatgatattggtgatcctgatcctttttaggcctaggctaagatgtttctttgtgacttagtctttaagaaaaaagtttaaaaagtaaaagaaatgagttaatttttttttaaatagaaaaaaacttatagactaaaggtaggaagaaaggaaatatttttgtgccgctgtacaacgcgtttgtgtttaagctaagtgttagtataaaagtcaaaatgttgaaaaaatttaaaagtttataaaatgaaacagttacagtgagctaaggttaatttattattgaagaaagaaaaatatttttaaaatacgtttagtgtagcttaagtgtacagtgtttatacagtctacagttatgtttagtaatgttctaggccttcacattcactcaccacttactgactcacccagagcaacttccagtcctccaagctccatttgtggtaagtgcccgatacaggtgtaccatttaaaaaatcctttatgtcatatttttaatgtaccttttctatgtttagttatgtttagacacacaaataccactgtgttacaattgcttacagtattcagtatagtaacatgcggtacaggtttgcagcctaggagaagtagggtataccatatcctaggtgtgtagtaggctatactatctaggcttgtgtaagtgcactctctggtgtttacacaacaatgaaatggcctagcaatgcattttttgaacatatcctgtggttaagtgacacataactgtatgcatatctttttttgtttgtttttgagactgagttcactccgtcacccaggctggagtgcagtggcgtgatcttggctgactgcaacctctgcctcctgggttcaattgattctcatgcctcagcctcccaagtagctgggattacagatgcccgccaccatgcctgcctaatttttgtatttttagtagagacggggtttcaccatgttggccagactggtgttgaactcctgacctcaaatgatccaccccccatggcctccctaagtgctgggattacaggcgtgagccaccgcacccggcctgtatgcatatctttgttgaggacgttcttcctttctgtttaccactgttaccacccaaattatttcaatttttaagagtaggtttcttttccaattaacctttgtacactgttttgtgaattatactataaaatatgctcaaattgccctcaatcaatatttggtactgataaataataaaatattttctgagtaacaagtcattttcaaaattctcattttcattacataatatttataatacaataattctcttaggtggatgtgactgctagatattcttctccggttctgtgtttgggcacagcttcaactgactcagggattcttagcctgcctagccataagactcccctggaaactgattatgcatacagattccaggcctcacccctccaccccagacctgctcagttacaatctctgggtgacttgtatcatcagacaagtctgagaaacttgaaactagtgaggctgcactgggaatttgatcaatgcgtaattgcatgttggtgtataggaaagatttatggatgtggattgaattgatagtgttcatttacttttatcactagtcaaacatcataagagaaaactgctctcctactttctttaaattttagcttctatgagacttcagttgaggtaatataaaaattattttttgagcactaccatgtacaaagcactattctaatgtttttcatgtatctattactattaatatagagagacgaaataatttgcccagagccaaataagtaacatatgggaaaacttggacttgaacctgagaaatcagatttcagaatctacacaattaacccctgcaatatattgcctatagccaccaaatctaagtatgtattaatgtgtcaggcactactatattaagtacttcatatacttttagtacttttaattcatttaccaattctataaagtgggattacgaaaggcaaattcagagatattaagtattttgcccagagttgccctgctagtaagtggtagaagcagtgtggtttgaaattggggtagctcaactccagaactcttttcacaaccactatcctgtacgccagagtggcatgtttgaaaacactcatacttgtcatcccttcagtattttatataaatagtattagcacctgagtggttttctgtaagctaattatataacacttcattgtctacatttaaaaatgtctacatttaacatctacgttaagacactttggtgtgtacattaaatttttaaagagattctacagtatattatagaattctgtctctgagaaagatttgaatataatatattggtcactctgttatctgtcataggctggctgaaggagagataaggattaacatactttcaaggaattcttaaccctctagtttttatcattaaaggatagtatagttggtgaatacttgcgtattttgtgaacatttggtaagcagttgcacttaatttccttcacttgaacattaaatattccacatttgttctgtcccaagtaagctattctcctttactttgaaatgacttataaatttactttcacacaattattaaagatttactgtaaactgctgctttccccctccttttttttttttttttgtcccaaaatgaaggtgaagtgttaattggttttaatggcatctatggttacctctttgtctgggacttctaaggaaaagcgaagaattggcagaaaaatgtgtgaaatttgtctggggaggtgagaaactttaatgtgcttgtgaattagtgcacttcttctaggtaagactattgcagcataataaatattgaaacggaattctcactcttagacctaatcctttaagtatattagtagacatcatagaagaattttctgaagaaatatgttaactaagtttctgtagctggaaaagatcagcccttgatagactatgaaataagaatgtcttgtgtaaacatacatggacaaccagtgaatagactgtctctctcaagaacaaaggcatgctaatttggattcagaactagaaagaaggagcctggattttgcaacatgctgttatagttaaatacaagactatagttgcctgagacatgtacctggctgttaacactttttcccaataaaagtgattctaataccaagagtggctaattcatctgaaacactgttcctggtgcttatacactgatacattttagtaactctgtgcctttgatttaataggtaaccatctagataagtgttcttatttaacaaaaaaatgtactgggattctggaaagctcaaagaagacttctttaccattttaacagctttaagataactaatcttttttaaaaaattattattccttctgcattttagcagttgacatttccacttgtacctttaccagaaggcagcagagtaatgtaatgagcccagttctgtgttgggggagagagagaaaaatatggctttgttagcatttgcttctgtaaaatcaattcagagtacagtgggacaatagaaatgcaaacaaagtctgttgatttgtttctacacttccctctttttgtcattccatattgaagtgtcggttgtattataagataccaagaaaatgtttttttatcatcaaagacaaaaacaaaattttttggccgtgggcggtggctcacgcctgtaatcccaacactttgggaggccgaggtgggtggatcacctgaggttgggagtgaaagaccagcctgaccaacatggagaaaccccatctctactaaaaatacaaaaatagctgggcaaggtggtgcatgcctgtaatcccagctacttgggaggctgaggcaggagaattgcttgaacctgggaggcggaggttggggtgagctgaggtcacgccattgcactcctgcctgggcaacaagagtgagacttcgtctctaaataaataaataaataaataaataaataaataaaattttttaggcactttgagccattaacccatacccgtgagttaagtcctctacttgaaatacataattttttccacacaattagacaggcattattactaccttattttacagaaggtgaaactgaggcttagaaaagttgaccaaggccatatcccaaataagcagcaaaaactggaaagcaaacctaggtctgtctaattcaaagataatgctcttagtcattatctcaaatatgaattgtatatataatttaatagtgttctggtgtattttgttttatgtacttggagtcagcatgtcacaataaagagcaagatagaaaaggcaggagatctggagtcaagacacttggatttggaatcaacttgtttgttggaattctaattctaccacttatactgtgttatattgggcaagttgctttaactgtttgaactttggtttcttttgtgaactgggaagtaagggagataatggatatgaaatgcttaataaatggtctatgctaatactctacatttgcagagtggcttacggtttacaaagagctttcaccaagattgtctcaggtaatacttagtgatataagtgtttgaagttcattcattcttttattcattcatccaacaaatattttataagtgtccactaggtttcaagcattgttttacaagttggaaagatttagcagtgaaactacagggaaaaaaagactcttgttttcatggagtttgcattttaatgaggcatatagataataacacataagcaaaatattaaatatattagataataacaaaggtagcatttaactcttatatggtaagcactatgagctagtagttagcttaatagctagaagcatattgtgattcatagattagctacatgattttccattatagacaaacaaaacctgtaaagtacttacagttcaactacaaacttaaaaaattgtattgttttaaaacaattaggggatttaaaacaattaaatgttggtacacatcaccaaaattggtgaaatatcttctagctttaacattctatgatatattggctaaaagcatggagtaaatatgtacctcttatacctgtctgtctttatgtaggtctggcaagtgtactctgaatataacataacaataattcacagatttttttaaagattattgaaaaacacaaaataatcttggcatttgttaactttgtaagctagtcagtattctcttgagttgtatgtctcaacttcagcgcaaagctaggaaaaagcttcagtgatctgaaacttccattctcttgtactatggctcttaagaagatgcaatgggatcatgagcagatcttgtagggaacccagacattaaggttatttctgtctaccctgagtttaaattcactgaaagctacaagaaagacaagtgttacttttagggtagttgacagccattgactattgatgactccaagtcatcattcagcatcatggggcagaggtctgtaagtattggaagaaaaagtcacatctccccattaaacgttttgagatttaatcctgaaaatgctttctagttatctcagtaaaaggaaataatctttttttcttgactcaaacattaaaaaatttactgatgaagtatttctggtcagtgtttaagacaagcttgtccaactcatagcccatgggccacaggcagcccaggatggctttgaatgtggcccaacacagatttgtaaacttttttaaaacatgagttttttttgtgatttattttttatttttagctcatcagctatcattagtgttagtgtattttatatgtggctcaagacaattctccttcttccaatgtggtccaggaaagccaaaagattgaacacccctgatgaagaagttaagagcccaagcttcagtaacagaattcttgttctactacttactatttaagaagaaatccattatagcttcaaaatattttgagcatctttccacctctctactcaccaccactattctgttccacacagtgtttctccatacagtagctagagtgaccttattacaattgaaatctgacagtctgatccccacaccttctcctcctcttttacttacttctcctgctctccaccccctatcttccccttattcctccctgccctcttaaaaactgcccgttttctttcttttatgctagaatgaagttcagactccttattcaggcctaccttgctgatctcacctacgtcttgatcactgagtgtaagtcacctgaattcttctaatccttaaacacattaagctgatttcctatttgcaactttaacacagcctgtttcctgtgctcagaacactgttcattttactctttacatggctgactctttatctctcgggtcttaggctttctcttaccacccaatctaagtaggttctcttgttatgctcactcatagcaccatgtttttctctttcatggtacctatcatagtttttcactttatattcctttgagttttgtttaatatctggattcctgggtgggcacggtgactaatgcctgtaatcccagcactttgggaggccaaggcgggtggatcacgaggtcaagagatcaagaccatcctggccaacatggtgaaacccctctactaaaaacacaaaaaattagctgggggtggtggcatgcacctgtagtcccagctacttgggagtctgaggcaggagaatcgcttgaacctgggaggtggaggttgcagtgagtgagccaagattgcgccactgcactccagcctgatgatagagtgagactgtctcaaaaaaaaaaaaaaaaaaaatctggattcctgtcctcccccaaccataatcttcatgtctttttggtctactgctgtacacccaactccagccacagtcattgaacagatactcagtacatcattgttaaggttgaatggataacaaatctctatgacctttcgaagtcttaatttgcttttctgaaaaatagggataataattcctatctctaaagttattgtgtgaattaaatgagattaaaagatctaaaatacttaatgctgggcttgacaaagtcttcaacaaatggtagggtctgtagcagcaacaacgtaatcagcaggcacttattaagcccactgtatgtgtaagacgtcactaatatttatagaacatattttagaaagagaaactttttttagacttttgtttaatctagccttttctgggtatattcattaacattgatccccatattaaggaaattaaaatgcgagtttccagcagtgattccatgctttttaatggaacattgatatgaactagcctcagttttatgttgtcacaattatcagagcccccaacatacattcaacagggtattactttgtgtagtaattgcctagactatcctccctccactccagccagctggcattgaaaaagaagcactgcttttatgtgtgcacgtaatcaatctgtaaaatcccattatccccaacttccacacccccgtggctgcatgcttccttttgaagcctcttaaaaaagaaaaactttgaaggcaaccttgaagtttatttctaatctcattctagccatataacataaaaatgagataggggtagggagtgggaggggttcataatgtgatttgcttacctctttgcctggaatcttatgatacttgtaggtaagcccagtgaaagtttacatgagtaaaaatacttcttcagtgtgtattttgagataaagttggatttaattctgtttcaaagtgtgaagaatagagcaaggttaatgtggttattcttgttcttcttttaatctgttcttaatgtctatactatttagaataagagtttccacccacctcttatgaccagcagcctgtgtaactgattatctgttagagtcctaggtgcaatgcccttcccactctgctttcctgtttcatgtctgtttctttctgagaatattatctcccttctggatcattttctaactgcttttactaggccactgcaatctttttcttttgggttccaatttcccatgtgattggcatttttcttagcattcttcccacagtcttgaagtaattgacgtttttgcttgaggatgacctttcctgtttcctccatctctagaaactaccaacatttgattaaagtagggtaggggagaggtgtgggatgtaggtaggtaatctcaaaaatgttttctccaaacatgaaagatgtgactatgcttctgtcatcattattcaaaaacatttattctgaagtctgtattttatatatgcatcacctaatcccatcatcttctccatcctcttcatctctgggacatttccccatcttccttagagcctgaactacaaaccttaccttcataccaactcattccatctctctcagtgactttgttctcctagctagtgattcttgtaaaactgtagcttctcggtctttatttcaggcatcctagagccacagtcatggcttaggccgcacctcttgggcatctcaactttcttttctcctattaaatattcttcctgtcttcattgtagattcctctcactatactcccatcttcttcctcaggttgatatatctccctcctggtgttcacttcctttttttctatcttgttcctccccatgacccaacaagaccccttcaccctcttaacttcttgaaagagtagtcttaatcattgtttctgttttctttatctcccattatcctgtcagcaccctagaggcttttccctcattactctgcagacgctgctttcataatccccaagggtcacctcatttttcatattcagtggtgacctcttctatgtctttaccctgataacatttttgacatcctccttttttaatactttccttccttgactccataatattttctttctgtgattattttccctcctctgcaatccccccctttttgtttgttgtttctttgatgtggattcttcttcttcccctgctacaaagggtaagttctcctttggcacctcttttctctctgcttattttctgttgattatctcatccgccctctcaatgttaatactcacctcttagatgtggtttcccttcctgatgctgaggatatgtccccacatcctcctttgtaacattctgtagacatgtccagagggataatgtaaacctaaggtcatgttaatttattatctaaactgggtcactgtggagggttgaagagggcactattaataattagcagatgtaaacctgtactgcgcacatagtcacctgttcaaagccaacatttacaaaatactctgaaatctgtttcttctcagttgttttccatctttattaattgcctcaccaacattctacttacctgtgctgaaaatcttcatcatcttcaatattctactttttttactgtatctttttaattaaagctttcttttctttatttcttttttgaccccattccactggcagtgcgctgttcaggcccttatttccccttgcctgaaatactgcatagccgtctaacttgtcttcttgttcccagtttctcccattcatctttaagcaatattttttatttttataaaatgttgcctgaagtgcactgatcatttatatacctgcttaagagtcattgccaaagaatatcaatgcagacttctcagcttggaattcaacacactacaaagcctaatggaaaatatacctttccagtcttacctccttcatggaccctgtatttcagttggactattggcctttatccaaacacctcctaaatcagtggtccttgaccacatcataatcacctttggaatttttttttttttttttttttttttgaaatgtacatgcctagccttcatctgggagcttttaatttagtaagtctttactggggcctaatcagaccccaataaaacctcttaataaaaacctccctcaggtgattctgaccaaggccagggttgagaaacattgcccatttttatttctcgataattttggtcacattttttcttcataaccagtatgtgcttttctttaaattccttcttacccttcaacacctatcctatctccttcatgaggtcttccttgagctattcaaatagatgtagttgtttcttcctttttactgcagagcagtgaacggtcactgctgtttatgcctaataattggtagacagcacacttcttgaaggcaagccatctgctacttataaaaaagaagccagctgggtgtggtggctcacgcttgtaatcccagcactttgggaggctgaggtgggtggatcacttgaggttggaagttggagaccagcctggccaacatggtgaaaccccgtctctactaaaaatacaaaaattagctgggtgtggtgacgcaagtctgtaatcccagctactcgggaggctgaggcaggagaatcgcttgaatccaggaggcacaggttgcagtgagccaagattgtgccactgcactccagcctggataacagagtgatactccatctcaaaaaaaaaaagccagtcagtaaaagtcattgactagttaagaatatttgtagagaactttgaagttcttaaaaagtgattgataagcaggagttattttttgctaatttaacaaaaagtcccaaaacaaaaagtacggtgtttgtaattctaagactatgctaaattaagatttgttaatcatgctaagaaggaaaaaggaattagaattttaaatgctgctaccattttcagcagcaatgaactaatagtacattcattggtggattgattccattaacactcatgcttcagatgctttagggcatgtagctctctttggattcctcatgaaattgtcatgttggcatgtagctataaaatatgcattaatcagaaactgtagttactaaagccaagttcttttcactagtttgtttggaataggggaataatacttttaataaatcggccttcctgtaagatagagcacagtgtcatttttaatagggagcaagaataagtgcagtgattaaatgcagttacaaatggctgcatctaaaaacaatttttgatttttgtcaaacatttagcaagggagtaatttttttcctctagttttttgtagctttcccagtttttttttgttgttgtttttgttaaagttatatgctatatattcagaattggattctttttccctataaatttgttagtacctgatttggaatttagtcttattaatatcatttagtttgggatgcatggaaatgtatgtataattattgagtgccctttaaggtggagacttgtatcttgatattctattgaaatatatatatatatatatatatatattttgtattttgcaaagcaactggattttatagcaagcgtaggtaaagaaaaaacttgtatcctcttggtgctctgtgtatttgctagtataaaacatgtttctgatttattccaggcaacataatcaaaaggtgtattttagaacatacacaaacttttctatgctcatgaaaggtatactgactggaaaatatcaatataatctcttttttttttttttgctttttataaactacaggtttacagagactttatggagacatccagtcctttccctgacttctagcagaactatagcttaaactactcaaaacttctagaagcaaagtcaaacttccttcagaaacattccttatgtttaatgttaatcacattcatcttttaagttgtccctcgaaaacaaccataatgggaagccaaaagacagagtgttgggaaacattttgaagacagcaaacaaataattaataagatttcatagtcacttggagatatctccttgtcagtagaggagtaaaaggagcagtatctagtaaaacttgggaacagatggcaaacatttgttgaccataataatagtagtaacttgtattttgtagaagattatacagtttccatgcacatcgtgtcatttaatcctcacaaaaatgagggtactattaacccccttttacagatatggaaacatagctaggaagggtaagtagtttgtttttaattgcatacctaagtggtagatctgagatttcaagtcttttgatgctctgtgtggaaaacacaaactcaaagtgtgtatgtgtgtttaattctctcattcaacaataatcaacatagaagacttgtcttaacaagttttgccccatacaccacgcaagcaatcagttcttcagcagataccagctgggtgtcctccaattcagtttaatcccaacactgtctacctggaaattgtgtcatatcccacaggttgagggcttattcccacaaaactgcctcctcttcagacaccagttgcaagactagtcagcttcaagtttggtttcccaggatcccctttttgtgttctattaatttgctacaacagctcacaaaatgcaaggaaacagatttactgacgtattataaaggatgttacaaaggatccagatggcaggaaacataaggtgaggtctaggtgggcacagagcttccatgccctctccaggcatgccatcctgcaggaaccaccacatgttcagcaatctggaagctctccaaatcttgaccttttgtttttttatggaggcttgattacataggcatgcttgattaaaccactggtcactggtgatcaacttaatcttcatccacttcgccctctctggaggttagggtttggggttgtaagtcccaaccctataatcatgtcttggtcttttcaatgatcagactttatcttgaagctacctagggcctgccagctatcagtgaactcattagcatatgaaaatatatcactttgaagattgcaaggattttaggagttgtatgccagaaacagggacaaagagaaagtgtgtatttcacagtatcacaaatgccaactcactctactaaaaggctattttaaaaaaacagtttttcaaagaccaccttaaaaagtatcaggacagtggcagcagtgcgcctaagagagaaaggctttgaaaccatttcttaaattttccatctatacagtgtataagtaagaggaaatacatttatacatgaaacactgaactctttgaagtaaaatgatacacaacctcaagatgttgattttttaaaatttttagccaacttttatttttatgcctagaaaaatacatgggacgtttaggactaatgtgctgggcaatttgctacttagtgatagtaacacaatcctgaaaaagcaagcacaattattctgtactttttaaaagttttattcagcaataagaccataatttttcatatttaaggagtatgaaaaatttgtggagttttaaaagctgaatacatgtagcgttggatcaaggcacatacaagactggccaaagggcgtacaatgcactttggttttttgttgaaaaaaaaaaaatcatggcaacagaaaagtgatatggtttttcaacaagtaacagctcacaattcagtaggaagctagaaggaaatgttacattacgagttcattatataatatctggaaaattgtgacagtaatgggcagtattcttgatctttgtaaaagtaaattgaacatttatgtacagtgttaaaacctttgacataaaccagatctaaatttgatgtctagtatttatttttctttaaattatctcttatttaaagaactactttctctggattgttgaggggaatcgcttataattacattacatttttaatatgcataaagtttctctgacatcctttatgataaaaacatcataaacactaacaattttgtgtttataattcacttttcaaaaatcaggatggtataggcaaaaccaaaatgcagttttggtatttgtgttcattacactatacaagtctaagtttccatgttttcctaagtacacattttccccccaacttggaagcacatttacattaccgtttttgtgaagtcctttattttcaaagctttgctgacaatggctttaacagacttcatgctccttttatgccagctgatgtattcagttcagaagatatgcttaacttttttaaggataattaatttgcctagagcaaaaatggagatatgcaggaagtttgatattgcccattacttcacacattttgatttattgaataccactgggataatacaaatttaataattggaacattatttcataaccattttttaaaattaaattttatctcattcagccattcagccagttttttttttttacattttattaataccaaagtgaaaaatggcctgtgcttatactacaaggatctcatatgaatgcagtcctgattgttcgacacagcaagaaaattcactttcacagtcaacaagtcatcttactcagtagaacacaaagtaaatggtttataactccaatatttgcaaggaaaatacagtacaaattactaaaaaatactaaaatatagaattgtgttcaggcatctccactacatcaatcgcagcagtaacctgaaatttgaaacttttaataaaaagttcttaaatataaattatatggcaaatgtacagtacattgctttttttcagtctctttttccagtgttttgcagtagaacagggttcctaccatcacctcccttaggtttaaaaaacccaaaacacaagtctgctgtgagtccttcagcatcatgagtgtgagtgatctgagtctggaataccactgtctctgtagcttcggttactactgctttcactgtgattgtttttgtacagattcattccattaggaggaaatatggtgtgtattacaaactcctccttcgagatgggttcattgcttattggtaacatctgaaaagaagtttccctgatttccaggatagagttgtccttcttagtgccagcttctgcatagtcatcctttcttctcctccctttgctatatgcacagttccttgagaagagcgatccattcctatgaacataccaacacactaaagcaagaagggcaatggtaaccagggccacagccccaccaatgatggcagccaaaggtaaattggggtttttgtaaggttctttctcttgctctcgattgagggtggttgtagggttgtacattcgaaggggtgcagtttcagtctcaatacaaacaggagtttcatcaaataggtagaggttgctggtttccatgggaaccatgcatactttatagggtgaatcaggctccagggctgtgaccaagtactcactgcgttcccctgttacaattgtttctgttatagatccaaatgccgggctatggcccagtttaagccagctgagtctcaaagcagtcataggtagagcaagtttccaagagatatgaatggtatcagaggtgacagacttcacagtaattgtaattgtttttcttgagggactccctgtggtttggtgatccttagtgagcttggggttcttaatatctggctgtttggtcactggagctggccactgtccttgggcaggatacactgtgttgggtattgcagtggttatctgaatggtgcttacaatcccactgtccttacaatcaaacagttctgcattgagatccttaatagccatcccacgaaccttttctggggcttggcacatgagcccacgcacgttgaccttcacaggtagtgattgtaaccagtcacgtacccatttcatcttgcacccgcaataccagggattgttgcgaagaatcagttgtgttatattgtccaaatcatcaaagataccctgaggtaaattacttaggttattattggacatatccagtcgatagagctgccttagataagaaaaagcatttgggggcacccgattgatgtggttatcttgaagataaagcttcctcaggtttgtgcctggaaggtttactggtgcagcagtcagggaattccgcaccagggacagctctgtcaaattaactaggttgaagaaaactttgtcacctaaaccatgattgttcaacaggtttccatctagaaccaggcgttttagactagtgagaccttgaagagatggtgatgaaatagtggatatgcgattatcatccaagcgtagttcttctatagtcctgggcaaaccccagggaattgtgctaaggtgattacgggacaggaaaagcagtcggagatagttgctgtctcggaatgctccctcttctatgctaactgcagagacagagttgtcatctaaatgtaattcttccagatagggaatttttgaaagtgaatcataagtgatagtccttatgttattttcttgcaaatgtaactcttttacatactttgggaggttggtaggaaattcatctaaactgttgtggtataggtatattctttctactttcagcaagtttttcaaatctgaaggaatcccagcattatttatttggttgttctgaaggtagagagttgtagcatcctctggtattcctgttggaatggatgtcagaaagcgatcattacagtaaatgaaacccgcatcgcagcgacacacagatggacaggatttagccataactgatagaggtgctacttgaaggaacagcccaattttagtcccgatgaggaagatgctccaggctgcgctgatcatggtcagcagtgttgaggtctttatacaaggtagcttccgttacttcagaaccctaaaatgaagtgagtaaaaaaagacagaaaacaataaggccagcatactgaatataatgtttaaaaacaaatgtggaaactaaaatatccataatcacttttaatattttcatttgttttgggagggggcataatagggtttattgctagctaacaatagacactgtcatataatctctttaccttaatggtttcttaatttctttataaattaaaaagtatctgtcctaaatccatttgattttgaaatattaaatataattgaagttttattgaataatccaaagtattttaattatactttatatcaacctttagacagtcactgatcaagctaattgaatatccatttcttacttaatattcataataagtaacaccttggaatattatttcttatatttaaaggtaatcattttactgttatcaaaaaaccacacatttttatatttactttttattaggcaaaaactatacaggtgtagaaaaatgtcataaaaatacctattctcttcatactcaggaatagttacacacatcttgagatcctcaatctcaaacccatagtttgctttgattattaatgtcatttcattttctttggttattaattttaagcattattttaaatggatggatttctgcaagaaaataagaatgattccttcatttatttttgggaaagaattacaaagctaatacatccagctaacctaagtggaaaatttcacttcatattaaattctgtctttcttctgttcacattttgttatatgtttcatactgcaggttttaatgactttgtccacatttttcattattttctacctcataacgtgttgtcacagtgcatttatatttctttgaattctaacctagaacataaatcaactttttctatggctggcaaagtatagatttatactgatgtattgtgtaatatagtctcttctgtccttttaagtattaattagcctttgtaattttaggcatgaaaataaaatactttgtttttcctaccttattgaacgatgtgagtaaattttgcgggggtgaatatccaatgcacatatattattttcctggtgagggactgggacttataaacttttgtttagtccttggaaatgttcttcaccgtttattcaagtaatcctatggcgtacacacctccagatcaggcttgctgttgtcaatgaacattccagctgcagttcagcatggtgggcaagctcattaaagtgggggcagaaacaattctgcttcctgttactatgtaggacacatggcttcctatgtattttttttttctttctgatagagtttctgtgtgaaagttccttttgtgtagcttaattcccttagtggaaattgccctctttgaaattcttattggctcttctgtgcaatgtggtcagagatagtaacttcagatcctcatgaagaaagtcattcatgatgctaaggcctgtatagtaataggtttttcaggcagttaccccctacctttattcccatccaggattatccaagtataaactttgtacagtagctacatcctgaggtatgattacctgctgtgaaatagctatttccagcttttgcttcttgctgatttttcagaatgtctggtgcagtcacgttatacaagaacaggtattctcttttaagaagtaaaggaaactaaattcttcatttaaagaaaaggaggcatactaaatttcctttatatttctcttccttaaaatatactgggactgagcatctcctgtgaaagtaaaaggttttaatgaactattaataatgaactttaacatactagagaaatttcctagacatttaatttcaatgtcttaaaataacacatctttcatcatagtggttagtcagaagggataggttgacctctttgtttttagacttctcattttcttatacaaataaagtaggagccaaagttgagattgtcatcaaacagataatttctattatctgattgtgtcactttgaattaaacaccatggctttcaaattcaagccagtctttaaaaatttacttttaaatcatatgcataaaatgataaaatgtttaaaaagaagaaaacaagtacatgtcaaagaggtgagcaaatacattaacaaatatttttgacagaaatgccaaggtaactttttaggcatttctgaacatgatttaacaaagtcacacaatccacaatttagagttgaaaagactattttaaaagcttttcttttgatttgcttagtgccctgtttgattcctcctgcaggtctcaattctcccaactgcagaatgttgacatcatcccctttctctttaggggtgtatctaaggactacttagtgatcttgaaactctaagcactcaggtgttcttgcccaaaaggtgacatagaagttcaagtcatatttagtttttctggagaatactgttctaattttcttttagcatactgagtttgaaaaaaaaattgtatttgaaatagaagggacactattatttcaatctccttgtagtgaccattaggaaagcacatcaaaaccaggtggggcatttctctctaggttcatacatgaatattgccagtttttaataagtgtatttttcatttccaaaagaagacttttggcttgactaaagagatcattgaatttaatgttgactgctttgcccattatcaaatatgcacgaagattttttgagagtttagaggaggtgagtaatattcgaattggttatgcagggtcatccactctgatactttgtatatatgtagggaacatttgagtatcctggaaatatgtgaccctcaaagtaaggactaaagtagtagcaatttgcttctcccacagttgctatctaacatccaacaagtatagcatctgttccataattcagatactctgctgaacgagtatgttaaataaggccacaatttgtgtttctggttctctccaaaaattcagtttcttttagtttgctaactacataccaacatggtcataggctatattaacggaagaaaagtgaaaacaattacagatacatataatttattatttacgcaacttgaaacaaaaatagcagttagcagatggatcaaacagtctctagtgaatattgcaaagtgcccacagaggaaagtttaaatgatttattgtttaatgtgaggttttactgtgatgcctttagggctttgctcattattgtcaaattccaatagtatcttttcttgaaaactgttgctttctcagtgtgtgaaaatggaaaaccaagctgctgaaattataattacaaagttactttttaaagtatcttctgtaaaagttttttaaacttgaaaattattcaacatataaaataatgtggttaatttaagtttagaaaacaattgcttatgttaaattgcattagaaactaattaaaaaccattataaaaataacaagtgagaacctgcttaaaatgttaccaagagtcaagcatttctgatattccagggatgatggtgaggcaatatatacttgagatgatgaatccgctgattggggatttaaaaactgattgtcccctgagtcaggtcagaccacagtgtgtccaaggtgatgatcataatgataaccagacataaaataaatgtcttttatcttgtgtctggactatatatatatttcaccaaataaggctctaacaatatgtattgattttcacatttttaacccagagaatgaaagagttctaaattggtgtgaaaagacggaagattaatttgtttattttacctgttttacatttgtgaagctgctttctctattctgtttgatatgcaaactcacatttgccattcatacaatagtggtaataatgtgggattaacagaaagccttaaatctcattaagttcttggaaaatgtcattctcttctccccacattgtattaaaataaaaggcaaaaacataaaacaggtttcttaggagagaaggatactctttcggaaatgaagattacgttcagagctactctcatatgcccctgctcccttaggctcaaaacagttcatgtttaactacgttttatatcttctctttcccatttatgtttgaaactatagtgctaaacagatttttgggttttggttttggcatattaaaggctgcaaggatctcttcatcaaaaatgaacgatcctctcctatccttagaccttcccctttctgagctggatctacatatttgcgcacctagaaatactgtagtcaaatgtcgatgatgaaaagaaaaatgacccccactggcatggacactgtggccaggtttccataacactgacttcagagcctttctgtccgcctaggcttgaaagaggccattacttctgaacaaaatgaatcgatcttttagaaaaatactgttaatggggtaacttgggaggaaaacataaatgaagccctggtaacttaatggaatgtttaaaaacattttttaatggaatcattatttaactataaaacacttaaaactgtagtaaaaagaagaaaaacataaccacctcactgatgaatcaaatttttaatagggatccttatattcatattcagtttatttttacaaataaaaattgtggggtttttttgcatttataatgtaatcatcaagtctgaaagcttccaatttatttccatgatacacccaataaaacatgtaaatagataaggatactattttagggaaactaatataagaagttgtatctgaatagaaaactagtatttaaataaaatcaagagcttgcggcaatctacatgtttatgtgatttcttccctgctactacaatattttggaggtgggagtgttatgagaaggtatttcttatgttttgagaatattacttagattaagatgaagctgtataatagtagtgctaacttcttatttaatgccttagatttaaattgattttgatttgacctgtttgatcattagtcattttttaaaaatattaattcaagtataaggttttgagattatagtttatttttaatgatttctctcacagaatgatttcttaatgctggggacttttaaaaatattcaatctaaaatctaatggcatgtagaacttttaatccaagttagttgcattgttttaagtaaaaccttgagactaaagaaaacacatgcctaaacaaatgtatccaactttgtgaatatttctaggtaaactggaatttatacaatcataatttagagtattaggaaggtaatttatttatgaaggcttaaattgctgccaaaaaagctcaacctgtgaatgctaagcctttgcaacaacaaacggtatttcaaataaactacatatacggttaaactgaaaaactggagtacatcaggttagttgatagtgacagcaaaatgctttctaagcagcctgtctggtagttaaattttccatgatcatcagatttcaggaaagttccaattcttttgttcaatgccaggcaagcagaaggacctctaactctcctcttgagagtcatgaagtctgaagggtttgctgagaggcagagaagcaagtgtgccttttcatacttggttttatccagactattttctagcctgaacaaggtccttgtttcatttatggaaaatagaggataaaatttccaatgctaagtatttttactttttctttttctgttactggttattttccccggtacgtttctgacaaatgaatcaaattctgcttcatttattttgacttgtaaagttaaatcaagcatccttaaaacaaaaaggcaaactgggatattatccgtcagcatagtgaatgctgcttccttttatgatattaaacccaaagtaaatgaattagagaacaagagttgtaagaacgagtaagatattaatttagagagtggtgaaggtaagtggtgcagagtttggggtgggggcatgctttaaatttgtgcttttgagcaaatgcaattaaaagtttgcctacttttgttaaaccacgttttaccattgcagacttcaaattcctttttaacagtgtgggtacaacttggttgatgtgctttaaatttctaatatttaagtttccatacagtagttcagcaaatacatttattttagtctactgtgtggcaagcactatactggtcggtgagaccacctgaaatcataaaatacattgtttttcatgtccaagcagggtattacttaaaccagatgaagaggaagaaaatcaacaacacataaactgatcaatccacagtccagtggcacactttaaaaatggtttttaaccaaatgtggtctgtgggttttctcttcaaagttgcctcggtaacttgtgcacatgtaaagtgaaagaataaagaacaaaagctgtcattgtctcatcgagtgagagcaatttctccctcctttgatttaaacagaataatacctgcagaaagctttttatacatccctgacacttgattttagggtaggaaagagattatgcatatgcaaaacaaatgaaattttagcttttgcttaaattatattctattgctttctacttaaaatctgttttctctggggttttcgtaaatagataactcaaagttctttcttacacaacataaacatagctttgaaaactgtcttttagtgtgatgtttaaccaaattgagtgatgtcgatctgtattttgaaactggaaaatactttttgaaatgtgtatacctattttcttaagaggaagaatgctgtttcagaagaccaactctttgttggaaatttatttgttgactttcagtaaatttttgaaatggtggaatgttagaaggagctgagaaacatccctttttatgctctgaagagaaaatgcagttttgaggattaatattgctgagagatttttactgtagagtttttgcccactggggggtggtacactctaccagaacactgctttctgaagccgcaagtcagatgttggctgctgctggccagtttttctctggtttaattacaacaaagcctcccgttgagaagaacagtgaaggcctctggggcaaaaggtggggggtgggagggaagggggaaggaggaaagacggaggggagaaattatggcctttgaaaaattactgaatcttatttccattgttgactttatttatggtagtcttcatttgatttaaacagttatttctaatgctttttttttttaaataaatgggtttgaataaaagaatatataaggggatctattcagaatttttaagttagctctggattttgccattaatcaatcacattctttgttatatagcccacccaccttaaaaagaggcatagaagttaagaaatgactgaaatggcaactataaaccaatactttttcattgaccagatttaatattggtatgaacattggcatatcaaaaatgaaaagcaagaaagaagaaacattaatatattattaagacaaggccaattccctgcactgatttttgtagggcttaaaactgttcaaaataatccagaaaaaggaggaagccttagggtgtgtggccaagaaaagcacagaaaaatctctctgcagtgcacttgcatgtttaaagctgattattgtatttttcatctagagagactgagtgttcattagggtcttgtgtccctaggcaggagatgctgagcataattggagtttctatttgattgggcaatatagtctagagaagaaactggggtaaagataattaatagcttgctaacaaagtctgacagccacaagatttcaaccaaatttatttcacactgcttcatttagctctgaaaaagttttgatagaattgtaggctccttaattaacacttgaaagcaaaagaaacataccttctattttgctgccacatttagttatgacagattttcttactgtttttcttctttttgtaaaaactttatttgctatccaattatatatctcacaaacgttatgtttgggaagtgtttaattgtgcattttgaacccagtcataattgattttaaagggtggggtgcagcgaaatgaaaaacccaattagtaactggtagacagttttacagaaccgcaatattaatgaattcattatgtttattcattcactaatattttgctgatccttggacttgatgtgttttggttgtgctcttcaaaaaatcaaattttagttttcttagtaaatctatgcgtttttgtaactctgtttttatttcagggtaataaatagatgtgcgtttgtctgtgtgtatatatatgtgtccaaactaaggggcatatctctgatttaattttcccatggtaaaacctggcatattatcattaatatttgtagtagttggtaatgttgatattattgattgtggcacttttaaaggattaatttttctttactcatttcggaagagatgaatattagtcatctgtcactttgggtcaggtataagtgattctccctgaatataagcaaatttattctttatgtttaggctggtcaggatatttttatgcagtcagagataaatgaaaggcattgctacagctgaaggacttttctagtggctttatttatgttgtttctggataataaaataacatagatgagcattttagacagatttattaatagacagatttattaagaatgtttaaaatagccttattattaaaaccattagagattttggactaaaaattgaaaaaaaaatcaattttttttcttttaaattctaaataaaataataaaaacaaaccccccagatgttgagaagacatggatgggcctgttgcactctttacctatatgcaaccattttgtttcagacctaattcagtgaacaaaattttttgagaagatacatttaactactttttcaagctttgtagtataaatgcatttcttccaatataagattttcctattataagttgcaaagaatggatcctctgcaaaacccacttgataagggctctactcatttatttttctttcctgctaccccaaactcactgcatacatcaggcatagcttccagggtgagctttgttagtttttctgagtagacttagccatttactatgctagtcacatacttcacttgcctaagcaatggattttggtgttctattgaagagggaatatggtttggaagagtgtctccccctcctctgagttcaatttactagttgagatttgcaagcctgaaatgcttgaagcagctcaggcacgatagcagtgcaagctttaaaatctaggtgtagctgttaatcctttacagaggcacataagtctccaggagtagctcggctagctgtgagcaagatgtatgcttttcatgtactgcgtactcatgggctgagggattattgattttctttcacagttgtaaaaacagcaattggtgatcatcccacacgtacagtacacaccaagttgctttcctatctgtgaagaatctccttgtattctttaatatttaacattgaactttccaacttgctgttttccataaggctcttttcacatagcaattactcaagacagaaaatagccacttactatcttttataaatgaaagaaggttctaagaaacttcttacattcagccatgatagtgaaatttttcattgctggcttgcacgcacatatattgcttgttgtggtgacagagcaaacgttcctatttggatttctcatagtatcaagtcgtttctttctagagagtaaaaccaagcaaactttctgggacaatcataagaaaaaacatggaaaacacttaccaggaagacgagaaaaagcaatcctatatacactgccgctatagctgtaattccattgacagtgaattggagtaatagccctcccccgtctcccaagctctgcgtccagtccacacaaagcccacggcagctgcaggctgagcttgtcctgcttcagatcactcctacactgaggagtgagcgagggagagcattccagtttactgcacacagcccacctccaagtctgaagtttaaagcttcacctcgcagtggctgaagaagggggtgatgtcatagatgggcaggacttagccaagatcttgttcagtgaggtaactggataatcagacagatgagctttgcaaacgctagagggggcgagagcagccaaaatgaagcatcagcctgccaaagctaggatgccatttggtttgtaggcagccctttggaatctcaacattttctaaagtttactacaaggcagtggtagcatacttatgtattttttttaaaaagcatgttagaaagatatttttaagatcacaatagaaaaagacaggctttgtcttatttttaaaccatctgtattgaaaagaagttaaccaaaatcaaattagttttattattcactagctaaaataatgttataattgtggaagatgtatgccagtaatcccaactgtgaatgtttattcaacatatgaataaacagcagattcaaatatatacatcagggctgggtgtggtggctcacgcctctaattccggcactttgggaggccgaggtgggaggatcacctgaggtcaggagttcgagaccagcctgaccaacatgtagaaaaaattagctgggcgcccgtaatcccagctgtttgggaggctgaggcaggagaatcacttgaacccgggaggcagaggttgcagtgagccaagattgcaccattgcactccagcctgggcaacaagaacgaaactccatctccaatatatgtatatatatacacgtgtcactgattcatttagttatgggaagggcaataggaatgccaaaagatttttttaaatggtattaaatggtctgttcttttggaggcgaagaagttactgttctctatgttttagaaaatgaaagtatgttttatgtacttctgctacgtgtttatattatttaaaatggattatttatatttaacgatcccccaataaaatgtttttaaaaaatttaatagaatattttcctttctaaatgtttttgctgatctgagcatgggtttagatataaacatcttaagaaaaaaatctttcagggtggtttgcctggattgaaattattttagtttaatttaggtacatgaataaacactggacaattgtaagacgtggagattataaatttctatgcctaattaacagaattatacttgtatttttaattatgatttttgtagactggtttctgctatttggtcaacaattgctttgtgcccgtaagttttccatcaaataagtgtatttcacttgttcatgttggtggtaagaacttagcttttatatttacctggaggaccgttgtcttaaactaatatctttatttgctctattcttagaggtgcatgaccttctcctttgtcctttctcaatttttccctgcatgtttatttctgaagaaggccagctaatagtctttcccaggactatttgattgtggtctcttcattagcttcatttagtttatctatttatatatttgtttgataacagtttgacctgagttcccttccaagaatgggtgatatcaaagtaggtgaacccttgataagaaatgtattgaccctattgttctatgattgcacttttgtgggcctcagaggacagacccattaaatctaggagttttagattctaatgtccattgaaaagccaatttctttgaactgctaggtagtacaattaaactgatatgcagcagctgaattttgggaggaaagggaggtggatatttttctgttactatgaaacaaagacatggattaaattattttattaaataattatttctagaagccattttcagataggagttggttctgtttaaaaaagaaaatttttgcctggtcaaattcctgtgggtttatagccatatttaatcagtttcgtcttcattcaggcaggccttaaacagaaaagaaaaatcaattggtgaattgggttataggtatcaaaaataaattgtactggcctgggagttagcagtttggaggtttcccttctctgggctgccattgttatatgacttcatatttgttgccctaggctttggtttcatcacttgacaaataaaggcagcaaggatttattaaatgccaattattttttgttgctttttttccccttttaagctatggattaaaatatgggaaaagaaaagaaattgtgaaaatatattctatactggggtactgactttgggggcaaactcttagtagaatctgtggcctcctattctgtccaaaaatatatactcttttgctgcatacatagtttttcacttcccgctcttatcagctacctgaaatgctactagttgaaggtgaatttataataatgtgtgccccctttgaaatagtatgtacaatctctggaaacatgaggttatcatgagttacttcagattgccctcctcttttgttttctaaggcactttggctacaataaggggatgactgttttgattgaaggggatggaatgctggcaatctttagcatgaaacccttttggctgtaataggaagggaggaggtggattctcatatcaggaaggacttggctcagggtagaggacaaccagtgtagtagacctgggtagtttaagaacatgggcttcagagattagcacagctgggctccatgttggctttgccacatgactgtagacaaattacttaatctctttgagtttgttagctcagtgcctgactcatagtaagtgctcaataagacgatagctgtcattatttaagatgggggacatccaagcacctggaacaaaaaggacactaagaatgggagaagaatacacaaagggaggtagtacagggccaataacagatttttggaatttttcaaatttctctttgaagtaattttacagtcagtaaatggaagtggaaaagaggaatagaagagcatttcattgattttttttttctcttgtacttacacatctcatgacctcatgttcccagaacttaacacttagttgggttctagtagatattttgggttgaaaagatgtttgctgttttgcattttgttctgttttgttggctagcctgtgaatctagcattgtacgtgagaaagtgcatttcagattgaaagcaactggtttggaaatgaacttcaataacatatcccagttttaaaactctaggactatctaaacttgtcatctcaaaggactttgtggtgttctttgtttgtttttatgagaaaatgtgagatgttcactagtggacatgaaagtagattggatttggaattgggtttcccaggttctgccatttacttgtatatccagacaaaaaaatgaaaaacaacatacacacagaagcctcaaatctgtcttttagttaccaactaccagctgaaactgactaaaacacacagtcatttcatggaacaatacaattcaggtctgtctagagttaagctacctcattcacacattcattcattcagtcttcacattcatttattcattcatcatatacatatttattgactccctgtgtaaaagaaactagtaggactagatgatccccaaactatctccaactatgaagttctgagatttaatcttagaagacattaaggttcttttaagcctaagaaacattcttcatgattttcctttccctcagcattcttcatgagaataaaatcttcaaaattgtgtaaagaaaacagtttggatgggcgcagtggctcatgcctgtaatcccagcactttgggaggccgaggcgggaggatcacctgaagtcaggagtttgagaccagcctggttaacgtggtgaaaccccgtttctagtaaaaatacaaaaagttagccgggcgtggtggcacgtgcctgtaatcccagctacttgggaggctgaggcaagagaaccacttgaacccaggaggtggaggttgcagtgagctgagattgtaccatgcactccagcttgggcagtacaagcgaaactccatctcaaaaagaaaagaaaagaaaaaatagttcatacttttgatagattaaatgtcttggactgttattagttaagatacttttggttgcaagtcattgaagatctaagccttacctgcaaaatcaacaatgggaatccattggttcatgtaactgagaagttaaaatgtatagtacaacttcaggtaaagcttgatacatggcttaaaatatgtcaataagaatacagtttctctctggctctctgtcctgcctttctcattgttggcagcctcctcaggctatatacagtggacctttggcagctctgggatttcctcttaggcaataacagttccacatatcacattcccataacacaatgttcaagggagagaagcgtcctccaaaagcccctgcacggagccctgggggggtcactgtttctcatttgcttaaacttgatcacaggttcattcccgaacctattacatgggtggggagataacgctggtgagcttaagcccaatgcaggagctgcagataagcccagccttactcagacacagaactgagaatggaggacagggcatgatccaaaggaaaatggggtactcttaggttgagaaggaaggagtggatgctaaggatcagctcattttcagaggttttaccatgctgaaacttgggcatattttatacatgtataaacttgaaactgctctttttctctttgtcttttttttcttaagccagagtttctgttaaaattgccaaaacatctttaaaagatactcttatttgtagacgctctcaagtctagcccagatttttctgtcaacaggtagtgatgcatgtcagggcacatcagtattacatcttagcataagcctataggatgttaataaaatatatagagagtgcactatctgtaattctgtgaagtcaggccagatgcttaatgtagtagttagaaactataccacatctttctcaacaattccaaagggtattggagaaataattagattttagcaggtcacggatgccttagaatgccgaaaggttttgaaaatgctacgttaaactgttcttttgttctgatatttgccttttattagtcaacacttaaaatgtacctaaaaacaatcacataacccttttaactatattcccaaaacattctgcactggaatgagatctgtcattacaggacttgaaacagatatcaaagcaaaatcagagtggttatttccctgcctgcctgcctgcttgcccaccctctggtacacccttcttttccccaacactcatgttggactgttacactttggggactgggagaaatgcaattaaaaatcacaactgagaaaaagcacctccttggcctcccaggaaagaaaggaggaattgtggttcagaataagctagtaaaagtcacggggtgtggcagtagctggtgcaaaactagaagcctgctgatccctactttcttccctcttcagcacctccatatatggccatgcagatacagcatatagaactccagctgatataggtcaaagctgtgtccttgaccccttgccactccccagtgccctgtccccttcacttgttttaaaatgttaaaaaaaaaaaagacttaaaatgatccttgaaaaaaatgagagacttggaggaagcagattgagtcaatcatttctatatgatactttctatgtggccctgagaaaataactggagctctttgagccttagttcctttatttatgaagacaggtatgtggcacccacctaatttcctattatggacttcaaataaagtggtggatgtaatagttcactactaaatccgagaaagcacataccaagactgagttgaaacctggggatagttgcttttaatcttcatagtgatgagtggggccaggatcagttcaaaagaaacaattcactaatgtcaaattgaactgtgtgctttaacaatttatctttgggaatgaaacaatttgagaaatgcttctgccttctctcctggatgctagactttgagataacagtatctaaccctggttctgagacttaattacaaatcaaaggacaaattccttatctttggcaatgattagtataaaatacagctttggaggaatgactaacagttaataggagcagatcaatatgtgtctgattattgacatgtggatcaacaagatattatacaagtggattgccctgaagcacgtgattttctctgtgtagccagctactgctgtcagtttggaccaaagtggtcgtcattttgaaaccatcttattgtttcactatttctggagtattggtgctaattttagacacacaaatagactttctgaaaggaagattttctgaaattgtcagatttttttttctggaaactggctctgtagttctccttgtattggagattatctctttgctatttctctgcagtctagactacttgggtacattaacatgcttaatgttgaaagaaacatgtttaaggtagagtcaaagactgttttctattttatcagtttattaatgactatggaaattgcccttcattggcactgtctgcaggaagcagatttactacaattagcatttattgccccttgggaactgatatgaactgattatttgccagattttcggggatcaagtatcagttgattagatttggattatgtaaatgttttacaatctattccaaataaaataagttaaaaattaagtcacatttaccattgggaaattttctgtaaaatataaaggtacttaaattttctaagcatgatttatgataaatatgttatatattaactagactcacttagttcattctgtaaatgattaacctcaaatttgaggaatttgaaaacattttataattttttcactagttttgtttgttttttgttttgtttgacatttgaagtgtattcatgctggaaattcacaaatactttgctaggtttcctatgtggatttaaaaattaagatctagactgaacaagtttatttaaagtacacaaatattgccaaaatgtatttatagtttaatgagctttcattcttatgttcaaagttgttttaaaaattgaaggtagacttgaaaaagaataaaaaagtgtgtcactttttaaagttattaatttttgtttggagaaattcaaggagctttttggttgtttaattctcatgtgtacatagaagcaacacacaactgtttgagcagctttggatgtaacccctctttgttttcttcagtagcccagggaacagacttgtcactcttaagtgctcacgtgtaatcctgtcctccctttcttccccaaggcaaatcagaaataagcttatcagatcatatcttattaacaaagaacaaaggattttgactgaccaaagagtaggaaaggactagcaaaatataaatgttaaatgtttgctgccaaaaatcctagtttgacagtggttttaggtaactaaactttttttgaaagtaggatttacatatttttaaaacatttgcctgaattatactttgtctaggattttaagtgcattagttaatggctttacctatattttatatatgaattaagtacaattgtcactcattattattgtcattgttattattatttgttccttacaagcaaatctttctagcttatatctgagagaagttagagacaattatattatatcctatgtgttttcagtataaagtgttttaacagaaagtataaatagccttctaataaagggagaagtgtttttctgatagaaagtacaatacattatttaggtaattataaggaacttttaaatcatatttgtgtcttgttttcttggttatttttatttgaaggtttttttttttcttagatggagtcttactctatcgcctaggctggagtagctgggactacaggaacgcaccaccatgcctggctaatttttgtatttttagtagagatgggttttgccatattggccaggctggtctcgaactcctgacgtcaggtgatctgccagcgttggcctcccaaagtgctgggattataggtgagagtcaccacacttggcctgaagatgatttttctataaggacaacaagttgttcattatttagagttgtgatagtaggaaggaaataactttagaaaggaagacagcaggctgggcaaggtggctcacacctgttatcccagcactttgatcacgaggtcaagagatcgagaccatcctggctaatatggtgaaaataaaaatataaaaaatactactaaaaatacaaaaaagttagctgggcgtggtggtgggcacctgtagtcccagctacttgggaggctgaggcaggagaatggcgtgaacctgggaggcagagcttgcagtgagccgagattgcaccactgcactccagcctgggtgacagagtgagattctgcctcaaaaaaaaaaaaaaaaaaaaaaaaaaaaaaagtaagagagcaattcccttgtgaaaatcaggcttgcattttcttgaagtttgaagtttaaagtaacctaactttatcacaaaaacaataatgatcccaaatatatttgggaagaaagataaatttttaatccatatgaatagcaaaaacataaacactacaagacgtatgaatgtagtgtttctattttgtttgctgtatgttctgtagacttcctgtgtggctcacattctatcaattgtttttttaaactttcttttcccttggcttctttgctcctacattatctgattctgcttaaggaagagcccctgaacaaagaacagatattaccatctccattctaatatagctgatttctagtaattgtatagcagatgctcgttcaagcacctatttatgtgtattctaacaaaaacatggtattcaggctcagagaggttacagttttttaaaacactttatccaacttactagcattctctttgttttgtttagattgattttactatcatctaagtctcagaatttgctaattaggaggaatgggtggtgatgtctaagtaatctgttgctttgagagtgtttagtagaaactcagacggaacaaaaggagtaagaaggagaaggtagaacaggtactctaagaggacccctagtttaatgccttgtttgccacgtgtcttcccttggtcagtttttcaacaaatgcttattgaatagcaaggtgtgcctcataagtctgatctcttttactatattctctgtttttcaaagactttataactaactttcccaagttggtctgtccacttatacatagattataggttggacaaaaccatctcatgacatagatatataggttcttgagcaatctcaaagaaatgacaaagaaactttttcgtggtctgtgggtgagaaggtcagcaacaatttaaccaatgtgctctagatcacaaaacgtatttgaaatgagactgaaagcagctagaggaaaagtttttgaagagatagtaaggagagaatcagaggtgctaagatagcaacagcatgttaatttgaggtgaaaagtgtcctaattagtaggtagattttggactctttatcagttactatggtggtaagtgcaagcaaggaagacagaggaaattctctaggaacattcataatgcacatatgagaggtcacccatccttgtagtgcgttttggggatggatagaggaatttgctgaattatagaggccaattatgaaaaagaaagtacgtagatttgggctaaataataatatcgatgtaatgagactagtattctaataatgataatagcatgaaaagagtagtggacagctaaatatagacgaaaatatagtaaaatctgattgtacaggatggtaagggtacacaaatatggagatgtgttactagtctggaatgtgacctaatcctgctgatttccatcttttgctcttccagggaagagagatgaggctttccaaaagctgccacttttaagtttacaggagaatccatgggattcccaagtttttatctgttctgtattcagaaatgcaattccttggctaagaaagggtcccctctaccatttgctttagaagaatgaaaactgacccttgccaagagagccagaactaagccttggctattaaaacgaagatatgggacatggggccaacatgtcccagccagatcacccacacatccattaggaatatggggcagctttcaggggtttctggtgtgtatccaggttaacatctagcctaacattgccatgtcagtggaggcaacagagtcatccaagatatgaaaccagaacaaatgtataggtataagccaggcacggtggcttacacctgtaatcccagcattttgggaggctgaggcaggtggatcatctgaggtcaggagtttgagaccagcctggccagcatgttgaaaccctgtccctatctctactaaaaatacaaaaacattagccggtgtggtggtacgcacctgtagtcccagctacttgggaggctgaggcaggagaattgcttgagcccaggaggtggaggttgcagtgagctgagattgtgccattgcactccaacctaggcgtcagagcaagactccgtctcaaaaaaaaaaaaataaataaaataaagaaagaaagaaagaaaagaaaagatgtatcggtattagaacatggaataaaaattctgtgacattaagggttcatggtaatttgtatcagaatgtacatgaaagaaaatatcaagaaggaaggtataccagttcaggatgtgttatctactaaatagtgtgccagaatcctaataggcatttctatttacatttggctcctctgaaccttattacttccttcaacttgtcttttatgaacaacatcttttattagtagacaaaaaaaaaaaagaatttcttatcagtttaggaaaaccaccaattgtcctgttatctcaaggaatgatttttggtggaatgtaccctaattctattttttctcctcagtatctttaatatgtgatgcttacagattcattaaaaaataaatgaatatttatgacttggaattttatgctatcaggaaccatatatgcattttttaactgtaagaaatgaactgaccactactgtctatttccatcagacttgtttcaattaacagcactttgggaggctgaggcaggcagatcacttgagcctaggagttcaagactagcttgggcaacatgatgaagtcccatctctacaaaaaatacaagaattagctgggcatggtggtacatgcctatggttccagctacttgggaggctgaggtgggaggattgcttgagcttaggaggtggaggttacagtgggccatgatcaccccactgtattcctgcctgggtaacagaatgaggccctgtctctaaataaataaacaaacaaataaataaatggaaaataaaaataatctgaattcccactatccagtattaacattgggtggtttaaagcctttcaaatatttacaacttgtacctatatacaaacttttttttttttttttttacaaattaggaaaatagtgtacttgttttataacttatttgttttttatttttaatttttgtgggtacatactaggtatatatatttatgaggtacatgagatactttaatacaagaatgcaatgtataataatcacatcatggaaaacagggtacccatcccttcaagcatttgtcctttgtgttgtacttcagttaatactcttttagttattttaaaatggctatagtcaccctgttatgctatcaaatatgaggtattattcattcttcttttatatatataatagtacctattaaccatatatattgtatctatatggttaattaattatatattatatattaacattatatatatatatattgtacctattaaccatccccacccacctccccactgcctcctgagtacttttcccagaccctggtaaccattcttttattctctgtctacatgaattccatcgttttgattttgaaattccacaaataagtgagaacatgtgatgttcgtctttctgtgcctggcttatttcatgtaatataatgaccttcagttccatccatgttattgcaaatgacagaatcttattctttttttcttttttttttttttttgcccaggctggagtgcaatgcgattctcctgcctcagcctcccaagtagctggaactacaggcatgcaccaccacgcccggctaattttttgtattttagtagagacggggtttcaccatgttggtcaggctggtctcaaactcctgacctcaggcgatccacccacctcagcctcccaaagtgctgggattacaggcgtgagccactgtgcctggccatcttattcttttttattttgtttggctgcatagtactccattgtgtataagtaccatatttactttatccatttatctgctgatgaactcttaggttgcttccaaatcttggttgttgtgagcagttctggaacaaacatgagcgtgcaaatatttcttcagtatactgatttcctttcttttgggtatataaccagcagtgggattgctgggtcatatgagagctctatttttagttttttgaggaacctcaaaactgttctccgtagtggttgtactaatttatgttcccaccaacagtgtatgatggttccctttttctccacaccctcgccagcatttattattgcctgtcttttggataaaagacaggcaataacaaatggggtgagttgatattttaactggggtgagatgatatctctttgtagttttgctttgcatttccctgatgattagtggtgtcaatcactttttcctatgcctgtttgctatttgtgtgtcttcttttgagaaatgtctattcaactattttgtccattttttgattggattaatattttttttcctatagagttcttgagctccttgtatattctggttattaatcccttgtcagatgggtagtttacagatattttctccttttctgtgggttgtctcttcactttgttgattgtttcctttgctgtgcagaaactttttaacttgatgtgatcccatttgcccatttttgctttggttgcctgtgcttgtggggtattactcaagaaatctttgcccagacctatgtcctgaagagtttcccttatgagtttcctcatagcttgaggtctcagatttcaatcttcaatccatttcgatttgatttttgtgtaaggtgagagatagggatcaagtttaattcttttgcatatggatattcagttttcccaggacaaattattgaagagactgtcttttccccaaggtgtgttcttggcacctttgtcaaaaatgagttcactgtaggtgtgtggatttctttctgggttctctattctgttccattgagctatgtgtctgtttttatgccagtaccatgctgttttggttgttatagccctgtagtacaatctgacgtcaggtaatgtggttccttcaactacttttctttttgttcagggtggctttggctattctggtttttttgttgttgttgttccacataattttttttaaatttctgtgaagattgtcattggtgttttgatagagattgcattgaatctgtagattgctctgggtggtatggatattttaataatattgattatttcactccatgaacatggaatatctttccatttttgtgtgttgtcttcaatttcttgcatcagtgttttatatttttaattgtacagatctttcacttatttggttaattcctaggtatttaattttatttgtggctattgtaaatgggatttcttttttaatgttcttttcaggttgttcattgttggcatatagaaatgctactgatttttgcatgttgattttgtgtcctgcaactttactgaatttatcagttctaatagtttttggtggagtgtttatgtttttccaaacataagatcatatcatctgcaaataaggaaactttgtcttcttcctttccaatttggatgccctttatttctttctcttgtcttactgctctagctaggactttcagttctatgttgaataacagtggtgagagtgggcatccttgtcatgttacagatctaaaaggaaaggctttcctcactcagtatgatgctagctgtgggtctgtcatatatggctgttatgttgaggttcatttgttctatatccagttatttgagggtgtttatcatgaaaggatgtataactttatcgaatgctttttcagcagcaattgaaatgatcagatactttttgtcttttgttctgtagatatgatatatcacactaattgatttgcatatgttgaaccatccttacatcccagggataaaccccactttgtcataatgaatgatcttttcaataagttgtttaatgcaatttgctagtattttggtgaggttttgcatcaatattcttcagagatattggcctgtagtttttgttttgtttttggtgtgtctaacttatttgttttatgactttgcacagggacctgcataactagcctctctagctgggcgtttgtgtgctttccagtttttcaagattgtgagcaagttttgataaaaatactcgtctcgcttcggcagcacatagacttaaattggaacgatatagagaagattagaatggcccctgcacaaggatgacaagcaaatttgtgaagcattccatatttaaaaaagaaaaaaatactcctaactaaatctttatgcttattatgtatatttattaggataacttctttgaggtaaaactgatggtttatagggatgacactcttttaatgaatttgctgtaattacaagattgccctccagaaaggatatatgcacccttctaacctctgccccttcagtaacattgagtagtgttcatctttaacttaataggagatacattgtatgttaatattgatttaatttgtatttatagaaggagcacattttcttgttttgggaaaggatgttttctttttcttctttttctcgttccttaatttcccctttttggctaaactttttctatgtgatccatttttttttttagtagataaacatggaagtacagagactaatagaacaacaatgcaccacccagaattaacaaaggttaacatttgaatatttttgctttagcttcttcattaaaaatgggatataatatgataataaagttgaaatattatgagtttccactctcatccactcacctctttccttatccataggcatctactatcatcaatttgatggtattttccagtttatgtttttcatatttgtttaattaaaattagcgttagctgtgactcttcaaaaattcaaattatgagtggcttaaacaatatggatgttgatttgtcacttgtgtaaaagtccaaatagggggtctagggtgtgtatggtcctccacatagtcagcgacccatgtttcttccaacttgttgctttatagtgggttaccttggtctcataatagtagcagccttattccaggaagaacagaaaagggattataaatatactagaattaataattactcatctgttataattaatagcaataattacttattttaatgataatttattcattaactgcaaaactgtatttagttgtctcctgtgcaaataagactgcaaggaacattcttttccatatctcctactccacatgtgtgagtttctcttggtgaatatacctagaagtggaattttagggttttaagggatgactattttttacctatactagatattgcaaaatttttaagctttctctgttagagtatttttaaccacaggtaacagacaatggaatttaaagtggcttaaataaagaaagctatcaatcacctcatataataagaagtccagaggtagaactgctctagatttgggtaattcattgactcaatagctttcctcttggtcatgaagaatcaggcgcagacaaaaccatggccagaggcgtttattcctctatgtctcttttgaagggcaaagaaactttctttagaaatttgtgttagctacattctttcatgtttcattggttaaaattaaatcacatgccaatgcctaaattgattacttgtaagggtctacaagaccatgatgattggctggggggcaaggctaattttgcttaaaaaatatcatcaggaggaaggagatacctgaaaaaaatatacctttaggaaggaagaaggggaaggtgggtgtcaagtcggcaatctgcagtgtctgctctgtctctaaagtggttactgcattcccatcattagtatttgagttattaattgtcaggatttttgtttgttttaccaatctaatgatcaacactttgttgttgtattccttagaattttctgtttctattgggttgtacacctttttagatatttatagacccttaggcttttcttttctttgaagtaccttagctatgttctttgcctgatattctcctaagttatttgtacttttcttattgatttgtagcagttctttacatattcaggataataattacttgtatgtatacttgtgttggaagtttcttccatcagtgaatggcttgtgtttttacatttgtttgcattaaaaatgtttttataacttaaatatttgtttcttgtgtcttattcgaagaaccattttttataccaaagtcatacaggttttttttctatttcttattgaattttaggtggatatcagcctttgcttgctatatcctagcagtttttaaagtgatggatggactctttcaaagtgtctgcaagactaaaattatttttataatgatattaagatgtcatttgccctttcccccatatatgtagaattgggtctttttcaacttttattttagattcacgggtacctgtgcaggtttgttacatggatatattgaatgatgctgaggttcggggtacaaatgatcttatcacataggccctgagcacggtacccaacagttagtttttcaacccttgttcccctctctcccttccttctctagtagttcccagtttctgtgtattcccaggtattttattttgttcatggctattggctttatgcctatgagtatccagtgtttagctcccacttctaggtgagaacatgcagtatttggttttctgttcctgcattaattcacttaggataatgacctctggctgcatctgtgttgctgcaaagatatgatttcattctttcttatggctgtgtaatattccatggtgtatatgtaccacattctctttatccaatccactagtgatgggcacctaggttgattccatgtctttctattgtgaacagtgttgcagaatagaaactggtagaatgatttgttttcttatagatatatacccagcaatgggattgcagggtagttctaagttctttgagaaacctccaaactgctttccacagtggctcaactaatttacattcccaacagtgcatatacaggtcattaacaaaattaacataaaagataccacttgtaacctatcaaattataaaataatgtcttaaatgataactaatataagacagagtgagttatgactctgactaggagtgtaaagtgataactttctggaaatatgttgcaaagaccccactaatccatatatttttaactcagtaatttctgttctagaagctagcctgaggaaactgtaagaaagacgttcagtgtagaattatttaaaagataaaaaagtggaagcaaccacatatccatcaataaaatacagaatcaagttttatctatggagagaattattttgtaaccatttatgtggtttttttgtgatgacatggaaatatattatgtaattgtgagaaaatcagcatataaaactctacatgtcttatgattttaatgatattaagagcaaatttgaaatggaaaaaaggaaagaaactatcaaaatgtttacagtggttatctctgagtattgttatgcatattttaaaaattagctttccaactttttatgataatatatattgttttcactaatacaagtgttattaaaaaggtctggtagagattggctatttttcatttcagccttgagattattgggagtggagagggcccttttatgaaatgaagtctcttatttctttggggagggagtagaacatttggtagtgtgtctttcccgatagaaagagaggaatgtgacccagcagggcctggggcagcagatactaactcagctggatttcaagaacaaccattggatcctgatttagtggaatgcactccagactgcttagtgtcatggttaagggtgctagttttgtagccagagtttctagtttatagcctagttctgccacttgtgagctgaattaagttttgggtaaattacttaatctctgtgtgtgtgtttcagtgtttccatatatgaattgggaataataacactctctgtgccatggagtttttaagagaataaactgaattattgtgtttaaaattgtcagcagagtattcccacataataacctcttactatttttttagtaagttttaataggtcttactattagtggtttaatcagctatctattacctcataacaaacctccccaaaattggtgccctaaaataacatgaaataacttatttagtccataaatctcaatagttatagctcatctctgctccacagggcatcaactgagatggctcacctgggggctggaggatctactttctttttttttttttttttttttttcgagatggagtcttgctctgtcacccagggtggagggcagtggtgcaattttggctcactgcaacctccgcctcctgggttcaagcagttctcctgcctcaacctcccaagtagctgggattacaagcatgagccaccatgcctggctagtttttatatttttagtagagatgaggtttcaccatgttggacaggctggtctcaaactcctgacttcaggcgatctgcccaccttggcctcccaaagtgctgggattacaggcgtgagccaccgtgcctggcctggaggatctactttcaagagacctcacgcacggctggcatattggcgctggcttctgctaggagcccagccagagctgtgtgatgggggtctctattttctccaagtgggcttcttcaggactgtccaggcttccctatggcagcatgtctggatttggaaagtgagcatcttgaacaaaacaggcagaagtgcatcacatttttataacctgtcctcagtagtgacttctttatcctactacttcatggagtactacttccatcatagtcatgaatccatccagatttaagagggaggaacgtagacacttccctgtctatgtgaggagtgttgggcacattgtaagaagagtatgagtggtggaaaatattgtttcagccatgtttgagaaatacagctggccatggcagtctactgaccttttagataacataatatgcttggctttcttatccactaacagcagcaatctcaattctgtgtattagaaccatcttaggactttttactaaatgcagattatgagtgacttttcatttcttttgaatattttctgtatttttcaatgttgaaaacttattactataatgaaaagttttaaatgaaaagataaactttttttgcaatgtatctagatattctacaatctatgaatgtaagatttctatgtagaattttaaaaatctattacactccttctttcttggtttggtcatatttctagtagcactgacctctagaatgaaagaaaagaaagaaaaaaaagattctactcacaaatatttctatgttaaatgtagtggttcctcagggcaaaccttagacaccaaatacagcctataaaactatgaagtgtgatttccactggcttctccttagaactctgggttgcaaacaactgatgagcagctgctggcttttactgctagtgaacttgaacagagagcagtttctattcatctgtcaagaaggacaggcacacaataaatttttgactacatttgatgatacaattcatgcaaataaacttgcaaataagacagtgctctcaagatttcaagaaatggccaaggaggctgttttgcccctcctccccaaaaaactttggagctgccactgatctcacacaaagtcatctctttgaattaaacatgtcttattctgaaagatgccaaggcctggtccattgaaacattcaacttgtctttgcagctgtaatttatttcttctctttcttcccatcaaatgggaaaattgttcattttaaaaagcaaagaccatttaaggtttgaggcaaaaagagaatgaaatatggaagtcaagggtcagtttcaaaaaggaatagtactgtataacaatttagtttacttctaagtggcaactgttgttacatatatataggataaagtatgcaggagtaaatagtggattgaatgtcactgtggtgacccaaaggagtcaatgcaacctctcaagtagattaacttattcttggggacagtttataaaatggcagatttggggctcaatataatttttattcattgaacatatatatattccagtttctatcctaaatacttatattaactcatgaaattctcttaacacccctaggaggtagttagtaccattgtcctgcttttttattttttatttttattttttgagatggagtctcactctgttgccaggctggagtgcagtggtgcaatctcggctcacggcaacctctgcctccctggttcaagtgattctcctgcctcagcctccctagtagctgggactacaggtgcccaccaccacgtctggctaattttttgtatttttggtagagacagggttttaccatgttggccaggatggtctcgatttcttgacctcgtgatccacccgcctcgacctcccaaagtgctgggattacaggcgtgagccactgcgcttgtccaccattgtcctgcttttacagaacaaagtggttaagaaacttgcccaaggtcacacagagttgcactcaggtttcaaaccctggctgacctcttttcacctattgtgctttattgcttcacagataagtttttgaaaaaattgtagtgaggccaggcatggtggctcatgcctgtaatctcagcactttaagaagctgaggagggaggatcgcttgagcccaggagttcaagaccagcttgggcaacataatgggacctcatctctacaaaaaatttaaaaaattagccaggcatagtggtgcctgcctgtagtcccagctacttggcaggttggggtgagaggatcacttgaacccaagaggtagaggttacagtgagccaagatcgcaccactgcaatacagcctgggcgacagagcaagactctgtctcaaaaacaaacaaacaaacaaacaaaaaacacctagattgagagatcatgaataattatctgtaggggatttttttcagagttcacatgcaaaaattaagggtggttattaccaaaaagacaaaagataacaattgttgatgaggatgtggagcaaagagaactcatgcacatttttggtgggaatgtaaactagtacagccattatggaaaacagtatggagattcctcaaaatattaaaaatagaactaccatatgattcatcaatcccaatactaggtatatatccaaaagaaatgaaatcagtatgtcaaaaggatatgtgcactcccatagtcattgttcataatagccaagatatggaatcaacctaagtattcatcaatggataaatggatagcaaaggctgggcatagtggctcacagctgtaatcccaatactttgggaggtcaaggggcaggattgcttgagttcaggagtttgagaccagcctgagcaacatggtaaaacccgtctctacaaacattagcctgacatggtggcacacacctatagtctcagctattcagggtgctgaggtgggaggatcacttgagcctgggaggttgacgctgcagtgaactgagattgcacgactgcactccagcctgggtgacagagtgagaccctgtctcaaacaaagaagggtaaagaaaatgtggaatatatacacaatagaatactattcagctttgaaaaaaaaatgaacatactgtcatttgcaacagcatggattaacgtggagaacgttatcttaaatgaaacaagccagacacaaaaagacaaataccacattatcttacttatatgtgaaatcttaaaaagttgaattcataaaggcagaaagtagaattgtggttaccggtggcttgctgggcacagggtggtggggggtggggctgggggctaggttggttcaaggggtccaaaatttcagttaggcgtgaggaataagttcaagagatctattgtactgtgtggtgactatagctaaataaaaatctatcgtatacttgaaaatcgctaggagaatagattttaattattctacccacaatcagcgtgtgaggtaatacatgtgttaattagctcaatttagccattccacaatgtatacatattttaaagaataatgttgtacatgataaatatatacaatttgtatttaaaaaacaagtaatgtttttttaaaggcaagaaatgtctcagaaagggaaggtaggcagcaaattgatacatttcaggttcattgttcaactttctttgcatctggaagttgagtccaatgggtttggaatgtgggagatgtctgacctgcactgctgtttgtaaaaagaacttgaatgagtcacttcatctctcctgaggatattaacagctgccctgacagccttgctaggttgttggagagagcaaatgaattatcatggttatcaaatcctgttgcaagctataaagacctcattactgttagttattgctgtaatcaggcatcttttcttttagaaaagcatttcaggaatgcctccttttagaagatcacattctgcagtttgttcctctatttttcactacattttatttaatgatacaggtgtgtcaaatgtttagcatggtgcctgccatatgatcacactgaatagattttattaattattacttaatttctagcagaagtcttggatttgcagaagcaattaagggaagatatctcacagaaggacagaagctgccgagtcaagatctgaaaagcagggcttcctagcttttccttgatgtcaaagaccataataatactgaagagagtttggaagtcgaattgctgttttcattctaattttagttttcggtgataatccctttcatttatactatctacttatgtacttatgtgccaaggccattgaaagtggctctttgaggactgtgttaaatgttctgggggcacatctaggtttgatgagaaggaatgtcatgatcactgcctccaggaggtagtatttgccatccctagcctattctagaaagtttataaaatatttttgcttccatttttaaatcataccctcactaccaccctctatatttgccaggggttagtttaccactgtgacgtgaggaaactgacattgtgactcctctttacctctgcatttttctcactagaccatgctgtgatggttttgcccattccttctcaggtttcaggttctgtcttgaaatctagaatggagctggatacataatagatgacccatacatttttgcagaattaaactttaatgaattgaaatttcactcctaaccaaatgatacatgtttaaagataaaagctcaaacttcaaaatggagctgctggtacttccctcattcttcctaaataccagagatttcagtctctgtaatgcatgtcactccaataggtggaaagggtgaacagggtcatttaatgacccgatactgttctcagatcatttttgttagaatggccattggactagggaggtgtctaaaaaccataagggctgtgaacaggatgccaaaaacaagccaatagctgatgtggcacccaatgggaatagggagaaaaagactcagtagctaggcattcttgcttcttcccaatgtacttttctgacatttgggctttttctgttttgcccatagctcaccttaaccttttaattttctttgtctgtgcccagcacaagtttactttctagagcccatttattgacgtctctggtttatctgcacatttcacaatcttttctagctgtttaataaaggtcatgtttatagctttagtattgatggtttgcccagtaggccaagtgtcagcttctgtaatgtccaatagaatcccttcccataagacaaagtcctaagatgttactcaggagtatgagtttttatagatccaaataatgacttttggtcttcaaaatatatcatatgttaataataataacttactacattccgatcattgttcccagcactttcttaatcttgataccaaccaagtgagacaggtacttttattgtcctacttttatagatgagaaaacagaggcacagaagtcaagaagctggtccaaggtctcctagtgattgctggagtcagtatgctatgctacttcccatgtgtgctatgtgtaacacttatgggtcaggccctgtggtagctagcgggattttgcagtgagcaagacagtttttaccctcttgagttcaagagttccctcagagaaccctccgccctcattcctaccattcatgccttaatggagacggcttttaaatgaagcatttgtgtaaaaatttcacagccccaagttaactttgtatagtatggtttaattgctctatctaggtgcatttcagacccctacgaaaaccaaacttgcatccccaggaatctttgatctcttgggctagaggaaaaaataacaccaaaaagttcctttgggaggaagagaattaacgatagattgaagcttattaaagcaatgaattgacacctgtgaatgaaaaccagatgttgaaatctctggggaaaaaaagatatgtaaatgtatacagggtatataatgaaccttaagagcatagataatagtaaaatgtagtaagataggaagcgatgacttttgagtattcttgtttttaatgtaattttttaaacatataagtacatataatttaattattaataatgaccatttaacaaccagctcacaaaatttctgaaaacttaacagttggcttttgagacccagtgggagccgtctgacacctgtttatttatatacacaaagaagttcaattaacattagccctgaagactcatatcactcagctccacctcttcacctggggtttggaggcagatacacttgagctctaactctcactctatattttattaaaactgagacatcaggcaaattactgtttctgagcctccttttattatctgtaaatataatataataattgtgaacaattatcttgtgccaaacacagttgtaattcaatgaatttctcaacggggagatactgtaattcctcattttacagctgtggaaatagaggagtagagagggtagatagcttgccccactgagaagtgaaagaggtgatatatgaacaaaggcattttggtcctaaaacatgccgttctaaccatctcaatatactgcctacgttatcagttatgaagatgaaatgacatagcatatttaatatgactggctcagtgaattctcttcaattctcttttccttcttcctatttagaaaataagattaggggccgggcgcggtggctcacgcctgtaatcccagcactttgggaggccgaggtgggcggatcacgaggtcaggatatcgagaccatcctggctaacacagtgaaaccctgtctgtactaaaaatacaaaaaaattagccgggcgcggtggcgcctgtagtcccagctattcgggaggctgaggcaggaaaatggcgtgaacccgggaggcggagcttgcagtgagcagacatcgcgccactgcactccagcctgggcgacagagccagactctgtctcaaaaaaaaaaaaaaaaaaaaaaaaaaaaaaaaataagattataagattaggaccacaaggtgttgttgggaatgtgtcagaaaaagggaacactgcaatctagtgatggtctcaatcatggtggcacagaaaaatcccctggggcacttttcaaaacatagatgccttggccacaccctgtactaattaccataaatccgaactctaggggtttggggcatgggtattagtgttttttaaaagcttcccaggtgattaaaaggtggttttctacttttagaattcttgataatggtactctcttactcctgtttgctgatcttttccttttttctcataaacacagtaagaagtactacacagaaaagaggtccacattagggaccaccttaatccaaacagaaaaattgatttggatttccttaacaagttactgcaaagcttataggtttgttagtggaagttccactttatgaaggcagattcctgctgatgtagaaatatgtaacctcattctacagtgagctgcagtcatcgtataggatcttacaaaggtttagttttgcctatcatttaatgatttgtgcgctttgtccccatatttagttgtataatttaaaaattattgtgaaatttacatatcataaaattgataattttaaagtgaacaacttagtagctaaggatgtattcacagtgttatgcaaccaccgcctctatttccaaaatattttcatcacctcaaaaggaaattgcatacccattaagcagttactccctattttccctggtcccttctctccttcccttagctcccagaaaccaccaaactgttttctgtttctaagaatttgccagtcaggatatttcacacaaatgggaattgtaccgtatatgacctcttgtattttgctttttttcgttagcataacgttttcaaagttcatttacattgtaccatgtgtcagtagttcattcctctttgtggctgaacaatattctcttgtgtgtccatgtcaaaatttgcccatccattcatctgctgctggacactttggtagtattttgttgaaaactttttttcatttatattcatgagcaatattggtctgaagttttcatatagtgttctgtctggctttggttcagagtaatgctagcttcatagaatgaattaggaagtatttcttccgctgctgtttcttgaaagaggttgttaaggagtggtgttaattcatctaaatgttaaattcttttaaatgttttcaagccacatggtcctgagcttgtctttgatgggtggtttttgattactgacttaatctctttacttgtgagagacctgttgatattttccatttcttctttagtcagttttggcagtttttgtgtttctaggaatttgttcattttatctacattattcaatttgttggtacacaattatttatagtattctcttataatcatttttatttctctaagattgagaaataaagcttagagaaataaaagtgggataaataaatgaaataataatgttcataaataacatacttatattgttataaataattatataataatatttatgtaataatgttcatgtataatagtgtttatagtgtttcatgctataaaacataatattcccactttcatttatgattattgtatattttttacccttttttcttagtccagctaaaggtttgttagttttgttgaaattttcaaagaaccaatttcttgtttcgttaactgtttgttgtttttctaatctccatttcatttatctctgctgtaatctttattatttccttcactctgttagctctgcacttagttttctgttctttttctagttccttaaagtgtaaagttaggttattgatttcagatcattcttttttataatacagattttgtaactattaatttccctctgagcactgcttttgctgtatcccatgaattttggcatgttgtattttcattttattttaggatattttctaatttcccttgtgatttctttggcctaatagttggttaatattgtgttatttaatttttatgtatttgtgaatattccagtttttcttctgttattgatctctagcttcatttattgtggttgaggaagatactttggatgacttcaattttttaaaatttatcatgacttgtttagtggcttaatatgtagtgtatcctgtagatgttccatgtgcacttgagaggaataagtattctgctgttgatggtggagtgtcctatatgtatctgttggatgtagtctgtttatagtgttgtccaaggcctgtatttccttattaatctcatgtctaaatattctatttattgttaaaagcagtgcatggatgtcttccacgattattgtataattggttgcttttccctgcaattctgtcaatttttgctttatatatttggttctctattattaggtgcatatatatttgtaatttttttatcttctttatatatttctacttttatctatatatagtgtcctttttgtaacttgtaactttttttttttttttgagactgagtctcactctgtcgccaggctggaggcagtggcgcaattttggctcactgcaatctctgcctcctgtgttcaagcaattcccttgcctcagcctcccaagtagctgggactacaggcacgcaccaccacacccggctaattttttttattttagtagagatggggtttcaccatgttggccaggatggtttcaatctcctgacatcatgatatgtcctccttggcctccgaaagtgctgggattacaggcatgagccaccacacccggccaacaatttttgacttaaagtctattttatctgattttagaataccacctctggtgtcttttagatatgacttacatggagtatcttttctcattctttcactttcagcctatctgtgtctttggatctaaaatgagtctcttatcacagcatgtagttgtatcaagttataaaattatatatattttactaatctctagctttttgttggagagtcatttaatttacattttaaataatttctgattaggaaaggcttgcttctgccattttgctatttgttttctgtatgtcttatagccttttgttcctcatttgcttctctactgccatattttgtgtttaactttttgaagtgtgcttttttgatcccttttccattttcttttgtgtatattttaaagacttttctttgtggtttgtatggggataacaattaaaatcctaaatttataacaatctagtttggattaatgccaacttagattcaataggatatcaaagttctgtttctatacagttctctcctcatgttaatgtttttatagataacatctttatacattgtgtgtctgataacatacattataattattgttttatgcatctgtcttttaaataccataggaaataaaaagaagagatacaaacaaaaatacaataatactggcttttatttatcatgcagttacttttactagagcgctgcatttcttcacgtgatttcaggttgctgcctagtatcctttttgttaagtctaaaggactccctttagcttttctcataggtcagttttacttatgaatagctcctttgctttttgtgttggttttcctggaactgtcttaatgtttcctggtttttgaaggacaattagccaaacatagaattcgtggttgacagttctttgcagtactttaaaaatgttatttaacttcttctatgattttgataataaatcagctattaattttattgaggatcccttgtatgttggatgaattgcttctccttggctgctttccagattccttctttacccttggtttccagtcatttgattataatttgtcttagtgtagatctctttacagttattcgtcttggagtttgttgagcttcttgaatgtgtgcatttatgtatttttcaaatttggaaagtgctcagccattatctttacaaattctgtctgctgtttctttttctcttctccatctggggttcttatgacatatatgttggtgtgcttgcttgtgttccacaaatctctttgattccattcatttatctttaaattcatttaaatttaaattctttggtaagtttttcatgttagttattgtacttttatttccagaatatctgtttagttcatttttataatttctttatctttactgatattctctacttgtttatacatcacattgctgatttcctttagctctttgattttttaaggacagttgatttaaagtctttattcattaagtccaaagtgtatgctccctcaagtacagtttttgttaatttcttcttttgatggggcatagtttgttgtttcttgcacacttcatacttttttggcttaaaactgggcatataggccacgcacagtggctcacgcctgtaattgcagcactttgggaggccgaggtgggcggatcatgaggtcaggagatcgagactaacacagtgaaaccctgtctctactagaaataccaaaaattagctgagtgcggtggcgggtgcctgtagtcccagctactcaggaggctgaggcaggagaatggcatgaacccggaaggcagagcttgcaatgagccgagatcgcaccactgcactctagcctgggtgacagagcgagactctgtctcaaaaaaaaaacacacacacacaaaactgggcatataaaatatgataacgtattaaatctagaaataagatttttccttctcctctgggtttacttttgtcccttgctatagcatgtagctatttgtttaatgactttttgaactaattttttaatgtagtattgtttttcatgtgtgttctctgaggtctctgttcctttagcctttgttcagctagtgtcttgatagagaataacttcaataacagaaggcaacagagaagaaacaaaagaaaaagtaaaaactttaaaaatcaagaaaaacaaaacaaaaaacctctcctaatgtttacagattggatctttgctgacaaacttcttcaacactttgctaggctatttttaagctctgtcttagccttcatttcctgtttgcattgatcctagagatcatctaaagctgaaagaataagtttttattagcgagcatgggcatggatttttttaaattcttcggtatacatgaatgctatacatgtcctatttcccaaggaaactctttagttcttctgcctgagctttgggtactctactatatgccccaactataatgtttttgtcttaggtagctgtggattttttgtttaccttacagtattttcaaggaatctctgctgcatttctcctctgaaggagtcctcagttagagaaacaaagtaaggtgctttgcgttattccccaagggatttcccatacaggttatagcaaatgtagttttttgcgagtaagattgtctttgcttcctccagaaccaaggaccagggttgcctactggggaagctacctgcagttttgaagactgctgtcaagccaaggagagagttggagcaggggcaaatacaaacatcacatacttttcttactgtttttaagtctcctttatcttttatttttaatattttggtttcagcattttcttggttgctatcaacctgcctattttcaagagttttgttagagttgattctgacacttttgcttgattttgaatatttctgtgggaacacaagctcttggagctacctactccgtcatcttcactgatgtcacttgcagtttactttcagggctttagttatccacatggtataatgtgcactgtccgttgaatactatttcctatttaccttttttctcttatttaattatttgcatatatttattttagaatatatgtactctaggtcttctctttacttcatgaaatctaccacctccataaaaaaagatgcattcaaagtagacttgataaatacttaatgttaaaagattttctttcacatagtttcagatttaataaagcaaaaatgcaatttcaaaaataatctttttgcaagttttgaaaaattctggctgctgaaaataaaattgaattattggcaaaggcaggaatttggaatagaataaatataaacttttgtgatgttaaaacaaattgtttcgttgaatattctttataagaaacaattaccatagagtcttcaagaccttattattagagataaatggaaattaatttatctcagctattatgaaaatgtgattttaaactttaatattaggtagactgctgctcaatagtttacaaacagaggaggtaagaaataattttggataaaatattaatgtatgagttataattgaattatcatgttatatagtctcttttaataattagcagttaatggaagaaaaaagcatgttctcattaataaatataaaaaagcatttaagttaaataaaagaaaaaggtagcttttgaggaaacttcagtctgaattgtccaaatagactgaaaggactttaagggcaaaattttgtttgggtttgggaataccaaaatttaggataaaatatttcttttatccttctttttttgttttgttttaagagaagaaaaaatttacatagactctttgtataccagtgagaggaagtatagcatagaaggccatctaaaggatgaaattcccataaggagttttctgaaccacttatatcaactggtcagaacttagttttaattaaatttgctgggctggggatggtggcaggacaatagcctgttttaaggatagagagccagctttaactttaactttgaatttcctggctccaatccattggtgtcactacttcagtgttatttaaatgcaggattttccatttaatttccttttaagggagataaaaaccacagtttctttttcagaaaactgccaaagagtctccctgtgctttattaagtaacaattgcattttcagtagagaaatgcaatctaagtggtagcacattaaaacattatagtgtaaatgtgcagatgaaaatactaaaaattaaataattattattcatagcagttaattcagttatatgtattttgaactcagtgggaaattgtttatacaacagacttaggatattaaaattaagtttaaaaatttgatttatttttataagacagacaataccaaaactcttttttcccttttatgccttgtattagttataatgtttgctcttacattttgtgactttgagcaatttatacttcattatacttaaaatagaaaaattttaggccaacttaattttttgtaagttttataaataataacttttgccaggtgtggtggctcatgcctgtgataccagctctttggtaggctgaggtgggaggatcacttgaggccaggagtttgagaccagcttaggcaacacagcaagaccccatctctacaagaaatttttaaaaattagcaggatgtggtggtgtgtgcctgtagtctcagctactcaggaggctgagatagaggatcccttgaatgaatccaggagttcaaagctgcagtgagtcatgatcatgctattgcactctgcgctgagtgacagagtgagactccatctctaacaacaaaaaaaagaagaaataataactttgatcatattttgtttgtatccatttgaatatctgcctttttatttttagtaatagagattttaaaatatagattattttttaatagttgacctcaatttacatacttgaatagtgagcatttactatattaaaattattagaaatcaagtgaaggaattaagtaactaaataaagtgacttttaaaatctacctgatatttctgtgtttatgataggctttaaagaagccattgctagattgccttccatgaaagccatttgtgcctaggttctctcttccatgattgctcttttcttttcttttctttttttttgaagaatgggaatgaagattcccattcttcagattttagctcaggcatcaattactcgagggccttttctgacctcccttaccacattagctccccccaacccctctgtatgttctcataacattatccttctcctccccagcattcataatagtttctagtttgacttctttgtgattatttgattaatgtctgtttccttgaccacgttttcctggtccgtgagggcagggaccttgcctgattttgcttatcatcataattcttgagccctgcataggcttggtccagaagcagattccagtgagtgcttgtgtgttgtatgaacgctgtactcggaagtactacatcatgctgtcctattttatgctgataaatgaacttcaaataattttactagaaaaaacatttatttattatatgtatgcaaaataagtcttaattaggaacattaatacagatatcctaaataaaatattagcaaattatatctagtagtgagcatatcaaaataataatacagagagtaatactaagactgtttcagaccagtaaatgaaataatgactgtaacatgggaataaaatatagtttggagatttgatagaaaatgtccatataaagtcttttgtgccttgtgtctttttagtggtatatttttggttaaatataaccaaaaaacaggtatatttaaccaattttcttggttaaaaatgatcgtattctaaatatattaaagaagggatatgtattaaattgtttctttgcttttctgattcaattcctctcaccgttacccccagctctcagccttccatctccccattcctttatttcttagttatggtagacttccagacttccgataacacattcctgttttttttggagagttccactaggcatttctccacatggctatctacttaggctttaaaaaagtttctatccttggatttgttttcatctagtccatatccaggtagaaaaagatgtgatcaaaagatttcattggttctgtttgctgtgtcttctttctggtctcgccttattctaccatggctttataactgtgtgtcccagtgtggtttgttttgaagctttctcctccctggggcatactgtcaaaattcatttatagtgacccacacttagattttcttttgtaagtcttcaaatattttgccattccaaacactgccttaaacctactaaagactctctatagtctctaagggacacatgggagaaacatcactggtatacccttcttgacagatatgtaggtgaaagataagaaaataaatcagcaagtggcggttgctctttcagcagccctgctttctcagactttccaaactaccaaaatgaaaaaaatacagaggaaatatttagtgcccttgcttttccatgtgattatatatctggtaaaatttggcatatataatatgtatgtttaatttccctcctatttttaatatgagatgaaatgtaatacatttgaattatgacaacatcaagaggttatttagaccaaaataggttgtattatatacaaaaataatggcaaatgttatgaattgtctctagtatttttttttaacgtgtgttttaaaattgaattggttgggagactatttgaatgtgctttacttatgtggaaaatatcatcgtttactatttttctgcagatccctcactctagcccctatacacataaacaccaaataatttgcttccattgagttagcataaaaatcatcagggcttcaggataaatacccttaaagtaatgcctcagaatgtgcctttttgtggaaaaggttaatctagcctattattggcatcattagaaaatcttgaaaatagaagttcacagtttctatgtgaagtgctgcattaattatgcagcgagagtacacctaaatacaggaggtgctcacatttaggagtagtagccacagttacgcggtgttacactagctctacatttgcacacatgctccttgttttgtttattataggctttccttagagaataaagtgttgcaaataaatattgcatgtgtatgtaggcagtttttgtttaataggtattagagtaaatgactgtgaatttgttcctaagaatcttctgtgtaaaaagagataattttatcatcttatcactttatctctaacattaaaatggtaatctttgcatgacattatttacttgcgattgtgtagaccctgaaaatagtgtatattatatctataaattattgtaaggaatattatattactgaatgttcaacactaattatacttttatctccaacttctttagagcttaatgtattgatttatttacacttatagcttctaacaaggtatattctaaaaagtttttacaaatcaaaaaatttaactagtttcttaatacacaaaaagcctcagtacaaatgacccgatgaccttaattcccaggaaactgtcacattacttctttacccctttgtctagcttaacaatgtgacccaaaatactgcggagctttaaagtttctcagcattgtaaggtcaagctttggtcaccatagttacagtttagatctgcaagtcagaggtcaaatagattaatgatgtcagacacatctttaagtggttctaacaccacttcaccatgcagtaaacagctgagcatattcgatatggcaaaggtattcttcagtcttgctaataagaatatctttggagatattctttttctgatagaaagatttttttataagaacttgcaatattgggctgtggcatcagcaataatagttggcttttagatttgtaatatcagatgcatattgaaaagtatattaaatagctcagatttacacttttctgcacgtctgtgttttgtctgtcataatcaaattgatcatccacctatttataaataggtatcctcactcccctattaatttatggctaaccatgacagtggaccgaaaaaaacaagctttttgattaggagtttttgctttttgcgtgtgtgaatggcacatctcttttctcccaatttgggtagtatgcgctttaaacagaattatttagaaaattgtgtttgggaaatctttctcacattagagagcaggtaattatccatttgtattttatatccaaatacctttatttatagcctaggactctttataaagatcatgggttgtatattcactttttttgtcctaaaaggaaattatttcctcccttttgaatcagaatggaaggagaaaaaagaaactattttacagtgaacgttacttctagaaaaattcaaatgttattttttacaaataaaaaatactctatagataaattttaatcaaaaatcacagaaatacaaataagacaaaaatattaagtgaggtgaaattgcaattattaataaaatatatttaagcaaaaacaatcatcagaattttactatagaatatatatatttaaagctttgccagtatggaattttgcagccagtagacagaattatgtttaagcagtaggcttaggttaagctaaacattaaaggataccctgtttctgaaggttttgtttcccatgtgtattttgtgcagctgtaagattttaagcttgctggagcatttgctcttgatcacatactataaaggtagacaaaggggagaacgaagaggtttggcagctgggaggtgttattatggaatttaatagcaaagaagatgggggttggggcttttctaggtgaaacagagattggcagctgggaggaggaaataagtcctggagtctgagaagagctagtagttcagttgcctgtgagtttcaaatgacaagctagctttcatgtgaatgaatggattgtctccggttttgcgttcaattcaatggaaatcactgccttgtagatatcgtggaaaccaacaactcagcaaagacattaattgctgacctgttttgcagcacttagggccattggttcaacaaactgatggagtattctgtttggtcattatgccaggagaatggcaaatcaatatttaactaccttttgaagaagctacaccactgaaatgctggttttgtataaaactgtttacacataagagtgtcctgaaatgcaagaaaaatgattttattctaaatgtagaaaaattttgtaatcaaataaaatatcaggttgagttctgactttcagaatctgaaatagtattatttctgtaaaaattgccttatgccttgcttttagatttcttgctcctgatgcattgttaaggtgggtaaaccaaccaatacttaatgtctaaatatttatttatcaaaaatatatgaaattggagatattacattttatttactcttcttccttaaagtctgcttttcttgtctacttcctatgcctttttatttaaattttttcaatttacacctttacacttttgctagtgtcgtgaccagaattgtacatatattgctactgtagtgcattagtaatagtttccagtccttggtgcacatgaaaatcatgtagtgaacattaaaatcacctgagcataatgcccagacccacccaagaccagttgaaataatgtagtgaaaagaatgcaccctgtggggatgggtgtagtggcttatgcctataatcccagcactttgggaggccaaggtgggaggatcattgcgccctggagttcaagaccaacctgggcaatatagtgagactccgtctctacaaaaaattttaaaaacattagccaggcatggtggcatgtgcctatagtcccagcttcttggagggctgaggtgggaggatcgcttgagcctgggagattgatgctgcaatgagctatgatcatgccactgcactccagcctgggtgacagaatgagagcctgtctcaaaataataataataataataataataataataataataataataataatgtaccctttgactctttggaaccatacttccctttggctctggttttctcacataatagccatgtgatattgggaaagttacctaacctccctgaatctgttttcttatctataaaaggcaataatattaatactaaatttgaaagatttcttgtgaggattttataaaatattggcataacttccagcctaatccctggcacataggagacatccagtaaacaataataaatatcactgtctccaattagcttgctgtgggaccttgagcaagtcactcctagccttttctggccccatttctttacctatataatgcagctgtaatacttgtcaatctcagagtgcttgtgagcatcaaattacagatgtgtgttgaagggctttgaagaatagagagcaatatagtaaagcaagatgtagcttgtactcttattgctaaggctcctagttctaaggctcagagaaaacaccatcaaaatttgaaactgtttgtgggcattcaatgcttcatttatcattttctcagaaggtttcctgggatgctctaatgagttgcagaccacaccatcactcctgtgttattgaatacttagagtgacaatatccatgaagatttttcaccaccttgtcctgtcactgtttggaatttgtctcatcactatctatcatatagaattaatgcagacttgaggattttccttagctttttgcaaccctgtgcatccctcttggctacaaatacaatttctgtagaagagacaaatagccttgaggctgctccctgcctcctttctgagctgatcttggtatttcttcacgtgcagatctttttagaagcccaaggagagagtcagatgccaactaagttggatttggctagaattgttcacctattagcattttgctttacttaattcacatttgtatagcccttagcatgttctcttatacttacagactttttttgcaatgagtataactttatgttgttaattcacttttctgtggatctgtgtcacatataaagtaccatgtcaaatattgttagagcttagtagttaccttcgagtctgtaaaccaacagctctgtgattgaccagaagtcggggctccaagtaatagaatttctttgttttccagtagtattggacatcagtccatgatgtgcattcataagagtgcaggctgtacctgcagtgaaataattttgcatgcattttatattttacatagcatatatagtagtggttctcaaacttagcatgcatcagaattacctggagagcttattgaaagacaaattgctagaccttacctccagagtttccatagtttattagttttagcgtgggacctgagaatttgcatttctaacaagtttccaagccctgcaactgctgctttggggacaataatatgggacccattaatatggtgagtgctaaggtgcactacacagattcccttttgagagtagagcattcatttcctaactgcaaggggtactggctgtcatggtttccaggccctctgggagttgccctcagttgatgggcactgcctcacttaaaactccatttctgtccctagttgtagctcacataaaatgacaggttaatgcagggagtacaaaggcccatccttcttgcttcagttcaggataactgaggggccaccccagctcagaggcctctgctgcaattgcatcacagctcagcttttctctacttaatctctcttcccttactcccaagagcactctctgattaacctgtgtctcaaagtcttttccagagaatttggcctgcagcagtaggtaataaaagagagttgtatttgttaagcacatatctgacagtaattaaatatcacaactccttcttgtgtagaagcatgaaggagtttgtggtggtttatttggtaatccatgaggccggagcccttaactactatctctcctatgcttcagcatgtcagtcctcctctttttagacatatttggctattgtcttccttccagttcatcagcattcttgttgcagaagctttcccacaatagccatttttagagtacacatttgctccatttcatttacaacaaatatttttcaagacaaattccatgcctctcatgaagcaggttgttgttcttcagtgggttagaagtgggatgattcctccaaatctaccctagaatctcagatgcttttctccgagcactttccccaataataataatgactagcattagtgcttcatatgtgccaggtacttgactaagtactttagagatattaactctttgaatcttcataacaaccctatgaagaagatactattattcttattttagaaaacaaaacaaaacaaaatgataggttaaataacttaccagggtcgtataattagaaagaggtggagccacattttaaatccaggaagattggctccagaatctgtgcgtttcacctgtatgatgtgctacaaattttcccatctgtgttatcaggtggcagttatgacttttttgttgacataaatttttaacagctttattgaggtgtaatttacatataatacagttcacccatttaaagtatacaattcgatgggtttttgttcattacataattaagcttttaattgtaagaaatatataaataaaatgagctattttaaccatttttaagtatgcaattcagtgacaataaatactttcacgatgttgtgtaaccatcagtagtacctattcaaacctattttattagcacaaatagaaaccctgtaatgagtaaacaataattccccatttttaccttaccctcagcccctggtaatctctaatctactttctgtgtctataaatttgcctgttctaggtacctcattcaagtaggatcatacaatattcattcttttgtgtctggctcattttgcttagcacaatgcttttcaagtttatcaatgttgtaccatgtatcaaaatttcactcctttttaaggctgaataatactctattatatttataggccatattttgtttatttattcatctgttggtagacacttggattgtttctaccttttggctatgatgaataatgtggcaacgcacattattgtacaagtatctactttcaattcctttggatctgtacctggaagtggaattgctgggtgatatggtaattctatgtttagtttttaaggaactactttaaaaaccattacattttctatagtggctgtaccatttacattcccaccagcaatgtatgagggttcaaatttttccatgtcttcaccaacacttttcttctgtttttggttttagccatcctagtgggtatgaagtgatatctcattgtggttttgattggtatttcccaaatgattaatgatattgagcatcatttcatgtgcttatttgctatttgtatgtcttctttggagaaaagtgtgttcaagccctttgcccattttttagttgggtagagttctggatatttaacactcatgtgatatatgatttgtaaacatttttcccatttaataggttgtcttttcactctcttgagagtgtccttcggtacacagagtttttaattttgatgatatccaacttgtctattttttcttttttgtgtgtgcttttgttatcctatctggtactcaattgccaaatccaagatcaagaagatttgcccttatgttttcttctaagagttttgtagtttaaggtcttatatttaagttgttgatccatttggagttaatattagtatgaagtgggagtccaacttaattcttttacttgtggaaatttagttgtcccagtgccactggtggaagagattattctttctctattgactggtctcttcatacccttgccaaaatcccattgaccatagatgtgtaggtttattttccagactctcaatctgtttcatttgcttatatgtctgtccttatgcctccattatactgctttaattattgtacctttatagtgactattgaaatcaggaagtgtgagtactccaaccttgttctttttcaaaactgtttttcctattcagggctcttttagaatttactatgttatgcttttgtacttatcagtattcagtatttatttgtccaggcttgtattttctcttttattttgtattcacatagtggctatcaccttagaaagatttctttgcaagctgttagctaatagttcatctcctgatttataactctgctagtacaagtctatgctttcttaaacacagttccctaatccaaaattaaaacctgtcctgaccagaagctttttggaacagagactgatctggattgatataaggttattttgccttttaaaaaaatcttacctaatatgaatattcatatcttttacagtagaactattcatatatttgaatagactaagctatctgagaccttacaatggatattatatattgcatgtaaactgtattttggtttatttcccttattaaagtgaagtgattctaaatcttaaaacacattttgccctaaggatttcaaatgagtgatcgttgacctggatttttatttttgagatatatcaagaaaaaaatttccaatgaaaatatgataggtcctgtgttagagtagttcttataaaatttagtgatctttgttatgatctttgtttcagttgttatgaaagaatagttgtggtcaggtaaatctttgtggagtaaagcttgatatattgggaagaactttttactaacattatttatcacttacaaggaaccatgcacattataagaaggaagatagtagtagcagtaaaaaatagcagtgagcggtgtttcctatatgaatgtgttgcatgaagaatatgtgtgcttatcccttcatctaagaacagattctttgtctctattatgtttacaccaaaacccaacactaagattttcttcaataaaaagaaaaattctaaattcagccctcctactcccatcctttgataacactctctgccttgactggcatcaagtctacttgttgaattcacactctcaagaggacaggaagaaagacagacagataagagagacacttgtctcaatcatatagtttcatgaactaacaggtttttgaagtcctggctctgaagaacatggtcattaggtttccaaaatcaaacttgggcaataaaaaggatattgctttgtttgttttggtaccacatatactataatgggattgatttttttttttttttttttgagatggagtctcgctctgtcgcccaagctggagtgcagtggtgccatctgggctcactgcaaactccgcctccagggttcacgccattcttctgcctcagactcccgagtagctgggactgcaggcatccctgccacgcccagctaattttttgtatttttagtagagacggggtttcaccatgttagccaggatggtctcgagctcctgaccttgtgatccgcccgccttggcctctcaaagtgctgggattataggcgtgagccaccgtgaccatacaggattgatttttgaaaggttaatctgggccaggcgtggtggctcacgcctgtaatcccagcactttgggaggctgaggagggtggatcacctgaggtcgggagtttgagaccagcctgaccaacgtggagaaaccctgtctctactaaaaatacaaaattagcggggcgtggtggttcatgcctgtaatcccagcgactccggaggctgaggcaggagaatcgcttgaacccaggtggcggaggttgcggtgagctgagatcgtgccactgcactccagtctgggcaagaagagcaaaactccgtctcaaaaaagatataaataaataaataaataaataaaaggttaatctgaattcttttttaggggtgacctaccgatttgccaagtattctatgttttcaaaaaggcagcctgagaaatttcctgacttcagttattcttgaaccaccttcagaacttttaccataactgagtaatcttttatgatctttcatgtagtgctatatttgttatcttgcttaaaaaaaattgcatttaactgtcgtaaaagaaaaaaatcaatattttccaaataaatatgtaacaactaaaattaaaaatgtacatatgtttgctacctaaaatcacctcagaaaccactggaaacaaatgcaccacacttttgggaacactgccctaacgctaagtctcaaaaaattgatgcgttcttcaagaggatgtaagaattggagggaaaagccacaaatttttcttttaagtctgggattaaaaatgcattcttgctttcttagtttaaaaacaaacagctaagtaccaattgaagggaccaccatggaagtccacatatagtttctgcacttgtcattttatagaagcaatctctacatctccgctgccccagactgaaaatttttagagcagtaatttgtcataaccgttttttgtttttttttttgctttttttttggaactccgtgacgataggaataaatagtaaacaaacaaacaaaaacttgtgcctcttgttccttcgtgaacactgaagttgtgaataaaatgataatgtagagtttgtaaatattcaaatttggacttctgtctttcatgttaaattgccctaggcacttggactcaatttcagacattagtcatctgtaaaatagaggactgacgatgctagccattgatgccaaagggatagaaagactttatgcatatcgagttctagaatgacatagttggctatgtaaatcagtttgcctgatttatcataacagtgcatttaaatacaatgttcatgaaatattacaacttgtaattagaaaattgatgttggttagagaaattgtgttgactttgtcttttctaaacacttcagaaactttatttattagctttagaggtagatccttcaattaagctgacttaaagaggtaaaatgaggttattgttagaaataaaaaccaatttttcattaagttcaattaagttcagtttctcctttattatgcttgtatttaatagaataatttatgtggtatttccattaaatcatttaccagggttttataacaatatgttactagtgtttggaaatataaatacaaatctcttataattttcaatttgtgcttatattaaccattcatttcttaagctttgatcatttaaatgctttatttactagttttcatatgcttcttgtaaacctagtctcacattaagaggatgcttaaaatgccaaaatgccctggtaaattaaaacgaattcatcgtatttcttacattacttaactctgatgactacagtctagttgatacttgtaggattcaaattcataaaacctgagatattcagatcaaggagaggatagccattgggaaatgagttttttattcttatggaactgaaaaatgcggtatcacttgaaattattagtctaaagtttgccttcacgtgactaatattgggaaaaaaagtttttaagaaaactttggaaaatcaacacttttaaaattttatatttggcaccagacataattggcactaagaaaggaaataactaaagttgtgttaagataaatacaaatgttttgtttccatcttaagaagggtttttgatgtcctctggtgtagatatttactggagagaaggctattgccaatctacattccattgcagttgattttaaaatatagagctaaacaggaaatgtcatgagtgatgtgaccatctgccaagtgtaaatggagtctgagcaagtggatgtaatctgtactaaacaagcaaatgcgttggagtacagcctgaaagatttttaaatcatgaagctacaagcccaatatataatgtttattttacatactagtaattcttgtgcaattgggtttattgtaactcttgtaacaactgtgataatttttgctaagtgaaattaaacagcatcttattccagtttcagagtttccatctgatatactttagagtgcttggaattctttggtagttcttttctgaaatccttaaagttctttccctgccaagaaacctgttttcacagtaattataaatcaggaatgcaggtaagaggaaagaagaaacacaaaagggtgctttatgtaatcccacccctctgctctgttcaaaggtgccaaaaagaaatcagggattgttaaaactcatactgaaggatttatagaagccatcaaattggggacaagttacaatgaaaacttttcattgtaaatgcactcagctaacagcatgatatctcattttaataatcaatggagaaaaagttctttcaggcaaagtgtattctaaagtgatttttttcccttatggaaacatagatagaataatcatttaaataaagctttaggagtaaaatgatacactattattttagttatacatgttatatacatttttattgaaatgtagatggctacacctttatcaaattacagttttattgtttcagtgttgtttacattaacttccattaactctgttgtgattcatagtttaaaatgggccacaaaaattacatttatcatttcacaaatttaaaaaagtatcaacgtcgggctatcctattcctttaatggaccagtttaatgcttagtaacataaccctttaaagtctacatgtcaaagatagcatttttacttgaagaaagtaaacataaaagaactttaaagttttagtatctgtttccttaactgattttaatggacttccaaaacaatcaagggcagtgggtggcctcttacttgcagaagccaatttttaagtgcatgtgtttcttttccatgttgacctcttgctgggacatatttgttgtcttttaaaatgatatttgctaaattagcttattgaaatgctaaatcatgatatgttgcttttcagccatcaatttgaaattccacgctttataaatttcaagtgatttaaaaacactgacttttatattcatgctcagataacaactgcatattacaaatgacttgtaaaggtgtgtggatcttccaataatgattgtattacttgcatgttattagcattaaagaacatgtatcatttacttattctttcatgcaaatgtattgaaggcatgtacatttattgaaggactgctgtatgagccaatacagcgtatttttgttaggtacctaatttgtgtgaggccctttgttaaatgcacttaatgccatatattatttagttttcatcataactttgatgtagtatactgtttttatcttcatttaccaaatgaggacatgaagacaataaagagactcacccaagaacatatttttaggaagtggtggtttaatgatggaaactctcatctgtctgactttatgtacagctatggtgcacagtagcagtctataaaatctatcttgtagaattcatggttttctaaaatactactgtggtgatgatagttttctctctattgaattctgccatactctacccacagattctgctttctcttctctgatggcaatatagtttggatatttgtcctcatgcaaatatcattttaaaatgtaatccccagtcttggagatgggacatgatgggaggtgtttggaatatgggggcagatcactccttaatggcttgggccatccccttagtcaaaagtgaaccctcgctgctctgaattcataggacatctgatcatttaaaagtatgtggcacctcttttctctctctttctctctctctcttgctcgcttctgcttttgccatgtgacatgccagctccccttttgccttctgccatgattataagtttcctaaggtctcatcaggagccaagcagatgcccagcatcatgcttcctgaacagcctgcagacacatgaatcagttaaacatctcttcattataaattacccagtatcgggtgtttctttgtagcagtgcaagaacagcctaatgtagatggcttttctctgtctcctttgcttcaaatgcagagaggcagtactagagacagaaactgcataaggctatggccttggatgacatcaccaggagtgtgtgatgcaaaaatcgggttgaggctagaaaccggagaacaccagtaatagaatcaaaattatgctttaaggacatgaatctaacagcaggcgtatctccttattgatgttctctgcttactcatacatcattctcctgaatttcttttttgtccatagttttcttcagctttttcaacataagacaattaatttaaagtctttttatagtctgtccaaggctaggcctcctcaggagtagtttctcttttacctgtaaaacagtatgaatgtgccatacttttctgtttctttgtatgctttgtaattttttgttgagaactggacattttgagtatcataatgtagtaagtgtggaaattcttccccctctccaaggattgctgttgttaacttgatgaaagctgcagttgtccatttgtttaacaagttttttctattttttttcaaaactatattctttgtcatgtgtggtcactaaagtctctgttccattatttttgcagtcagccagtgatcctacagagaattccttgaatgcctagatccaataagaaaatagaaaaaagtgtctatctttttaagttcctttgacagctgctttagcccaatagggttgaaagaatggccagcctctgtgcttctgtgccggtttctcaatgaacagccaagcatataaaaacacacaagcacaattgttggaggacaacgtccttattgtccactctagcaccaacaagccataccaagtacatggtcttatctccctatggctgccagcttggagctggggctaaaggatggtagctgctttgtgaaatgccaaaattcattgaaatttgccatgcctctttttccctttacactctcctcatgttgcaagtgtctcaccagacttcagagtctgaaatactatagtttattctgacagttcttgctacctcaactgatttcagtggagacatcaattcttggagcttcctattcaaccgtcatctgtgacataattctattttccttttttccctttggttcattttaaaatttctttctacttttttttataggtgacttttatgtaagtaggtttttttttttttgagacagagtcttgctcagtcacccaggctggagtgcagtggcatgatcttggctcactgcaagctccacctccagggttcatgccattctcatgcctcagcctcctgagtagctgggactataggcgcctgccaccacgcccggctaatttttttttgtatttttagtagagacagggtttcactgtgttcgccaggatggtctcgatctcctgacttcgtgatccacccatctcagcctcccaaagtgctgggattacaggtgtgagccactgtgcccagccttatgtaagtagtttttattaatttggaattttaagtacacttgactctgaataatgtggtagttgggactctgatgtcaccccacacagtcaaaaattcatatatgacttgattttacaaaactttattaatagtctactgttgaccagaagcattactgatactgtaaacagttgattaacacatatttgtatgttatatgcattatatactgtatcgttgcaataaagtgaaacaaaatatcacaaagaaaatcatgaggaagagaaaatacatttacaatgctgtactttatttgtccgtaccataagtttacattgccttttcagaaaatgaattgtctgtcagaactagcaggccatctgcagccgcagacctcaatctatggcacatctcaagcaattctatttttttttaatgttgtgacttctctgcttcttgcaaggacttccggcatcaccagtggcattttatatgggtcccatggtggttattcaagatttatggtatcacactaaactcagtgaaaaatacatgagaactgagacacagagagagagagcagtttttgtttttcatttttgagatagagtctcattctattgcccaggctagagtgcagtggcgtgatctcggtccactgcaacctctgccttctgtgttcaagtgattctcctgcctcagccccctgagtagctaggattacaggcaccctccaccatacccagctaatttttttgtatttttagtagagacggggtttcaccatgttggccaagctggtctcggactcctgacctcaggtgatccgctcgcctcggccttccaaagtgctgggattacaggcgtgagccaccgcggctggccatcggccaattattattattattatttttttaaagagatagagaccagcgtagccaacaggcgaaacctcgtctctactaaaaatacaaaaaattaaccaggcatggttgcccttgcctgtaatcccagctactcgggaggctgcggcaggagaatcgcttgaacccggcaggcggaggttgcagtaagctgagattgcgccactgcactctgacctgggcgacagggcgagacttggtctcaaaaaaaaaaaaaaaaaaaagacatagggtctccgtcaattgcccaggccggagtgcagtggcatgagagagatcacttttaccatgacgtgcaaattatgggagagataaactgttcacatcgagatgattggccacactatgttttaagaagatacttgtaacatttgagctcaatgcaggggcaacgggagctggctatgaaattatgataatggtacagtgtacactacagttaatactgcatttttacatttgcttatatttctctcaatggcaaatggcaccatgtacaatctattagtgttaaattttaaccataagcatacttcaaaataataagagccatatatgacaaacccacagccagcatcatactgaatgggcaaaagctggaagcattacccttgaaaactggaacaagacaaggatgccctctttcaccacttctatccaacatagtactggaagtcctggccagggcaatcaggcaagagaaagaaagggcacccaaataggaagagaggaagtaaactatccctgtttgcagacaacatgatcttctatctcaaaagcatcatagtcttagcccaaaacttcttaagctgataaaaaacttcaacaaagtcttaggatacaaaatcaatgtgtaaaaattactaacattcccatacaccaacagcagtcaagctgagatccaaataaagaagaaactcccatttacaattgccacaaaaagaataaaatactagaaatacagccaactagggagttgaaatatctctacaaggagaagtataaaccattgctcaaagaaatcagagatgacacgaacaaatgggaaaatattccatgctcatggataggaagaatcaatataaaaaagaccatactgcccaaaccaatttatagattcagtgccatttctattaaactaccattgacattcttcacagaactagaaaaaaactattttaaaatttatttgaaaccaaaaaagagccagatagcaaaggcaatcctaagcaaaaagaacaaagctggaggcatcatgccacctgacttcaaactacattacagggctacagtaaccaaaacagcatggtactggcacaaaaacagacacatagaccaatggaacggaatagagaacccagagataagaccacacacctttaactatctgatcttctacaacctgacagaaataaacaatggggaaagattccatgttcaacaaatggtgctgggataactgactagccatatacagagattaaaactggaccccttacttataccatatacaaaaattaactcaagaatggattaaagaacttaaacaaatgtacaagaaacaaacagacaaccccattaacacatgagcaaaggacaggaatagacacttttcaaaagaagacatacatgcaaccaacaatcatatttaaaaaagcacaacaccactgatcattcaagaaatataaatcaaaaccacaatgagataccatctcacaccagtcagaatggctattattaaaagggcagaaaacaacagatgctggcaaggttgtggaggaaaaggggcacttacatactgttggtgggagtgtaattagttcaacaattgtagaagactgtgtgatgatttttaaaagacctagagacagaaataccatttgagctagcaatctcattactggctacatactccccaaaatatcagttgttctgttataaagatacatgcacatgtatgttcattacagcactagtcacgataacaaagacatggaatcaatctaaatgcccatcaatgatagattggataaagaaaatgtggtatgttacatcatagaatactatgcagccataaaaggaacaagatcatgtcctttgcagggatatggatggagccggaggccattatccttagcaaactaacacagaagcagaaaaccaaatgcctcaagttgtcacttataagtgggaactaaatgatgagaacaaatggatacacggaggggaacaacacacactggggctaatcagaagctggaaggtaaaaacagagaggatcaggaaaaataactaatgggcactaggcttaatccttgggtgatgaaataatctgtacaacaaacttccatgacacaagtttagttatgtaacaaacctccacatgtatccctgacttaaaataaaaattaaaaaaatttagccttctataagagatctgtgtatattgtagcaacatggatgcagctggaggccattatcttaagcaaattaacccagaacagaaaaccaaatattgcatgttctcacttgtaagtgggagctaaacactgggtacttatggacataaagatggcaacaatagacactgaggcctactagatgggggaaaggagggaggtggacacgggttgagaagcttactattaggtactatgttcactaactggatgatgggacatttgtaccccaaccctcagcatcatgcaatatacccatgtaacagatctgcatatgtactccctgaatctaaaataaaagttgaagtcatttaaaaaaattaagttttctgccttaggaatgcgacttctttttttttcaaagtaaaaataacctccatgagacttttcttttaatttcatttgttattctattcccatagaatacatttttatatttcatcaactccatatagactttctgagtcctaaatggaaactgagatatcttcaactagataattgaacttgatatatttcaagaattgttatgtatttcaaaattttacagatacaaatatttttatactagttccttttgtcctccctcccttccttctttcctttttcctctctccgttctttcctccttccttcgttccttttattcacatattacatacataatatcacttgtatgtgtaaatatatgcagttagacttttctgaaactttatgtgacttcaaaagattattctaattcattatgtagatcaaaaagctgatttcctttgagagggttttaaatattataaatgacttagtatgcagaagctggactttgccttgttatatatgataattaaatacttgatttcaaaatatataaattaagatggaaaattatttaaagattgtgtgaacctattattttaaagttacttaaaaatataatttctagtcatcagaaatattttatggttttgccatgagttaaatattagtccaaaatgaatctacattttgttataatgtatatgcctgtttggactgtctgttcctaaatttcattctccccagctctgtagtcccttagctctattatgtggctcccaatggagtcccaccttaggtttcttatattgacggcaacttggatgcatgcctcttaagctgacccatgcctgactctgccctgtgtatgaatttgtgtctgcttgtagatctctgcagtatagctctgggtcagaagcatttccatagttaacctcaagcctgtgcctgtccagactgtctgtggtacccatggatctctagaatactaaaggcttcactgacatgttgaatccaaactcaccatatattaagtaaaaccaggttgagatcttaaaatgtgtttatcctcccaacagtaagctttttagacccgagaaagtggagagatataagagagagattatcattacagtttagaggagtgtatctcattgaaatattgttaaatgagagctgatcaaaactaagatatggtttcacaatacatgtgaaacacatttaggtcaggagtttagaaaacttctgaatgagcatgttaacaagaatattgatatggagtctctttctttcataaggaatggaggaatggcaaacagaaattaatgtttgaagtcaataacctagtgtgcaagttctttatgatctaactccatttcattttataagcttctttcactgtctaccctttagctatgccaagggtcagaaaattgaatatattctgtcttccttagtgtatttgttttttctccttttcacattttcttaccttagttcctctgcctggaatctctttctgctcatgactgtaagccatgcgtaatatctgctctttcagactcagatcatcatcttgtgcaaagccctcattcctccctttctttcccagctcctctctcccaccaacacagaagtaattcctctttcttcttaattcctactgaaattttggcatgagtataatttcttacagttttatatcatggcttagtctcattattgcttgccatatgtgaggggagttgttatggactgaatgtttgtgtttccccagaattcatgtgttgaagccctaatcccaaacgtgattagattaggatttgagagtctttgtcaggtaattaggttaagatgatgtcatgcgggtggagccctatgttaggattactgtccttataagaagaggaagagacaccagagctttccttctctaccatatgaggacacagagaaaagttgaccacctgcaagtcaggaagagggccgtcactaagaactgaatctgccagtaccttgatcttgtacttcctagtctatggaactgtgagaaataaatgtctgctgtttaagtcaaccaatctatgatttgttatagcaacccaaaaggacgtgtagaggaatattatgtcctatgaataccacagtagttttagtatacatggaatcagtttgtcaattgagattgtgttgaatttatagatcaatttaaggaaaattgacatctttgagttatcaagcctttcaacccatgaagatggagttgctctccatatatttagatcttctttaatttctctcagcatcgctttgtagttttcagtgtataggtcttatatcttttgtcagatttatacctaaatattacatatttttgatgctatggtaaatggaaaaggtttttattcaatgttaaactgcttgttgctagcatgtagaaacacattttttaaatattgctctcataaattgcaaccctgctaagcttattagccctagaagcttttgcacagaatatgtagatcttctacatagttatgttttacttcttcctttcttatatgaatgcctttcttttttctgcctttttttagtgtcttatattgccttatcacaatggctagagctccccatacaatgctgaatagcagcggtgtgaggagacatccttgccttgttcctaatctcaggggtaaagctttcggtctttccccattgggtataatgttagctgcaggttgtttttaaaaaatacataaaatgtgcctattattccaagtttgctgagaagttttatattttccttaatcaggtattgatgttggattttgtcaaatgcttttatgcatctattgatatgattatatgtattttcttatttgtcctgttgatatggtgaattatatgggttgacctttgaatgttaaaccatcattatattcctagaataaactctattgtgtcaaaatatgctatctttttaatatattgttggatatgattaaaattttaagattttttatatatattgattagggctgctgacctaaagctttctttttttaaatgtcttttctgatgttgatagtagagcaatgttgatctcataggatacgtcaggaagtgttccctcatcttcaactttctgtgagagtttgtgtagtattggtattattttctcttaaaatgtctggtggaattcatcagtgaagacatctggtcctggagtgattattgattattagtttgttttttgtgggggaaggtttttaattataaatttaatttttataatagatatagggctatttgtattttttgagcaaggtttggtagttcaagttttttaactaatttgtccagttcatctaatttgtcaaatttaggggaacagagctattcataatattttcttattatccttttaacatatgtaatctgttaaaatgtcatttctctcagtactaatttttgtaatttgtgtctttattttttttcatgatcagttggctagaaatttaccaatcacattgatcttctcaaacagcagcttttgatttcattggtttttctctgtcattttgttttttatttaattcatttccactttgatattcagtatttattttcttctgctcattttgtgtttcatttactcttctttttctggtttcttaaagtggcagctaggtcattacttgatacatttcctcttttctaatataaatatttagtattacaagtgttcctctaagtacttctttagctgcaatccacagatgttggaatattgttttaattttaatcaactgtacatactttctaatttctcttttaatttcttctttgactcatgggttatttagaagtgtgtaatttagtttccaaatatttgaggattttccaagcatctttctgtcatggattttttatgtttatttttgtttttagagacagggtatctctacaatgcccaaggtagactacaactcctggactcaagtgactgttccacctcagccttccaagtagctgggactacaggtgtgtgccactgcacctgctatggatttctaatttaacttcattgtgataggacaatatacttagtatgacttaaatccttttaaatctattgagacatgttttatggtccatggtgttgtttgtcttggtaaatgttccatgtgcacttgaaaaacatttgtactctgctgttagtgagtagagggttctataaatatcaagtcaagtggttgatagttttattctatatccttactggtttttctctacttgttctattaatcattcagagaatggtgttgaaatctctatcattgtggatttgtgtatttattcttgtagttctatagtttttgcttcatatgttttgaatctttgttattaggcataaaagtctaggataattgtctccttttgatgaatgaatccttttatcatagtgaaaccttctttattcttggtaatatcattttctctggaatctacttttatagccgttccgattttcttgtattagtgttagtatggtatatactgtgacattcttctaacttttttgtgtctttacattaaaaggggattatctgtatcagcctatagtttggtgttgatttttaaaatccaatctgggctgagcgcagtggctcacgcctgtaatcccagcactttgggaggctgaggagggcggattacgaggtcaggagatcaagaccatcctgcctaacgcggtgaaaccccgtcactactaaaaatacaaaaaattagctgggcatggtggcgggtgcctgtagttccagctactcgggaggctgaggcaggagaatggcgtcaacccaggaggtggagcttgcagtgagctgagatcacaccactgcactccagcctggacgacagagcgagactccatctcaaaaaaaaaaaaaaaatccaatctgatagttgttaatttttaattggtatatttagaccatttactttttttttttttttttttaattgagatggagtctcgctctgtcgcccaggttggagtgcagtggcgcaatctcggctcactgcaagctccgccttctgggttcacaccattctcctgcctcagcctccagagtagctgggactacaggcatgtgccaccacacctgggtaatttttgtatttttactagagatggagtttcaccatattggccaggctgatcttgaactcctgacctagtgatctgcctgccttggcctcccaaagtgctgggattacaggcatgagccactgtgcctggctgaccatttacatttaacataaatattgatattgctgggtttgaacatacatcttgtttgttttatattgttggcttattaattataagtcctttatagtggttgcttatagtgtgcacatttaacttatcccagtctactgttcaaaaataacattgtagtttatgtatgtaacaagctcttaaaatagtatattttcatttttctcctttggctatgtgttatttttgtcacactattatctttacataaattgtagaccctacaatacatcgttataaattttgctttaaataatcagttatctttttccctttcatttttagttgatacataataattgtacatatttatgggacacagagtgatattttcatagatgcatacaatgtgtagtgatcaaatcagagtaattaggattacaaacatttattttttttgtgctgggaacatttgaaattctctcttctagatttataatatatacaataagttattgtcaactatttttctccacagtgccatagaacactagaacttattcttttctagctgtaattttatatctattaataaaactctgtcttctcctccctgctacatttcccagcctctagtaaccataattctactctttccttctacttctgtgagcttttttgttgttgtttccacatgtgagtaagaacatgtgttacctttctgtgcctgagttatttcacttaacataatggccttcaggttcatccacgttgccatggatttttcattttttattgataaatagtattttattatacttgtgtgtgtgtgtctgtgtgtatgtatcaatcacatttgctttatccacttatctgtggatggacatttagatgaattacgtatcttagctattgtgaatagtgcttcaataaacataggtgtgcaggtatctctttgatatattgatttactttcttttgaatgaatacctattaatgggatttctggattatatggtagttctatttttagttttttgagagatgtccatactgttttctataatggccatactaatttacatcccaccaacagtgtgtaggagttctcctttctccacatccttgccagcatttttttttttttttggtctttttgataatatccattctaactggggcgagatgatatctcatgtagttttaatttgcatttccctgatgattagtgatgtggagcatcactaaaacaaatttgatgtttaaacttgttgggcatttgtatgtcttcttttggaaaatgtttacttagattctttgcccatttacaaatgggattattttttatttgctatcaaattgttggagctccttatatattctggatattagttccttcttggatgaatagcttgcaaatattttcttccgtcctacaggttatctctttactatgttgattgtttcttttgttgttaatagtcaattatcttttaaaggtatttcaaaaataggaaaaacatctggtatatttatcatttccagtgctctccattcgtttccatccatatttccatttagtatcactttctttctgtctgaaggtcttccttttatattcctttttttaaaattaaacagcacgccctgttcataccattcctttagatttcttataatgtagttctgttggaagtaaacccattcagcatttatatatctaaaaaagtttttatgcctcaatgagtattttttttttttttttgaggtggagtctcactctgtttcccaggctggagtgcagtggcacgatctcagctcactgcaacctccgcctcccgggttcaagtgattctcctgcctcagccttccgagtagctgggactataggcacacgccaccacaaccggctaggttttcttttgtatgatagagacagggtttcatcatgttcgttaggctggtcttgaactccttacctcaaatgatccatttgcctcggcttcccaaactgccaccgtgcctggcctgaatgagtctttattttatcttttttaaaaagacattttactaaatattaacgtctatgttgacaggagttttttctttttctatgctttagatatcccttcactgtttttggcttgcatttttcatggagaagtctgctgtcatttttatctttgttacgtaagatgtaatttctctctagctacgtttaattttgtctttatcacggtaaataatttgatgataatttgctttgttagtgttttcttcatattgcctgtgcttgtcgttcttgaatttcttggttctgtggatccatagttgtcatgaaatttgaacatttttctctgttgtttttccaaataaattttctgcccctccctgactttggggatgcatattaggttgtttacatgcatgcatattaggttgtttaaaattgtcttacagctcactgatgttctgatcatttaaaaaaattcttttccatcctcttctctgttttattttggatagtttctgttgttgtgttttcaagtttactatttttttctgtcttatctaatttgtttttagttccacctactgtatctttaaatgtcatatattgtattctcagttctagaattagatttttaaaaatctttcctgtttttatttaacatgcttaatctttcttctgtctacttggatgtacagaatatagttacaaagatttaatgcccttgtctactaattttctcatttctgtcctaagtatttgtattgattaatttttctccttgtaggttgtatttttttcttgtcttagtaagcattgtaattgttgactggatgagagacattgtgaaatttataatattgggtgctaaatatttttgaatccctatcaatatcttaacttttattctaggattcattggagttactggaaagtagtttgaccctttcaagccttgcttttaaggtttgttagacagtaccagagcagattttattctagggctaattttccccactactgggtttaataccttttgagtactctccctgatgacccgtaaattatgaggtttttccattctggctaattggaacataaactttccccagtcatgtttgaatgccagatattattcctctcaggtagttttatcatatgcatgtgctgatcagtactaagctgaaaatacaaggggatactgcctgtaaatcttgtagctcttctgtatatcctttcaatattctgccagtgaactacagctgtcatggcatttctgggtgccatactccatttcctcaactttaaaagaatgtctggatctacctccgttcctcctccctacactgtcatgtggaaaatgtctccgggcagcaagatggggcaatcctagggctgattttatttgctgcttttctctcagggatcactgttctgtactgcctaatgtcctatgtcttgtaaatcttgagtcatatatgttgtcttatatttttagatgcttcagactggagtgtatatctggttcctgttattctatcttgtccagcagtggaagtccttttaccatatttatactctactgtgagtcataatgatctatattaataatatccattagtacttatgatgttaatggtaaatgttctttggtgtggtaatgccatatgatttgctatagactatcatcattacagagatgcaggctgtatccacatcggtctatacagacttcaaccgacttggttgaagtggctggtcaatttaaactcttgcctaattctatcaaaaactaattttcgtgttcttcaaatcaattaatcattccataaattaactaaattgagcagatttctgagtatacgtgtagtctagttatattatttatgccaagggatagttctggaaactgcatatttccattccagtaggttgattccatgtgtttgctattgtgaatagtgctgtggcaaacataggtatgcatgtgtctttataatagaatgatttatattcctttgggtatatacccaataatgggattgctgagtcaactggtatttctgtctttaagtctttgaagaatctccacactgtcttccacaatgactgaactgaaagagcaaattttaattgttactgtatgctttctttactgcctgaaatttttgtttgtgtattttacataaataaataaatagaatcacacagatattgtatttttttccattaatccaaatatgaatctaaataagtcacacttatttcttcttgggtgttaattgccttttttgacaaccattcatccaatcagtgtgtttattctgaattgactcaattcaagtaaaacactcagcatgtgatttcctttttctttgtaagtcccctgtcaacactgatggatgtcattgtgaaaaggcatctcatggtggttttgttggttcacagatctgtctgtttttttttccccaatacaaatttgagtctgccatcatatactttagtttcatctttgttgtaatctagattataattgttttatttcatatttatttccccttctgctagactatcatactgatcttgtatgggagagggtgtgtcagtactgttgcttcctgctttagatccacaaattgaagtgccatccaccagctgttacattctctgaacaggcagcttgccaacaaaccagagattttctgatatactgcaggctttgtcaattattttaatatacttagatatagaaatattttcatggtacagagtatgtattagctgttttccttgcatcaataaacagctattatagttcaattataagtgtatgtgtatgtgtatgtgcatgggtatatatgtctcatgctcagtgtcttctggctttaatttgttgcctggaattaaaaattatgaactctgaggagcagtggcttttttgtgttagtgttgttttctaaaacacttaagttctggttgtagtttatgcaatttttagttgctttgaaaatatgacacagaaagtgttctggaataaaatgtacccaagagaattgtatttatcccattcatttgctgctcatccttaattcttgccttttcatgatctttataaacacattgctctaaatattctagcttgggttttcttagattaagcattttatgccagtggtggtaaaactgaaaaggaaggttcacatcataggggaaatgtatgtgtgtacgtatgtatgtctgtgtctgtgtgtgtgtgagtgtgtttgtgtatgtctgtggggttttgctacaaaggttaaatcccagaaatgttatgatagtttatagaaaatgtgtctcagttacagctgagttaaataagaaccctgaggtaatgctctaagaaaaatgaacacttgatgcccttttctttagtgtccccttagagttgcctaataggatcttagtgaactaacaatcataaacagaccaatagaaagaaaccttcttccttagaggaaaaacagtttcagagtcttggggtattcagtttgctcatgttgttagaatagtttcttttgccaaacactgaacattggggctgtgttttcttgttcaagaaggaggaagaggctatatgctaatgacagaaggcagctacttgcatgggtaatagactcaaaggaatgtaaatggctttcataaggcaaaatatctcgtgtataaacacttcaaaatctagaactcatatttcattaacaaagatattatttccttgtcttatttaaaactcacaagatattttaaaaattatgtttgatattgggatattaaagaaattcttttattttggaattttctcaagatgagacaaatgtagaattatgcatttgtttaaataccaatggaaataaaaaaatcacttctaaggggtccataaacaatgcttattgacttactggctcattgtacccccaaacactgacattgccatgtcactggatgatttttcattaattaaggaaaaagccaagtactttatttacaaaaaattgttaattttgacattaccttaatgtctttttacagatgtaaggcattttacacatccccctgccctcaattatttggttggctttattttaaataaaaatcaagggatggtattttttttaaaaagcccaaagtatataaatgtgaaactcttcagtaaatgatcagaacttaatatccagtttgctattgaaacattacaaatcactaactataaaggttgaaatagaattgcagcatcagaaataatattttagctttagaaatacaaaccagaaatacaaagcagaaattttgttgcctgtaaaatcagtactacatccttttatggaatagaagatttctttttcacagagtattctctggagccaaatacctgggttgtcaaaaatgctgcaaaatgagaatttagtttacagtagttgcaattgggcagtgtaccctaattgacttggaactagaaatctattaaaaggaagcctattaaccagatctcaaaaattcctgtagataaagctctagcaaatatgagcttacaatcaaaattcataaaacatgcaagagcccaagataccctaaataatataactattggaaaaatcagatatagaataaaaatttatatgtttaatatgataaaaaataattaggggagttgaaaataaaagtaagtaaattagaataaccagttaaattggacaaacataaacagaactataataaattgaaagtataataattgaaactgtagatcagaccgtggaatgaaaacatgagtgaattagggaaatatagatgtgaggaaattcccaataaggcagaagagaaagatagagacacaacacatgaaagagagattaaggtacattaaatatagatttagaatatatatctagtcagagttccagaatgagataataagagaatagggtagaggtagtatttgaaaacataaaggctaagaattttccagatatgattaaggaagcacatgtatacaaagcaagagaagtcaagagaaatctaatggggcaggtgcggttgctcatggctgtaatcccagcactttggaaggctgaggtcggcagatcacttgagtccagaagttcgggaccagcttgggtgacatggggaaaccccatctgtacaacaaataccaaaagtagctgggcatgctgacacgggtgcctgtagtcccagctacccaggaggcggaggttgcagtgaacagagatcatgtcattgcactccagccggggtgacaaagtgagacccccatctccaaaaaaaaaataataatatattgaaaccctgaaaaaccttagtggaactgcacatcaccaaaggcagagaagatttctaaaatagctagagaagaaagacatgacctaacaataatgagactgacagctggcttcacaatagaacagaaaccagtgtgacagctatctttaaagttaatattattttaggaagaaaaagcagagcagagaagcacaaaatgcaacactagaaatgaatccaaatacagtatctatcagtaattacaataaatttatatggactgaagtcactaattaaagaaaaaagattgttagaataaaggcatatttaaaacgtacagaatatttaaagttgaaaaaagaaaaaaaatatatattccaggcaattatcaactgaagaaaggtaagatagctatgattgtgtcataaaaaataaaatttaaagtaagcatattactagagttaaataattctaaacttacatgtatctaatatgaagttcaaatatagaaaagcaaaaattcacaaatccaagaccatgttgagacttttgaagactctgtaacagtaatttatgtactaagctaaaaataattttagtaagaagatttgaaggaaaacttgagtgatcggttagcatttaaagcaacttgacaatactacagaggtggttatttagtaggaagacttaaccaaaaagccccttttcggctgctatgagactttaaatatgtttatgtctgactattatggaagggtttgttaatggaaattaggaataattttcttctttagtgaaataagttcaaaatatgtgtgttggttagaaatatcctataggcatctccagtctgaaacaaagaggatttaagaatctacgggagtccagtaggctattggaggactttgtcctactctgtgctcagccatgttcaggtactctgtcacttgaactcattagaagattagctaaatactgctgctagaatggagtcgtatctgcttagattattttatgtaagattcttgtcagaatatctaaatgtgcagaaagctgggacttcattggtctttcatcatggcctatgtgactggttttttgcttgcttacaaattcatatttgtacctatggttaaattcagtctcagatcttgtatttctatcataccatgcataattatagttttattggagtggagatctaagtatgagctctaaatattttgtgcaaaaaagtaataattgtgaagaatctattacatataggtagtttacagcactatggtttcaattcattgactagaggtcagaatccaaaataacttgagccattactgtggaattttattttctgattttatctaataaaaaaagagacttttgtcaaaacaacagtaacttgaattattcctgtggatcataactggacaatttggactgatggaaaatgagaatatttattaaaaatgtcaaaataggacaagatcttagaggatactttcttttatataatcatgaggacctgtttgacaaaaatttgctcctctctgacctatcttatgggaagtactccaacaatggataagatgtacttattcttcatcaaagtaaccttttatttgcataaaatagcagtaaataggatagcagtaaaagttctgtaggtttctttttgaagtatgcactacttaaaattatttaaatatcaccttttacctatggaaaaggcaaatatgtatttccttttacatatggaaaaggtcctggcttagacgtgttctgattttatattcttgtaagtcaagatggagagttgggtagagaataagggaacctggtacaaagaatgatgtgtgaaagaagatttttagaactagaacagtgctagattgtatcaatattgtaagctatttatatacagaaactgtttgagacagctatttagtctccttcttttgaacttctgcaacttttcccccttagcattgtgtggttagctatcttgcccttatcttttcaactaaacagatgttacattcctcaaggataggaagacattgtctttggctttcttatgtgcccatccttgccagcccattactttgcagatagtaaatacctagtaaatatttgttaagtgactaattccctgaaactcaccatctttgtcatgtctcagtaagtcattctgtaaatacttcagcatatcacatattaatcattgacatttcagaagcaaagagagagttctgatgatcccaaaattaagtttcatttctttgtaggaagggctcagccttcttcaattttgtgtcccctaacaccttacaaagagcctttcttggaatgggcttttaatatgaagctgttgattgcaaatgtgggttctgttatcatgagaaactgtattgcatccttgcagatagttttatagtcctaatggtctacaggccttttttagccaccatatttttaaacaatccttttattcagatctagtgatattactctagtggcaatgaaaaaaaaaacatggtaagaaagtatagccctgtttctactggatgtagatttaattttcatttaaagtctttcttaccctgctctattttctctatttttgttttctcttggggtttcatctgttcatctgtgggtctgtatttatttatttggcaggtataatctttcctttcctctccctccccctggcatctccttggaagctgctcttactttgtgtcaccctaaagctgatggtgactctgttttctggcttcaaaagcagttttatgcacttttttctctctctctctcccactctctatcttttttgaaatgagctgtctttgattatagtttgacagtgtggtctgactgctaacattgattcccagcagtgaacaactttgtcatattgttcaacattaggtttcgatgtgtcatttaatagactaaaaagccattcccagtaaaatcgaattcctgtgggaatcattgttaaggacgctctcaaaatgaagtaaatatgtaatgctttagaaatttcactggaaaggcatcaggtgactacatttactgaaactaccaatgtcttagctggattttatattctggaaatgcaatttacaacttgcttgcctttatttaggcaaaatgtgattcacaataattaagctttatgagcttcttcacttaggcaggtcaaataatatttttattttgtttttaactgtaagaaaatacttgctctttcttcacatttctatatgtgaacctaactaaattcaggtctgggcccagaagtgcctgtcccatttcaggctagacatgcagtatcactaaaaactaatatttaactgtatgctatagtggtggaaagagcaggccctgaaaccagactgtatgggttcaaatgccacctttggcatttactgactttgtgacttttagtgttatgtaacttatctgtgccttagtattgtatctataaaatggggatagtgcctcctttataggattgttggataagagttaatacacttgtaaaatctgtgcacacttagtgtgcatgaatcatattaagatttcagtattatttgtcatgcttattatgctgttttgtttttttgtagttgacaatgtccaatatttatttagagatattcctctgtcttatatctgagaaggatgcagaagtagaaccaaaggctatcctcttcattgacccagcagtttgtttctcacaccaactttgcataacactcgctaacagaatgaaagcacttcagtagaccacaccaactttccttgggtggcagtgtggaggccccttgtgattacttaagtatgctcccgagagtctgatttccctttgccatcaattcctttttgagataagactagaaatgttttccacatgtctttaaattttcagcgaacatgtttttcttacctggataggccatattattactgaggttcaactgccaggatctcagtccctgcttcagaggagtataaacatgggtggacccaaagagaagccaagtgggtagcgcccactaagcatttgggcatctatattggttcattagccatagagatggcatttagataactattagttgaataacatcttactctttgtgtggaatcgttttataggcactggctatttcagatcaagtaaagtttacctctagagagaagcttggttgattccagagaagaagtctttatttgcctcagattcttaccctggcaatgaactatttttagggctgtttgtagtatgtgccttagacctaggccttgagtcagtcaaagtaaccctgtctatcacttctgtgtcttggctaaactactacatatagagccttcactcctgctgcaactcttgcccatgtcaagcacatctagagcttagtcctgctggtacctgacatgaattttgaacctgtttttgtctcctgttttgtcttactttgccgtgggctgtctttgcctgggcttgctctacgctcttcttctaaggtctgttttggcttttttttttttttttttccaaacgtatcccctagtgccatgccaggtaagtgataggtcctcagtaaatgtttatagaacagaaatgctggatccccctgcaatggaagcttgtctaatttgctgtgaccttgcattcagctttgacttctgtgatggtatccctacaactgtacttctcaatgctcagtaagctcttactaagtgccaggcactgtgtatatcactttgtattcagaatatcattttatcctctcatgaaaccctatgttattggtattttattattattattattattccctttgtacaggtgaggcaaccgagacccagagagattaagtaactcacccagagtcatccaggccaagtaaccatcgatgatgggattgaaatccatgtctatctgaatgcagagacagatcataacctctactgggttgccttgtatatcataccatttagaaaatagcatgacactttgagtcagctgtcccataggcagagtttatatttcatctggttgggccaaatctccaccttatcctaaccaggttttgtgggctgctttagctgcacttgctcagatggctataaacgtgaggcttagtgtccttaattgctgctcgggttggagagcgcattgatacaagaatgctcaaagactaagccactgtttgtgggatggaaactccaactgctgaactgaatcagatctgccagcatctttagaagaaacatgaaagtatagcagagctgtagctcttcccatatctccaaagcattcacccgtcctgtgtaggtagacatgaaagtttttatttgcaagtaccttctactctttcttgagggctttctctggctcctgaagccaactcagcttggagggagagagggagtagatcagaagtgttggggagttgaaacccaggagatgtccatcaatgattggcaagagtttgtagattaataccctagcttagtttctatcaaactgtagcatgcttaagaatcttgaaaagttgtttaaaaattagtaggttggaggtgaggcccagagtttgcatttcttttttttttttttttttgacttttattttagattcagggagtacacgtgtaagtctattacatgggtaaattgtgtgtcactggggtttgttgtacaaatgatcctgtcacccaggtagtgagcatagtaccctgcagttagtttttaaatcctcactccacttccaccctcccacttctagtaggccccagtgtctgttcttgtctttctatgtgtactcaatgtttagctcccactcatcagtgacaacatgcagtatttagttttctgttcctgtgttaatgcgtttaggatgatggcctttagctgcagcatgtcaactgcatgttgctgcagtggacatgatttcattgtttttttgtggctgtgtactcagaatttgtacttctaataagcttccaaatgatgctaaccttcaaaccacattttgagtagcaaggccctgttgcctcccatttgggataaatatgcagtatagggtatgctgtaggttccttagcaggattgagctccagttgttgataaatgtaaactgtttaataataaacactttattatctcctttggttttctttctgacttccctacttttctatcaatgctctctggcatcagcatttacacaaactgctcaactacaaacactctcatgcttgtctcagtgtcttcttctggtagagaccaacctgagcagatgaccataccaacttctagaatggaaagccctacccagacagtgggactgtctccagtcctccagcctcaggattttggccgacttgaggtcactctcatggatcccttccagaaaagtatcactgggcatgaggtagtccaggttgagagagtgtattgatcttaaagtgtttgctgatgacagcatagctggcattcttccctgggggaattgccaggacccttatttgagaaaaaggtactgtgttctttctctagtgaccatagggcttctaaacttgatatgagccaagattgcccagtattctgggatagattttttttcttaagggttaaaaaaagagagattcaaatcttcaactctaagaaatctatcacacttttgaggatccattagggataagggttagggagtagttagtcaccggcatgctttcactctgaattcctgctcccagctgaattcccttaatgttttctctctaccagctcctaaagttttctctggttctcattaaccccgaatttaaacatggctcctcctgcttcacttcccacagcattactcccataatgctgttgggtatgttagacccttcctgaaggtctgaggttaaaggatggaggttacctagagaacacttaaaattcagtctaagatactaaatactatcactgtgctactaagaattagtatcacagtcactaagttttggcatccatttctgttgccaagcttcccatactggtggctgctgctcatatgagccccaagacctgttatattttctcatcttgttttatttttcttctcagttcaagctgccccctaccagcacctccctgtgtgtctgcacaggctgtagactgtgcaactatggggggcactatttaccatagactgcgatgaaaatagcatcccctagagtttatgcagcttgatagctctctgttctcaaccccaaaagacttagacaccactctcttaaaaccagtggaagacggaattttctattattttattatacacagcaattaaacatcattttctttcaatctgtattttctagaagtgccccaagaatcccacatcagcataaccaaaagtgtcattaatgtattttttccccaaaacaaaatagcagttttctttctgtgaagaattctgtcttccttttaagctcaaattgcatccagcttctaaaattgcaatttctctgcccgcactttctgtttagcccagtgaaggatgacacaggttctatctaggccttaatcaaacaaatcactgtgaggacttctgtcttagctgtgaccctgggccctttgggaattcccgtcccccctaggcccttctggagccagctttttatcttgatatttctctgctttcaacgcaggcttagaaaacctttcaattaaagatgtcatgttggccttaatggaagccgctcttcatacctctcattcccccaaataggctgttttccattggcagtgattcataggagccacagaagagtttgagatttaagtcattctcaaccagttacagaccctaggagcagttacagacgttaggtgacagagttgaatttcagaatccatagcctacactcatgctagtaatggtgagaagtgtaaacatagggataagagacaaggcagtgatctcagaggaacctaaatatagttaccatccctgtaacctttgcataattgttttttcagccttcttctctgtaaaatggggatgataatccctacgttacaggcctgttaaaaagattaaacaaacgaatgtctgtaaagttcttagcatggggtctgacaataataagatatcacaaaaaaactattgtcatcaaacctctaagtctgtgcctctgagggatgtggtatcctgatataggttggtagtcttcctaagtaagttgaatctcaggcagcagaggaaaagtccagtgaaggagaacttgaagattctaaatggatgtgcatagcacaccccttttggcagaacagtgactcaagactgtaataagcagaaattaagggaacatcttcctctggagctcctaggagacttgaaaccagtggcagagtctcaggccctgtgggatgttacattaccacaaatctagccatagcctactattaccacttttggtaggagccagctatactattattattatgaggaaactaaagctattaaagggttgagctggtattggaacccaaataatccaactttagaacctgtgctctttaccactgtttttttttttgtctccttaaatatgtacgtgcgtgtgtacctattatgcacataaatataaaattatatatctattaatatatagtatatatgttaatatagaatatcatatataaagttgcaaattgccttaaatatatttccctgtaaaactgatatttataagtttagaacatatttttttcttgcatttgaacaatgttcatgtatactttggtctcacaaatgaaacctgtttgtcattgtgcttcctaaacttgaatattttatggaccctgttgaaagacattctctgggacccttagtattgacataaataattttttgttgtaatgttactctaaaatgtagaaatatataatcaggtataagtgtattatgcttgtggctcctaaaattatttaaaaacaaattttgaaactacaaaagcaatggcattcaaattaatgacacaagtttcatgtggcaatgatgtttgctggaacgaaattgctacttgagaaatcaatatggtgtagagttacacaaaacaggatctttagagttcagcatgacagaagtaccatgtaccatgtgatgaaaacttttgctgctttttttttcctgctttttttttcctgttgaaattgctatgaaaccattcacaggatgggcagaaacagcctttgctcttggtgtgaatgcaacatttatatactcagtgtctacctttgttcctccaaaataatggtacttggtacaaattgattataaatgtgacttttcagtatttgatcagaacgggggataataagggagtcatgcagatgacactaaccagcatttcttctgctatctgcattctgtccctaagggatgtcatctggtgtcctggctttaaaaaacattcatttgctgacaactctctaatttatatctatggcgtgtattgctcccctgaacttcagatttgtgtatctaactgcctaatagacatctcggcttagatttctaaatcttacagtttacaagtcccaaacaaatcttctggccccctgacctgctccaaacctgcttgtcctgtattcgtctccatttcccagaaaggcaactccactcttcctgtcgtacaagccccaaaccgtagtcgctctttacttttctctttttctcacatcttaaatccagtcaccctgaaaatcctgttggcctaaaaatatatccagaacctgaatacttctgcctgcctccattgctggcccccactcccaaggcaccatcatttcttgcctggatgatggcagtaacctcctcatttgtctccttgttttcaccctggcattcccaattatgtagtgcaaatacagtattttacatagcaatcagagtgatgctttaaaagtaaaacacctaataggttactacagcattcacagtcttcaaccctctaaagggcccatttcagagtaaaaaccaaaacccttaccatgtccgtcaaggccctgccactgttctttagtcagttgattccagccttacttttcttcaaacaacacacaagcctcgactttgtgtaggctttgcactgcttttccctctgctgggaatcctgtttcctcagatggtcacctggcttgcacctcctggcctctgcttagatgtcactttatcagtgaggccttccctgacaatcctatttaaaaaactctgttcccaacatacttcttcctcatcactttctcacctgctttatgtttttttttttttcccatggtgtgcctatcaccatgtattagtatacacatataaatgtatatgtatttcaattgtttattacctgtctctttctactagggaatatataagttccatgaatgcagaaacttagttttttcagtatctaaaatagtgcttgtcacttattatatgtgtaataaacatttgttgaaggaatcaatgaatgcttagtttttaaaacttgtcagcagaataaaaacacgaaaggaagtattattagggagaggttgcaaatctgagggtaaaaattttataccagcgtgtaacaccaaggaatgtactatgagtacaacttagattttgtaaaatgttagaaatctttttactgccaactttcatttttatcaatctaacatcttttgaattttacagttgaacataacttctaatttctcctaaatatttgcatgtatatttacagcttatttaaaaggtaaccacggccaattgtgtgaccaccaacaccatgctggggtgttaatatagttcagattgtctgagagaaaagttctttgtaaatcagtcactcccctgattttcacttggaattcatccaattattgacagcacttagtttgtaacatttcctggactcagaagagagggaagcttgctgagctgaaaccctgatatgcagtggagatttacattcagggggaaacagtgtctgttgaactgtgttaacagctatccatgtaggaaactcgaacagtatccaaagagcacacataattgtggtgattaagccgataagctggtgacacaaggaaagaaagtacaaattgaagtttcagcaacaggtgtaaggcacgtggtctatcctttcctggtagtcttaggaaagtaataagatagcttaattacatgattaaaatactcaaagtccagctgcaacccatagtttctgcctgtgcttgcttgcttgcttttttcttattagaagtgttgagatctttagattgttatggtttacctttctgttgtcctctatttttttttttttttaagactgagtctcgctctgttgccagactggagtgcagtggcgcgatctcagctcactgcaacctccgactccctgcttcaagtgattctcctgcctcagcctcctgagtagctgggattacaggcacacaccaccacgcccagctaatttttgtatttttagtagagatggggcttcaccatgttggccaggatggtctcaatctcctgaccttgtgatctgccctccttggtcccccaaagtgctgggattacaggcgtgagccaccgcacccatcctctgttggcctctatttttttagcttttatattaaaatactgttaatataaaattaatccaagcttgtcttcacattctgctgttttttccccccagtgtaaattaatgacttactcaaaacaatttttaagtcattagctaaaacgtgtacacatcttaataatatataacaaatagtgtgttcatgaatacacagtgtcttatatacacttattatcatgtatgcgatatatttgtttgtacttcaagaacattatgaaaataagggatgaaaccatgatttgatttgcatgcataagaaaaaagagtctctttgtttaaacagaaaattgagtcgtattgaagccatacttcagcattgtaggaagcatcctgttataagcacgtctttcttttccttcctccctttcttccttcatgtttcaatagatattgattgagtacccactatgtgccaggcaataaagtacacactcagtttggcattggtatgaatgctaatttagcaatcctaggctatcctggagtggcatcttgaaagtactcagttggagtgagcttgcatttagtttttcagttgggcatgggaaagatgaggcccatttccctggatttggaatctggtggttttgcatttgccagggcaaggtgctgtgtttattctctaaaagagtctcacttacctgttagtttggcttcaaaaacttttagcaacctgaactttaattttctgttatgtgaacacacagacaccacacacacacgctatctatctatatatctatctattatctatctatctatctatcatctatctatctatctatctatctatctatctatctatctatctctgcaaggtcttatggcttatttttcttcctaagttctagacttgttttattttatcttcttattcttcctctgagttccctgttttagttaaaagtttgcattatatattgtagcaaattgtttttgaggaaatgtactatatttattcaatacaaaaagataaatgcgtacatgtctagaggactgagaagatagatactttgaaaactgccctaagattgaatgtaataggaagatgaaatgttcttaaaagaaattaaatagattaactaacttatttcccacagaccattagccagacagaaaatgataggaaagtcaatgcttacctgatcacctatttcaatatctagagggaggccagaggtttcacatctcattaccagtctttcctaatattatttctttatatcctttactttttcattggttactcataggggagatggctacctgagagagctctctatttgaaaatgtgtttatttcaataagaacaaaattatctggacatttttgtgtaggatattagacaaaatatttttatgaaagaccttgaagtctgaactttgtgtaggttttccacagtacagaaagaaggtggagtttttggctgaagctgacctgcatttaagttgagattgagtgctgtattacttctgttttgaatccttcttcaagacttgtccatcatagtcaatcccaaagctcagagtttctgaaaaggattttaggctgttaaaaaatacattgtatggtaacacttaacagtttttaagaaaaatgatacatgtgagatatgatggattttagaaattataataacaccctctggttagtgttcctttactacttctgttataaatcaggagtttgcaattttgacagctaatctttttttctgtcagcgaaaacttgagtcagcctcttaactataagctaactgaaaatgaagactctgtctcttaagatattgatatatattttccttggaattatagttcgagcctctgaatttttgtgtcttttgggctgtcataccctgtgatgaacagaataggactttgttcctttacagctggattaaagatataacttcagatacttatttaaaaattagtattgtttccataataagcaaaatagtattgttaattcatagcacaggcattatttcaaaacaaactaatgatgaaactaagatttttaacataaatctgcagtatggtatgtgttctactgtccttattccagctgttgaggatttgaagtgagaacgggccaattttagcatgtgttggaaccatccatttgtctatttgacaaagatcttagaatcttccagttgaaaaggtctttggagaccatctacttcaactcccttaatttacagttgaagggatccgtggagaaagttactccccaactactatgttaataagtacaacattgttactcagttcattgccaggcaaacctttgttaggaatttaacagttccacaaatagccaacaaatagttggcaaactttatattcttatttgtaggcagctcatcatattcaggaaataattttccccaggagtgctctgactttaacacatggaacttgttttcactgagagaacaactgaaattctttcagaagagatgttttagaatctctgttataataaaacacagtataatgttacatgcactagaatgtagtgaggtccaactttcattttgattccattatttatttgaacgctcccttcctcctcttctcttgttttgtttctttgtctccatgtttccaaaaggagttcttatcttggacaacctatttcatctttaaaatagaagtaatattgtcacgtcttcctagatctggggggctaaacccagaaattctcgtgactttcttactactcaagacagtcttaggattttttttgttttgttttttgttttttgagatggagtttcgctcttgttgcccaggctggagtgcaatggcgggatctcggctcaccgcaaccttcgcctcctgggttcaagtgattctcctggcttagcctcctaagtagctgggattacaggcatgggccaccatgcccggctaattttgtatttttagtagagaaggggtttctccgtgttggttaggctggtcttgaactcctgacctcaggtgatccgcctgcctcagcctcccaaattgctgggattacaggcgtgatccactatgcccagctaggatctttatatatttttgaatatatttattaggtatcttctaaagttgtttaaagttgcttcaaatttaattatcagattgatttctggaaacattgtctttctacctcctcagactgctggggaattgacaggaaaatttggaatcaaacacctagttattagggaatatatttcatttacttgcctggattaaccattcccctcctcccgctctagctgctatgtgtatttagacctacctttattgtaaaatattttaaaaatgtacttctatttttaaattataaaataaggcatattctctttataaaatttggaaaaatagaacaatttaaataaaatcaaatgtttataatcaggatctaaagatgatcttgctatatactggtgtttatatatttctagtattgcttctattatttcttttcatttggaattacattgatcatttctttttttctcttttgttccattgaatcaatatatcatgggcattttgtcatgtcattaaatatttttatgaaagttgacatagtgttacaaaaatgtatcatgtggataaatcacaatttaaccaatcactattgttagtcatttgtgttgtttccaaaatttgctattagaaataatgttataatgcacattcttgtgtgtatatctacgataattttcttagggtaaatacccaaatgtggaattagtcatatggtattttcatatgtaataccaaaaggtcctctagaaatttttatttcttaccatagggcccatttacctctgtcctaattatatatatatatatatgtttagagtttagagattcctcaaaaagttaaacatagaactaccataagacctagcaataccactcatatgagtagttttatgttcattatggtagttctatgtttaacttttttgaggaatctctaaactgtttttcatagcacctgtaccattttacattcccaccagcatagcacaagtgttccaatagctccacttgttccaatagtaacacttgttgtttcttattttattgatagtagacaccctaatcattataaagtgatatctaattgaaatttttatttgcatttcactgatagatagtgatgttgagcatctttgcaggtacttactggccattcgtgtatcttctctggaaaaatgtctattcaaatcctttccccatttttgaattgagctgtttgtttttcattgccattattgagttttaggagttcattatgtgtttcagatattaatcctgtgtaagatagatgatttgcaaatattttctcttattctggggtttttctttttaatctcttgaaaatgttctttttttgagaccaggtctctcattctgtcacctaggctggagttcagtggtgtgatcacagctcactgaagcctcaactcctaggctcaagcaatcctcccacctcagcctcccaactagctaggaatacaggtgtatgccaccatgcctggctaatttttaattttttgtgtagaggtgaggtttctatatgttgcccaggctggtctcgagctcctgggctcaagcaatcctcctgccttggcctcccaaagtgttgggattacaggcatgagctactatgcccagccttgaaagtgttctttgatacacaaaagttttacattctgatgaagtcaagtttatctaaatttatcaaaacacgcttggtaatggtgtataatcctttaaatatgttgctgaatttatattgctagtattttgtctaggatttttgcatcaatattcacaagaaatattgatttgtagttttcttttcttgtagcgtctttggttttgttatcagggcaatactggtcccataaaacgaggcagaaagtgttccttactcttcaattcctgagaagagtttgagaaggaatgaagttaattcttccttaaatgtttagtagaaatcaccagcagaaacctttggtcctatgcttttttgttgttgttgttggaagccttttgattattaattcagtctccttagtagttatgagtctatccagattttctgtcttcatttttcaattttagcagatagtgagttgctaggaatttgtttatttcatctagattactcagtttgttggcatacaaatgttcatagtattctattcatagtctttttcttttgttttgtaaaaccaacagcacttgcttttggtgcatccaataagtttttgtttgttgtgattttattttcatttgtcttaaagcattttctaatttattttgtcatttattatttgatctactggttaagactgcatagtttaatttccatatacttatgaattttcctattttccttctgttagtgattcctagtttcattccattgtgattggaattttttttgtatgatttcaatcttttaaaatttattgcaatttgttttgtggcttaacattattgtctgttctgtagaatgttctatgtatgcttgaaaaatgagtaatttattgttggatagagtattctgtatatgtgtgttaggtctaatttgtttacagttttgttcaaatttagtattttcttattgatgttctgtctgttgtacctgttattgaaggcaaggtattgagtcttcgactattatctcccttgtattccagtatgtagaactatttcttccttcaattctaggaatgtttgtttcacatattttggggttttgttgtttggcacataatttataattgttatatatttttgatgaattgacccttttatcagtatataatgtgtgtctttctccttttacagtttttgacttaaattctattttgtctaataatagtatagcaaccccaactatcttttggttacatttgcatgtaatgtcattttccacctatcagcctgtttccatctttcaatgtatttgtgtctttagatctaaatgaagcctcttttggatgacatatagttggatcatgtttcattttaatacttttgctaatttctgtgctttggagattttaatacatttacacttaaagtcactactgttaaggaaagatttacttctgccatttgttatttgttttcttatagcttttttgttgctaatttgctctattactgtcttatttttgttcaattgatttttttttgtagtgaaaagctttgattcctttattatttctttcgtttatattctacaggtattttttttgtggttactctcagggctatataacattctaaatttatggcaatgtaatttgcatggatactagttaaactttggtcacatacaaaactgcctctatataccttcatgttattggtatctttatacgctgtctacccaatgacataggtttataattgttatttatgcatttgtcttttaaataatgtggaaaataaaaaatagagtcacaaaccaaaattgcaatattacctgctttgtatctgcctatgtatttacctttacctgagacctttatctatttatatggcttgaagttactgtcaagcatcctttcatttgaacctgaaagactcgggttagcatttcttttagggctggtctagtggtaaaaaacagccttagcttttatcagccccgcccacacttttactgcctgagttctaaattagatgaaacaaagatgagtaccttgcttcagtccttcttgtatccctcaggcaggttagagcaaatgtacaaataatttgcaaataaagtctgttctgctgtgtttgctttgagggagggaatgggaactggaatgctctggtttcccgaccaagaccactgtcagaccagggagagggaggggcaagtatgaataaagacaccacaaaattttctattatttcgaagataggtttttttttgtttttgtttttgttttaattaggcaattgcttgtttgctgtaaacttttgagtttttttcacagctccataaaagtaggtttagacacttgctgcttgtgttttttgatgtttctgggggatgggggcaggcggtgggggtgtttaagaacttgatgcggcctggagcggtggctcacgcctgtaatcccagcactttgggaggccgaggggggcggatcacgaggtcaggagatcgagaccaccctgtctaacacggtgaaaccccggctttactaaaaatacaaaaaaattaaccgcgcatggtggcgggcccctgtagtcccagctactcgggaggctgaggcaggagaatggcttgaacccaggaggcggagcttgcgttgagctgagatcgcctcactgcactccagcctggacgacagagcgagactctgtctcaaaaaaaaaaaaaaaaaaagttgctttctagtccaccattttgctgacatcttaaattttttttttttttttttttttttgagacggagtttcgctcttttcgcccaggctggagtgcaatggcgggatctcggctcaccgcaaccttcgcctcctgggttcaagagattctcctggcccagcctcccgagtagctggcattacaggcatgtgccaccacacccggctaattttgtatttttagtagagacggggtttctccgtgttggtcaggctagtcttgaactctcgacctcaggtgatccgcccgcctcagcctcccagactgctgggattacaggcatgagccaccacgcccggccttaaagtattttttaatgtgtctaaatttttatattgtccctttaaggtatacttatgccctgcaaagtaattatacacaaaccaataagctaagaaagaatgaaaggagtaataatttttggtgctactttaactgtgaatttagagtaggaagctttttttgcaagtatattttttgtataaaattaagaaaatatataaaataattgtatcccccttttttaaatatttttacctcttactcttttcaggttctaaaatgtgacttaattatgaaggttattagcaagaagtggcatttccaaaagtttcagcactgataccactacaattacaactacaataccactgataccactgataatttgcttcttctttctctcctctgtccacatttttagagttgaagtatatttttagagttgaattttaatatttatttttggggaagtaattttgaagagtcagacatgaagggtgattgtcaaatttcttctttgtttacaatttaggttgattgttaatgacaatttgtgtactggactgctgtgatgcaatggagtctgagactgggttatggctcagctagaaagggtattgtgaccaatttatgatgtttgccatagtcctggaaggtggcagtatttatgtcaatcattttccatctttattttcagcatccctggagccccaatctaataaagtcctcaaatcacctatgtgctgctttaaattaccagctgttataaggtacttaatttgaatcatgtaaatctataataaattggggatgatttctctagtagatcattttagaggaactataatatttaatgaaagtccaagtaaagagcgtatttaaaatgtcaaaagaccataggtttatcacattgaattctttattcctttgcagtctagacatttaattcaccttgtttctgttcgggttccaaccatctttgaacacgcaaaacaatatgattcacacaactctttgacatactcagcctaaatttatacctaatgtttacctacgtaacagcagtatttcaacgccctctttttcatttactctttggtcaaagaaaatctctttcacccagtgttagcttaagtttttgatattgagcttcatgtctctgagtgtcatatctttaagtacatttcctgagttttcatttttaggcattatctactggcattccattatgaaaagataatttgtctcttctttctctcctctctccgcattaccccataatataccagactttctccaccctccagctttcttacataattatatcaaagtaatgctatacaaattatgatatagctctgttcagtgtttgcattactatacgtatgaaaagcgatcaagaactagacatataacagctacaatattttttccttttctgtgcagctcttatttaccttggagttaataatagcatttatagttatttgcttggttttctatgtacttgttaattcaaaccaaacatttaatctgttacctaaatctcttctcaggatacccagacaaatctggtattccatcatttttgtctttctgaagaggattttcctggaaatttctgacctcctgtcctgtgaacaaattatcctgtaggttttgtatcaactgtcatcatcctggcctgtcccctcaccgttaccctggggactcttcgcatctttcctctgtcctatctattgtttcctgtgtctcatcttcctgtcttagtttattcttttattttggtgacactcatccctctgtatctttcaaataaatgctactttgcaactaaatttttgaatgatcttgtatctgaaaatataccttttactttgttgatggtttcctgactaccgaattctagattgaaagtttttttcctcagtgttttgaaagaattgtttttgttttttctcctctggaagcttgtagtacactaggtaccgaaatttctctataatgtgctttgatgtgggtttatttctatccgttgtaataagctttctgtgagcactttcactcatgttctccctggggaattgtctaaattatatcattgattttaccactcctcttgtttatctttgtggaatttatacaatttgatgttggatctactggactggcctttctttcttacatttgatctctttgtatttgatattttctcgattctgtcaactttttattttttgttatattttttgtttccaagacttattttttttgttccccaaatattcctctttttttccttttagtaaaagtattttgtttttatgttatggttctcttctcttatctctctgatattaataatagatttttttaaagttttcttatttctgcatattgcatttccttcaagttgctattatacatattagtttgcttaatttttaatctttcatattagtgactttcctcagatgtcttgtagtcttttgcttatccactgacatgtaaaggtgtgggacaaagtagctcgattggagtttttgtgcataagtttgtccatatagttttgcagtatgatgatccatttgggctatttagttaggtaaacttcagagttatcatctccatatttttctacttaggcagatcagatatcccagagaaggatcctctagcctccttcctgtggagggagtacctagcatcttcagagcccccattagggaggaaaaatggggagattctggcatccattgtgcttacgttcacttaatctctctgttttcagtgtgttttccactgttaactatgcagagaccttttactttaccccttagcccttatttgaaaatgaagagggacatttaactgtataagatccagggatgcaatttggatatccacctgcttcttagatattttttcagcaaatcgttgttatttggctttattccttcacccttatctttgaagtacccataaccaccaattccttagtcttttagaatttagcagtataaatttggttggctcttacatcatggactcaattattcacccctcattcctctccaattaattaccttcttttatctttttttttaaacggtgaaacttttataataaattgattttattcgtcctctgtctttctttacttgtcatgcctcccagtctggtttcagcacccctcaactttcatttaagacacctctgtgttgataaatctagcagatatttttggcctttgaattatttgacatctgtgaagatttgccccagttaggtactttcgccttctagtttgtctacagcttctctggaagctctcagttttttctagttccatggtcttctactttcctcatgattctttcttttagagaatatcactcaagaccagtaatatcaatatatctaatatataatattagatcaatatatctagtatcaaatatatatgtatgatatataatatacatgtaacataatatataacatatctcactatattatatatgtgcatgtatctgtatacatacacaaacatgcatatgcaaatccacaaccatgacacatgccaaattgtcctgtcatgtagtttggtcacagacttttggaaaacttgctgtataatgaatgatttctcttttttaatgtgcaaaggtctggaaaacatccttagaaatatagctggtgtttcttttatttgctccatgtcaaatggcagagctggaagtgctcagttaaaccctgattccttgcagcttaattcttcagtctcagttttagagtaatgaaataccaagtggctgaattagcagattttggaatgctgtataatgttctctttataatggaaatgattgatggtattgtgtaaatgttctatgatatttggtaaaagttaataattctgttttcttatttgtaaccttatcataatttctaccatagtaatgagcagacttttagactggcaatttattgaaaatgttagtaaaataatgatatcatatgaggcagtttagtctataatctcaaatgtaatttagcagaaaatattaaatagccattttgtaaactgacagaactcaatttttaatgaattgaaatacagatggagagaaatgccaaaatggattaatagtgttataatagctgatccttttagaccagaccacactgtcttcaagatatatgcctattaaaatcttggtattctaattttaaatatgacagtagtgctattaacataaaaatatgactcgattaataagattcactttatgactatttaactctctcatagtcaggaagaatccctcagtctagtattcaagagaatcttcttaatttctagattttcgaatagaagtaggagattaaatcaaaatgccagttgttttatgaaatgaaaagaatgtctgttgttgccttttcagattaggcatattggtacttggtgttatcttcctgatattaattttatactactcctgtatttttactaagatgaatttggtttaaatgtgaaaataaattatttaaaaagagataaatcttttgcaatcaatgtcggcaatagagttgatttgcagcagtgttatctttgaaattaagtgatagtgccagtaagggttgcttagaatacttcttacagatacttatatgaattaatggaattgtacacttattacccgtgaagataaatatgatcattgaaatggtatgtgaaacattcaattcctaaattaactagaatgaataagaactttcattgagtgattttttattgtatagccgaatatactcctgagtctatagggagctttgcctttgagttgactcataaatattatgcttttcgatgaggtaatttggtcctccagtaactaaacccctgaaggggaagtctaatattgtcctgttcttgaacttccctctaaatttaggactgatacagtgaggggttaccttttaatatgcagtatttactgctttaaaaactaaattaactactcctcttggtctattgttaatgaattgagggttcagcttaaccttcacaaactgtttaaatgaagcacctgatgatatttaaactcactgtaatatttcatttaaaataaatcccagaggtacaggttctaaggttgtaagaaagccacggtgttcctatatatatgtatttatttcttttacactaggccagacctttataatttataaccaggatgatttctgtggcctttaaatgtccacagtgcttgataatttcttccttgttcatggtcctgttaggtaaaagttttacacttacaaaattagatacaaagcttattctcaagaagcatacagcctgataaccatattcagtatctccacaaggataaagaagtgatctaatggaaagagatcaagtaatgatcaaatacttcatatttagaagatcagagaaagcttcaaggagaaattgccttaaacatgtgttggaagttagtatagatgggctttggtccttttagtggactttacagtgctctgctcacctgagtccatttatagctgtggatggttcttggcatgcagatgttttcctaagtcaggcatcagcacctttttgcttttctgcctttgggctttctctggcactagaagagcttgcttggctatgctgcagtttccacaggggaatggagaggagttaacaccctcaagagcaaccctcagacagtggctgatgggaaagaatctatagatcaatggccctgcctccccagcctccttcaggagaaccatttggtggtgtgaccttcatgtttaccagagggtccctaacaggattgtgctcctgtggctcacagtagtaacttcatcattaatgcagccattattgcattttctttcttttctcgctttccattttcttatatttcttgagatcacttctgaattaaaccatctacttccaaatccttttctcagcatctacttttggtgtacccaaactaaaacggtttgttagcgttggagaaagaacagcatgaatcaagttgtgcagattaagtatagcatcagtgagtggttcagtttaactagactatcaggtttatggttccagggcaataaaattagtcaggtcacaaggaacttaaaagtcagtctaaggatttggggcttttcttcaggcattgcagactttccaaagacttagcagaaggaggtgacatgatcaggattttgcttccacatagtgacttgatggcagtctttaaaagagatcgaagatgagggagactgaaagtgtggagaacatctaggagacggttctgtcgtgctaggatctaggttaggcagtaacactagtgggaatggaaaggaaggatagtaaatgctacatttagcaatcggtttgatatggatgccacaggagagaaaggcattaaaaataatgcaatatttctagctttgactgctaactgggaggatggcaatgctttgttcaaaacagaaaacacagaggacgaacatatttaagtgagataaaacttttagtttacttctgtggcaaaatctgttagttgtctgtacaacagtctttctccctttctttttcagtatgagaatcctcattttggtcaggcctatagtgtgtccagataagagatatttcccagcttcccttgcagcaggttgtaaccatgtgactaagttctgggtaatgtgatatacaacagtgttgtgttagacttcaaggaaggctgcatgagaggaggagacccatctagaggtaagcgccttcaccttgccctcattcttactgcctagcatcccaaaacacggaagtccagccagagtctcagacttttggagcttggaagccgcatgatgggaatttttaaagactagggagaccacaccagccccaaactgcctacctccagaatttatttgtttaagagagaaataaacatcatcttctctgaggcactggtattttgggtttccttttttacataagctgttgtacctaatgctgtctgatgacacagagtatattgagcctgaattaagagcagaatatctagatggagatgttcgataggcagttagaaataaaaataaatacataaatttaataatagcaattaacatttgagtgataattatatttccaggtccttattgtgtatgcaaggaggcatacagaggcttaacagtttgcacaagatatataactgataagtggcagaggtgggatggaaaccctatactctctgatgtcacactgttaactattgtgctgtagggtgggatggagcttagaagaaaggtcacaagaatttatttttaagagaagataagttgagataattctttaaaactactaaaaacacagaagtatttatttgcatacatatttcacaaaattgttttatgacttttaaatcatttacataatatccatgagatccacagtttttacaagtaaaattatgtcaagaaagaaattcagctgtcaatctgaattatagtaattggtgaattagggaagtttattaatatttctcttgtctttttagagatgtttattaagagttctaccaggtccaaacaaatggaaaggcatcgaataactataaagttagaaaagaatttagacattatctggtgcagtgctctgcctttaagatgaggaagtgagacctgaagcagttgagtgactgaaagtggtttatcagagttagggacagaaccaagaaaataattcggccttcttattcatccttaagtttcccatatgccaggcttgaagaaagctctgttgcaattacctctaagttctcactgatcctgatccccaggatgtgaaatggttaagtattatatttagagtacttccacagcagagggggtaagtcaggcacaaatccagccatgctgactatctgttgtaagagaaaattatttgtctcaattcctctttttaaaaaattcagattatgttttaatgtgattatttggctgaagaatatcatggcataaaattcaaattcctccttagagcgtacagggccttctatgatgtgctcgcctgctgttatcacggcacttccccttgctctagccatgctgttcctggacattgttgatcatgttcctaccttagggctgtctcacttacagtcctctcttctaaatactctactattattatctgcagagctgaattcctcacttcctttatgggtagctcatacgtcatttcacaggatatattactacctggtctgtttaaatggaattgtttatttttatatgtattcattagtctgtctgactttgctagtgtcatgaagataggcactttttttttttttgctgtatattcaatgcctaaagtagtatctgtctaacatgtggtatgtattcaataaaaaatgtgttgaataaatgaagatagtacgtgagggctaacttataaaagtagtattctataatacagattgttattttagagcccacttaatagttgttactttctgttttcttaaaaaccattatggaagtactgtaatcaagaggtttaaatatattgaaggccagttactaaaaatagtttatctggagcacttcaggtatgaggccttttcagagtctgtcatctgtagtcaatgtgagctcctttgttcttcaggtattccaaatttctggaatatttctgcagtttctaactaggactaggtgcctggccaccattatcttatggtagtaaatgaccctctagtggcctgagtgagttgatgtattttacttattgttaatttggtgcaactttgaagaattgctttcagaatctaagtctttttcaatatagagagactgaaaattttatgcatacaaatttgtagtcatagaaaataataataataataatggcaaccagtgtttatagaactgtcattatgtgtctgcactgggccaagctctttacacgtgttgaggttttaagtgtgtgtcaccatcagcaggtaggggaaattttctatttagagaaaaatagaccagttcatattcttaaacagaagagacagtgcacagctctacctgccttggaggaaattgtcattttatggtcttaaggaaggagatgaaataagcataataaatagtagtaaaagcagaaacacagtgaaagagacgtaaaacacattcataacaaagccccaggtgactgaaacataacctgtggataaccagcaatgaatgtgtaataggaatgtttcagatgattttttaagacattttattaagtgaagaaatgcaagcctttttattttgcttgacaactatttaattttctagtatgaccaataatacagaaaataaagtgaaaagggtaaaatttctaaaacaaagtggacaaataaatgattttggaaagaaacccaagtacttcaagatagagagaactgcagaataatcagaatcataaaattcaatcttcatcagatggaagtttggtcattcttatttaaacagtgcaaccatcttcatttgctaagtttcctgaagagttaagactactcacaaaacagaaaattccagtagctaacatatggcagcaatgcaatgaaatggaaagaaaaatggccagtttacctgaatattgtctcaccaagacagtttttttaatattctgcaagtggctggagaattgatttgcttgtatatggtttgacagagaaacattttttttttcaatctgggaaagcaattcccagaggatttaaaatagttagagaaattcatcatgtgatttttctcttctcaatgaagctttatctatgaaaatgacttgcatacatagttagtgttgcaataatatggcacaaaataaacaattcttttaaccatggtcatatatcattgaagacacatgcatctagaagttatatgcaatttatggattttctaaatatttaaagtgtcatgaatggctggtcttagttttagtcagtatgtttttattgccagtaagttacagatacagcagacaagtgaacacaaaactgattttgtgattgacttagctgaaagatatgaaacttctaatttaaattctcaaattctataatgcgattctgtatctatttgacgttacttgtaaagcaaagagaaaaaattgctacagcgtaccttgtggaataaatgcaatgagttatcaaatcaaatgaggcaaactgaaattattttgaatcttttttgtatttgagttttcatagttatggctttctaccatttttaaactcggtttagatatcatttcttcagaaaagcttctctgatccctaccaccactaccaccatcccctttcccagtattaggtgcttcagttctacactctcataacacttctacctttcctttttggcacctgatgcccttgcaattgttagtttaaattctctcatccagcctttattacagacaccccaagggcaaggatgatgtcagtcttgttaacaacctaaggtgagtcaagcacattgctccatcagttcttccttctcctgaatcataagctttcccttctctgttggctcatcccatcaatatacaaacatgctattgtttttccttttttcaaaataactctcttgactctatgtcccccatttctaactttcttacaacttttcatcaaaactccttgaaatggttgccaatactagttatctttaattttttcctctttcatccactttagtaacccatcactctactgaaaatgcttttattaaggtcaccaatgagtgccagtggtcaattctcatctatatacattgaagattgttagcagaggttcctaatactttctcagtgaatcagctacagcttggcaactacccacgtcagttttcttccacagaaggtctgttgataactgtattactttcctagggcttccataacaaagtacctcagtttctgcttaatactgcagaacttgattctctcaagttctggtggccagaagtctgaactgaaggtattcagggccacactcactccaaaggcttcaagaaataaagaatccttccctgcttccaatttgtggtggctttcggaattccttggcttgtggatacacaactccaacctctgcctccatcttcatatggacttcttctctgtctgcgtgtgtcactcttctctatgtctcctaataggacaattgtcattagatttagaacccacccacataatccaggatgatgtcatctcaggatcttaactacatctgcaaagaccctttttccaattaaactgccattcaagtttccaggcattaggatatggacatatcttttgtgggggcaccattcagctcactgtgataacgatcccagtgttcactgcttttgttcatagtggaggtatgatataatattctcgaccagatgccaattttaccactaattaattttttaattcaacagatagttattgagtaccccttatgcgtcattataggtcctgaagagaaagtgtaagcaaatccctactctcatggagttacattctagttgagggaaaaatagaattattcttatattacttaaagtacattagtacatttcctaaagttatagaagtcattttttttttttgacataggatcttgctctgtcacccaggctggagtgcagtggtatgatcttgtttcactgcaacctctgccttccagcttcaagtgattctcctgcctcagcctcccaagtagctgggtctactggtgcccgccaccacacctggctaatttttgtatttttggtagaaacggggtttccccatgttggtgaggctggtcttgaactcctggtctcaacggatccacctacctcagcctcccaaagtgttgggattacaggcatgagccaccatgcctggatgagaagtcattttaaacttataattaagtttctaaaagtcacaattttataaaagccagaacatacacaatacaaagcaatcttttccattcagtggttggcagactgcatatcagatgtttcacccacgtgctaaagcaaaagaaaaaaaaaagtgccaaaagtcttattaaatttatgtttatctgttgacaagtgatacaatgtcatgcatttagtgtgattttaaaccccagagtaaatgagaaagtgataccatgatgaccctgatttcgctcattaatgttgtatttataccacattattagtctaattaaaataaatataaacaatgtaccttccatatcatgaagccgatttcaaactaacttctgtttcatttaacacctctcctgcttcccaccttttccgaaatacttaattatgctgttttctttgctggctgtaaattatgtagattttgttactcttactaacactatatgcctaggcacttcacccaccttaaccatcaccctgtattgtgatagcgtcttccatatgcgtactccctagtgaacaatgagctctctaataggagaggccgtatcatttcagtttttgttttcccagcactctacacgtatgtgacatgtagtgggttaaaaatgaattaaacttagtcaactgtaggcttgacaagtacaaggagcaggattccttggatgctgagtgacctagctgtatcaaccaactgtctagtattgggttcttctttgccaatttaactcagtgtccttgtctttgaaaaacagagaataataacaatgaaaggacttatggattatttgtgagacacagtgatgtgtattaagcatgcacttactgtgtacctaactcttagtaagcactctgtagatcttagtcattaactttgcttggtttttgtttttagcattattgctttaaacatctatcctgacaatgaagtggattttcacttatacaaatagcttttaattgaaacacacagaggtttcaatttggcaggacccaaggtttaaaattgtaggcagcttaataaatagaaagtataattaatggctcaaattttgaaagccattaactatattttagtgacatgacttggaagagttagctgcataaagcacacatttttataaaaagaaaggtaagtggtgatgttttctaagctttctactgtttctcccaagcacctttttttgagtggatgtcatccttaacttttcccattcttttatattttatatttgacaattcactatgttttaaaaagggtttcttgggccggatgcagtggctcacacctgtaatcccagcactttgagaagctgaggcaggtgagtcacaaggtcaggagtctgagaccagcctggccaacatggtgaaaccccatctctactaaaaatacaaaaaattagcagggcgtggtggtgagtgcctgtaatcctagatacttgggaggctaaggcaggagaatcacttgaaccagggaagaagaggttgcagtgagtcaagatcatgccattgtactccagcctgggtgacaaaagcaaaactccatctcaaaaaaaaatttttttctcattaaatatttgttatatgaatctcttctctcttcgtcaatttgttaattctgtcttcactttatcactttgaaaattgaagtcatagaatttaagcaatgaataataatggtacttatataaatgaattttgcttttatattactacactcaaaatacattttcagtaaaaattgtttgaagtgttgcctattaagatgtttttaaataaattctcttgtgtatatttaagatacaaaacattataagacacatctatatagtaaaattattactatagtggaacaaattaacatattcattatctcacatagttacccattccccctacagtgacaagaacagctatatctactcatttagcaaaaatcctgaaaaaaatatactgctattaactataatcctcatgttgcacattagatttttggacttttgttcatcctacatatttgctattttacatactttgacttgcatcttcctatttcctcctcccacctcaaccctttattccttttttaatagattccacatataagtaagatcatgcaatatttttctttctgtgtctggcttatttaatttagcataatgtcttccaggtctatccatgctgtagcaaatgataggatctcctcccttctttaaggcagaataatattcaattgtgtatgtataccacagtttatttcatccatttgtctgtggacacacaggttgctcctatatcttggccatcgtgaatagtgctgctgtgaacatggaagtgccaatgtttctctgtcataatgacttcctgtgctattaatatatacccagcaggattgctggatcttatggcagttttgtctttaattttttgaataacctccagaccattttccataatggctgtagcaatttacattcccaccaacagtttacaaaggttctcttttctccacgcccttaccaacacttgttagctcttgttttttgataacagtcatcctaacagatgtgaggtgttatctcacagtggttttcatttgcatttccccgatgattaaagattagggcaccttttcatgtaccagttagccatttttatgtcatctttggagaaatgcatattcaagttcttcgcccattttaaaattggattatatgttttcttgctattcagtgtcatgagttctttataagtcatggatattaacccgttatctgttgcagggtttacagttttaaaaaataatttgtaggttgtctttttattttattgtttcctttgctgtgcagaagcttttaagtttgatgtagtcccatttatttatttttgattttgtaggctgaattttggcataatacacaagaaataattgtcagggctaatgccaaggaggtttttccgtatttctcctaagacttttgcggtttcaggtcttaagtgtaggtcttttatttgttttgatttgatttttgtacatgatgtaagataagagtcaattttattatttcgcatgtggaaatcaagtttttgtagcactatttgttgaggagactattttttcctctttgcgtccagttggtgatcttgtcaaaaatttgttgactgtgtaagttcgggtttacttttgagctctctactctgttctctgtgtctctttttttatgctagtaccatactgttttgattactgtagctttgtaatataattttaaatcgggcagtgtgatgcctctaaccgtatttttctcagaattgctttggctattcatagtattttgtggttccccatttaaaaaatatcctattaagttttcattttctaaaaaccacactgagttattgaaaaatggagtttttagtccactagtattattttaaaatatctaattttagggattttgtgtgtgtgtgtatgtatataagaaattgttgagagacagcattgagttggggtatggatcataggctccagaaccagtcttccagaacttgaatatgggttctgctacttatagctgtacaactttgggcagaatggttaatctctctatgcctcagtttttttcatttttaaaatgaatttaataatgttatttactaacagttgtgaggattgaatgagttaaatcacttaaaacacttagaataatgctagacacatagaaagaactgaataagtattagttctgcaaattaattaatggagtgaaaaggttttttgttttgttttgttttatttttggttgtgagtacacatagataagtcccagaggcaggaagtcatgggatttttacagagttaagcagtaaaagaaagcccatgaaaatgagacttgggccaggtcttagaggttctgccctcaacattccaaacaagaggccacagtaatcccacatcccgtaggtcatctctgagatcactggcagacttcccacactcagagatttgaaccttattctataggcaaagggaaaatattgaagatagtacagaggctagtacatgggctttagcagcaaactccctggaattggcttctgattcttttctgtacctgagtttcattattgataatagtaatgattcctactttatagggtcttgcaatgattaaatgaggcaatatagctaatatattcagaacaaacttgtctaaccccagctggtcacaatggctttgaatgtttgaatgcagcccaacacaacttcataaactttcttaaaacattatgaggtttttttgcaattttttttttggttttagctcatcaactattgttagtgttactgtattttatgcgtggcccaagacaattcttctgcttccagtgtagcccagggaagccaaaagtttggacatccctgaagaacattgcctggctaatagtaattgtttaatagaaattggctattaaaaattgtgagcaaaggaatattgtgagcagatctgtgtacctttacataattctaggtaaagtgcctgatcttctatatgagaacagagagaaaatgagacgtctgtagaagagtcaagattaatgagtatttcacgcttgtgctacttttccacaaggttggcctggggacatgggtgtggaaaagggaaaaccattgctgaatttatggcagttattgctaagcctcagggggcattaataccatgggatctccaggcctcccttaggtagctagggagcccggggcatgagtagaggaccacattcagagttcatggagaagattgcctctattccatagagtacctttgtgaacattagaagagggtgccactttctttggggccatataaccctgcagcagggcacatggcatggtaaacagagcctaggactcaccccctttgctagatacctttggacaggacacaacctgagcaacacacttatgtcctggccagagagcacttgtgattacgggaaattctgcctagtaagaaaacatgtgcattatttatgtctgtacatcttttgaatttggggtgatcttatgattttctttgataaatagaatgtgatagaagtaattttatgtgacttctaatgctagaccttaagagaccttgcacctttcacttttaccctcttaaaattctgctctgggatcgctatgtaaagaagtctagtccagcctcctggaggatgagaggccatgcagaggagaactgaagtgctctaggtgacagccagcacttcctggcagctgcgtcttcataagtaatcccaggcaagatggcaagaacaactgcctagtcatagagttgctgaaccacaagatcttgtgcaataataaatgagttttaagcctctacattttgtggtagtttgttatacagcagtggataactgatatacatatgtaggccaaaagggaaggaacagaggtaattctcggtctagaagtcatctgtagtgaccgttttctctcagcttccaataaagatgcttccagtgatatggcattgagtcagaacatttccttttcatgaacagagatattactgcatcatacaagtcagtttggtctgtaggagcatcagaaatgactacagagatttccagcatagtttctgatacccaaatggcctggaaatgtctgctggcatattacctttctagttactatgtgcctcataaagacagcaacaaaagactcagcaatattaaaaatgaagaaccaagttgctggtttattctagttatcattatcactgagagtgtgctgttacaatgttgatagtgatgtacgcgtttacgaagaaatgacttctaaaaacactagctagactagaaagtcacataatgaagcagtagaaagtgtagcaggaatctgaagaattgagataaattaaaaataaatgggaggctgggtgcagtggctcatgcttgtaattccagcactttgggaggctggagcaggtggatcacctgaggtcaggagtttgagaccagcctggccaacatggcgaaaccccatctctacaaaaaatataaaaattagccaggtgtggtggtgctcacctgtaatcccagctactcagaaggctgagacaggggaatcacttgaacccaggaggtggaggttgcagtaagctgagatcccaccactgcactctagcctgggtgatagagtgagactccatgtcaaaacaaacaaacaaacaaaaaacccaaaatgaaatacctggaaaaattggaaatatatatacattatatttaccaaatggggaaaattaaataagcaggtgaatctttgtattttggtcaattttactctcatgattctgattttatgaaattattattttctttgattttgcagtgatttttcattagctggaagctacagagcaaattattttgatgccaaagtgaaaaatatggagatatttattggaataatacaaacttctttctctttctcttcttctctttctttcttttaaactaaagtctttcatgaaatgggaattaataatgaatgccagctgccttcacactggattcttgctggaactttcactccccaattcctaatgctcttcttctggtagagcagagagccatgcccaagcagtcaacagactataacctggccttgcttggtcctagaagctgaatacctacctccccacaagagatggcataagagtaagaaatgagaactacagggccgggcacggtggctcacgcctgtaatcccagccctttaggaagccgaggcgggcagatcatgaggtcaggagatcgagaccatcctggctaacactgtgaaaccccgtctctactaaaaatacaaaaataatttagcccggtgtggtggcgggcgcctgtagtcctagctactcgggaggctgagacgggagaatggcgtgaacccgggaggcggaggttgcagtgagccgagatcgcgccactgtactccagcctgggcaacagagcgagactctgtctcaagaaaaaaaaaaaagaaatgagaactacactgagtgtggtaatactgaccctgccacagaaaacttgacatctggtactatggtctctcaaatttaaagctctttcttcctaaggatgaaggagtaagggtgaaaggactgggtagaggctgggacaagggtgggaaaagacctaccctttgagattaaattaagagggtatagggtgtattacctatgctttttttttttttttgaggcagtgtcttgctctgtcacccaggctggagtgcagtggcataatctcggctcactgcaaccactgcctcctgggttcaagcgattctcttgtcttagcttcctgagtagctgggattacagatacatgccactacgcctgtctgacttttgtatttttagtagagatgggttttcactatgttggtcaggctggtcttgaactccctacctcaggtgatctgcccgcctcggcctcccaaagtgctgggattacaggcatgagccactgcgcccagcctgatgtatgctattatatgccaaaatggaaagggtattcagcttctttttatggggaaaatgtcaaattgattcagttaaaatagaagaaatattagtgagtgtatcagtagtaattatgcttgagtagcatgaaatcaaactgaatttgaatcatggctctgctacctgctagctgggtaaattgggcaaattactcaatttctaagccatagtctccttgcctgcaagataggaataatcacaggtcctgccttgcaggattactgtcagggtttaataaagcaaagcatttaaagcacttagcacattgcctagcacacagtcagtgctcactaagtggttgctactattgtggcataagtcttttatttagataacaaagcagcttacattttaatttatatgttattttaagtaatttagttaaaaccaaatctcactttatctaaaaactacaatatgattaatatgatttataattagtgtcactgttattcataaaaactatataaaatggacaaataggtcaatgttatcaggggatacagtaaattagaagcataagaaaaagtttaggataaatcatttataaccttgctaaaagggaataatattgccagagagatactttgtcagggagaattataaaatgagtacattctcctgtgttttgcgttgcccaatccttcaaattgctcaattgagtggttacttctgagtcctcattttgtgtgacttagcagcagcatatgacaaatgatcgccattccctccttgaaacatatccttcacttggctgctaggacaccacatttgcctggctttccttctccctttccgtctgttccttatcagtttttttctgattcctccttatctgcccagcctcttaatattgaaataacccgtggaacactctttagggctcttttctgactacattcactccctaggtgatcgcattcagtctcaagttgagttacaatctatgtgctgatgactcccaaatttgtatctttagtgtgtgtgtccctcctttcaatttcagacccataaaccaactgcctattttttatcttcacttgaatatccaactccacatatccaaaatcagcttcttctgtggccatcaccgtctcagttaatggcaactcttggtattcctgtttttctctcacacataacgtcatgtagttcagcagaaaaccttgtcagttctaccatctctgtgtgtgtgtatatatatatatgtgtgtgtgtgtatgtgtttgtgttccatatatatatgtagagagagagagttcaccatcacccattacacccctatgaccaccatcatcctgcttcaagccagcatcacctctctcctggattgctacaatagcctttgtctccttgcttctactcttgcccctctgtagtttgtttccaacacagcagccaatgtggtcttgttaaaatttaaattagattatgtcatttttctgctcaaaacccttcagtggctttccttttagggacctgggtaaacagcctcctattacctttctgatgccatctcttaccactttctccctggttcatcctgccccagccacagcggtctttctattgaactttaacgcaagctccatgagggcaaggatttttgtccattttgttccctgcatatctccagcatctagaccagcacttggcctaaagtaagcactcattaaatatttcttgaatatattatggacaacttctgaacccatctcttttgcacaattttcccataaaggtcattgtataaggcatcaatgtatgtatcagtctttaccagaagtctgaggtaatgatgagatatttgttcatcatcatgttatttaatgtgtttcttcctcaagattactgacacatttccccaattccccattttcctggttgctgtcatcctctgactcattcccttccccagaacttgattcctttgtttatcatacagtgtaaaacagtcctcttctcctgtgctggactaggtctggaaaagtttaatccatggcttgggaaaaaaagactggaaaaatggcattttcctgtttcctttttaaaatttcagtgctttgatgtttgattttaaaaatcatcgcaaggatagttctaggggcaaaacttaaagttggctttgttaaggtaacaccaattgccgtaatacataattctccaaatttcagtggctttacacaaaaaggacttttgcttgcttcatgcacatctagttccaacagtcatttctgatcactgggcctctaagtggctccttcaataatgcaaacctgccatcatgcaagtttgctgtggaagagggaaagagtatagaatattattgagggatgttttataggacatgtttgtgactatacatccactactattttactgtccagaatttggtcatacctgaatgctggcaagtttggggcatgtgattcacatgtatacctaggaagaagcagaaacaagtttggtgatgacccatccagagtctctaccaaactttgtattgccacactttctctctcactccttattcataagcctctgatgtgtggatcctcttcttgcttggtgttggatggaatcataatagtaatagtataaataataaatattttctgctattcactgcttatattatttaattatcaaaaactgtgaggtaggtctacttatcaccatttatagatgtggaaattgaggcattagtgtgtctaacgtcactaacttgtaagagttgaaaccaagatttgaaccaggctgtctgacttcacaatccacctccctaacaaggacactgtattgcctctcaagttttgaagagttagacctcttttcccttattatattgcttcttgaggagccaggatgaacctggaaggaactttgggaccccatttcaacttcaaatttcctccattcatttgctgatttgacttctacacttatgtctccaattcttaaccagaatgactcagggcctcccagttctcagatcagtttcagacagagtggcaacttgaggctaaagggtgaaggaatggagccctgtttgtgtaagaattctctcagagtatttcattgtgggcacttttcacagttccaactctcctaattgaaacacatttcaccaaacactccaagtgatatggtaattaaaattaaatctgttgccaaaaaaggcaaagaaaatagtataagcagtctataaactattataatatcacctgctaaagatatttattctggagaaaacaatgcctataacttataaactgatacaacagagtgctattttttagttttatcggagccaccaaaatacaatatatatcagatactgaaatgacttagaagatatcaagatgcagattttcttttttattttttcctttttttgagatggagtctcgctctgtcgcccaggctggagtgcagtggtgctatctcagctcactgcaacctccacctcccgagttcaagtgattctcctgcctcagcctcctgagtagctgggattacaggcacccaccaccacacccagctaattttttgtatttttagtagagatggtatttcaccatgttggccaagctagtcttgtactcctgaccttgtgattcacctgcctcagcctcccaaagtgctgggattacaggcgtgagccactgcgcccagccgatgcagattttcaaaggaaatgttcaactaatggatttcatcccccaacaagtgtattcaaaagtcaggtttttcgagattaaagattttgtgaggacaatttctttggaaaatagcatctgctgttatttgccaccttttatcccatggcaagggagggaagtatgtgtgtacgtacacgtgtgtgtgtgtgtgctgtgactttcttcacacactgcctataggaagaggcctcagaggagactctaggagtttattgtctcccccagacttgggagagtacagctagctcatgtctgatgtccacctgaggtatctgaaagtgaaaagctgtcaaaaagggcctttggaagctaagtagagggctgtgtttgggctgtaactgaactctactccagatgggccaaaggtctgtgactcctggggaccagacatgggacccagagaagcagacaccactgtccaaagtaattttgactcctgcttgagaggactgccagagaccgcagagcaacttcagcagtctttgagtaatggaagatgggaaaactagaggctgagggggaattagctgctggagggttagaatgaatagtccatgtcaccggagttacaatcaaaagaggacagtagaagagcacttgagaacccatgaaaatgtgtgtgtgtgtgtgtgtgtgtgtgtgtgtctgtgtctgcatgtgtgtatctgagagagagagagatgtaaacatctgcgaggccaagagagtgtgaagccattttacaatagtattagtcaagtgagaactttgcagcccgtctttcccacatctctctttcatttagaccctagagaggtcagattaccacagtccaaagtaggggaagagggatggtagtctaacctttgaataaagattcaattgctgtttaatttgttagacaaacttcagtgtactaaattgagactctgttcagcaactaatgtctttttattacctatgaatgtccagagatgtcatggagcctgccagagttttcattcgttggaaagggaaaaactttccctagtgaatggattttttaaacagtggggccaggcgcggtgactcatgcctgtaatcccagcactttgggaggccgaggtgggcagatcacttgaggttaggagttcaagaccatcttggccaacatagtgaaaccccatctctaccaaaaatacaaaaattagccaggcatggtggtgcatgcctgtaatcccagctactcaggaggctgatgcaggagaatgtctttaatctgggaggcagtgagctgagatcatgccactgcactccagcctgggcaatagatcgacactccctctcagaaaaaaaaaagaaagaaagaaagaaagaaaggcggtgagagacaaacataacattgactttggattttatcacatgatttacattcatgattacatctcatcatgcagtgcgttgattgtgcttgttatacggaatgtattgctcctcagcaaatatggattttctaatatcactaatttttaattcagaattaatatttgaatgtattaattttctgccttttagagagtaatggagtattgtataactcattgaggattgatcggtatgtaccttaaatcttaaacaatttgagaattattaacaaatctataattaagtctaccacttagagaatcttttctctggcacaataggaaagttaggttctagttgaagaaactgaagaaagaggaggcagttttgaggtctttatttggccattagcttgctttaactaagaaggtttttttttcctgtgctttttttacccccttatctgagtccttgtaaaaagaaacaatatcctcagtgtatgctaaatgcttgacagattaatttttctgcatcacaattgaaaaagttgctcttaaaccagagaaatgaatagatggttctttgtagacttacttggcattgttttcaaggagtttctctgaccatgtcacatagtggatcaatcaacagactttttcagcatccactaaatacttattattgtgcttggcaccacaggatttggaattcagtccaaataaattcaatagattataattgagtactatcccatgttagacactgtgctaggctctgagaaaattagcatgaatgattaaacccaaggtatgtagtctggttgtgaaatacatgtataactaatactgtacatagtgggatgaatgtcaaatgtggagtacaaacaaagctgagtgttagtagtgatgaggaaatgattcattctaactgaaaagattgaggactacaaaataataggtatcatttatgaataacccgagatggtacaggtactctataaagaattgatatttataagtccccttgggatagttttcatatcctcattttattggttagaggattcagaaaacttaagcagcttgtccaaatcacatagctagtagttatcagaatcagcaactagaatctgagtctgtttgatttcaaagcctatgttcttattagcaacactgtgacatctgtgcttgcaggggatcatttcagattaaaaggagcagtgtaaataaaggtacaggtttaagaaggaagtgttgacaggtaggttgtagtccattgtgactaggcatggcttagaagccctggaaagactgaaggcatattgtggaagattttgaattctatgctaagagattggactttattctaggtatagtcactaaaaaattataaaaaacaaaaaagacaaatagacaatgacaatatctaataggtgctaattatctgatgcaaatcagtgtatctcaatgtaatttaaaaattgtgctattattaatacaatgacaatattaaaaaataatacgtcatctaaatcaccttataactgagtccaccactgcaactgtttgcttttctgttcatatgcatgttggttctaagaagtacacattgggctaatgagaatagaacagaaacaaatttcatgtgtaaatgacaccattttaggaagtgaacgtcaaatgatgttagactgcacacactgaacaaataatgtgttcatattaatgaggagagagaaaaggagtgagagacgcttatcacctcacagctcactgtggcctatgcacaacaggcttctaggtcttgcatcagcctcatatcttcagtgggagtagttagcagaagtaaaaatcacattgagttaatgttaatttgaaatttattgattttggtatttaatatataactttgctttggtttcataattacataaatgttatgaccctaaggagtttataacattttaagttagcatggatttaaatacaaatatgctatatagttatacttaaggctaacatgggagacccagaaacgtgtttttctcttaagtttgaaaaatacttcatgaacaattcctactgagaaacattaacatagtacctgaaggaaaaggggctagaaggtggggacgaattccgaatgaaataggattataagcagaaacacagaaacaggaatgaagagatggttacactagagcatgaagttcgttttgtggtaagtaggcaagagagccagacaattaagaaactcatatcactgaagtttcatatcaccatagaaaggggtcaatatggactcttcaggaagataatgaaaatgtgacttaatttgagttacccccaaaacacactctgagaagaggatttgaatgaaggagttttttggggggctggtcccaggaagcactggtagaggcttggtgaagtgagacagaggaggaagggaggaccataaagagtatgttacctggccgggtgcagtggttcacacctataatcgcagcactttgggaggctaaggcaggtggatcatctgaggtcaggagtttgagaccagccaggccaatatggcgaaaccctgtctctactaaaaacagaaaaatttaaaattagccgggcgtggtggcacatgcctgtaatcccagctactcaggaggctgacacaggagaattgcttgaacccaggaggcagaggttgcagtgagctgagatcatgccactgctctccagcctgtgacagagagaaactgtgtctcgacaaaaaaacaaagtgtgttaccccaagcatgttacctctgtgggtcactagagcttaatcccactgggaactctgggagcaaatgcagaacatgtgccttggggctatcccttcaatggacagagaggctggaatgcttattcgccttcttccaccagcatttggttgagagatttcccagggcacgtagactcagcggcaggcctagcctgaggcataagaaacaaggcagtggctggaggccaaagaaagcccccaggcagagcaatgcaggcactggcagttggaagcagggctgtgtgcaagaaagtggtaaggccaagggaatatgggaggagcgtccagtgtctgctaagtgaccttttacctttttaagactgtccattttgtggacaaaggacactgacatttcagagtttctgtcatgtgccttgaattatgctgaacacttttacatttgaattttataaaaattctgtggtatatttattttctccatgagggggtggaggggatctccaatagcacataaagctcacgctcagaaagtttagtacctcttgaaggtgacactgctgagtcatgttgaagttagaattgggagaggattttgaacccaggtatttctgacccagaggcttctgattcttctatctactgatggaatggagaaactagaaagagtttggaaattacaaggatagaagataataatgaatttagattgtgccctatttttcatttatatgtttattaagaaattaatttttttctttattctaattgcacatggctaataacagtctcattttcaatgtgttaaataataaggtttttgtgtccttgagtatttattttggagatacatgacatagaaacatcttaacatttagggataatattcttttatgatagtgtttctcatagttaatctgaagtttttaatagaatcagtaataataatgacaatatccatcttatattattcttgtaggacttttcattataccaaataaattactaaattaattttagtgagtcattacaataggtatgtgacaccagtaacagtcttattattaccaacttaagaagaagctaaagttgaactcagtggcttgtctgatgtaattcagctcatctttgatgaagtcgggtctgagaactgcattatttccggatttgtttgtggaatgcaagtgtagctccctttatacaatgtgcagttctgaaaaagtgaattgttattactacaaatcttattattcaaagcaatcctattgtgaatcctttggtaaaccgaatagcttgtcttttgttcaaatgtggattttttgcatttagatttgcctgaaagtaaagagtactttggccatttttgccttggaaatcattatatttgtttcttgatgcacatcttacatcttgaggttttcctcttatggcagtcatagagattttcctttgaatgtgtctttccacttacggttgctgcaatctcctgcagcatttgtactggttggtatcatttctcaactattgatttcaattaccttatctaggtccttaggacaagaagtgagaaatatgatacccaactctaaagaaagaggttttgaagggaaatgtgctggaatgtggatagagcttttttctgttctaacatgagaatcaggactacctacattcattgatattggtgctgatagtgttattgcattcctatggacattaagaccaccaaggcctgcatatgacttgtactttcaggcctgagaatgcttgtagtttgtcagcggtttgggaatatggttcccctctgatgtgtgtccctacttagccctgtggatttaggctcctcttcttgaaatggtgccatctatctttgatcactgctgtcatttcctaataacccacagcttcagactgtttggctgtgttgctttggagtgctttttttcctgcttaccttgcatgtggttgttccagttcatctcatctgactatataagcagttacttaggaattctgttgtaatctgtctttgcattcctaacctcgtgaaactgaggcatatgcagcatgcttcagtgatgggaagttgatcaaatgctttaagtacgtgggattcattgatgtgtcgaatgttggacataagcaaccttcattctgccccttcatcttattttatattactttaaatagtagaatgtactgtattcctcgttataaatggaaatcttagaacttgataaaaatttaaaagaaattacctatagatccactacctaaagaatgccactcttaacagttttttccatttaattacctgtgtccagttcattaaaaatacatttatagcctatatataattttatattttgcttcttatatttaacaggacatgattggcatttctgaatgtatataattcataagtataattttaatatttatatactatttagaaagagttttcataccttaatttatttaaccaaacccctattacattatgttttaaatatttcaatgcatatcaccaaattgtcttccaatagtgtaataaaaattcacattcttattagcaatgtatgatagtgtctattttactgaaccttgttcctctatagctattctaattaataccattgtttctggtaatctgctggacaagaaatgccatcttcttattttaaattgcatttattaggcttatagcaaggatgaaaaattgttgtatgtttttaaaattctattctttcttataaaatttctatttatattctctgttcatttatctattagtttctcagtggttttcttattggtatgtatgagtaattttcatagtaaatatattactcctttaccatatcaactgtatatatttttctagttcttatttttaacattcaatagctgtaaatttttatgtagctagatgtatgatcctttattccacatgagtttttttttttgtttgttttcccagtgaggaaagtattcagctctaagtaacagaattcctaattaacagtgacttacacaagagagtggtttatttttcttgcataaacagaagtctggtggtaggttgtaacagcagtggtttagtttctcagtaaaaccgttttagaaccaggcttttttttctctttgttctatcatcttttatcattatcagatttttaaaaatatataagcaacttcttcattaagaaagctaaggcccagagaagttaagtgatttgtccctgctactcagctaatggagtttcctttttctgtctctacactctttttttttttttttttttttgagacggagtcttgctctgtcgcccaggctggagtgcagtggtgagatctctgctcactgcaagctccgcctcccgggctcacgccattctcctgcctcagcctccctagtagctgggactacaggtgcccaccaccacgcctggctaattttttgtatttttagtagagacggggtttcaccgtgttagccaggatggtctcgatctcctgacctcgtgatccgcctgccttggcctcccaatctgtctctacactctttctgttgcactgtgctgtcgcatatcttgctgtgcatttcacattggtacctgctattggcatacaaaacacatacaaatatgacttcgctctgtactccctcaagaggtgtccaggcaatattatgtattagcaattaacacctcagctattaaattcttttataataaaccataatttaaaataacatgggaattcagtatctgctaagttgaaaactttatttactctcattgtatttttgcagatgtgacagaactttttgatagaaagagctcaaatgtttaagagcatggttcaattcttattttatgtattaaaaactaatttgtagcaggagatcctgaaacctactgaagtgaaatatcagacaggctttgatcaacgaaagaaagaaatactctcatcaatctttgtaagcctctcattggtaaatctaaatcaacatatataaagtctatatctgtgcaaagcattcaacctgcccctgtggtaactgagctcgtaaattagttgaggagacaagagcaatagataatatttaatccacaaaagatgtaaacagtagttgaaagcaactataaattaaatgccacagagtagggcatgtctactttctaagcaatagaatacataatattttcttaacttcacttgtctatgaaccaacatcattattttttgccctaactataaagtttatttaaatattaatatattttttctttaaaataactttgaagcaatttagtttataaaacttaatcttgctgagtgataatacccatgaactcatgaattcaatcttctagctgtacttttttgtttttaactgtacatattttaacacattaaaataaatgtattaaaaaaatggtcttcatgtatcatctaaaaattatcttatgtctcagtctttgggaaacactggcttaaacaatcaattactagggagttcagatgaggaacaatagaacaaatttgcagtgattctattaaaatatatgaattaaagaattctcttgttcccctaaggccataatcaaaattatagttcagatatattgtctgctaggtaatagcatattaataaggatttcttatgtgttcatagatattttatataatttagctttaaaaacagccttcagataacagtctttcatgagtgttgaaaagacttcagtttcattcttaatctttcagtaatagatcccaggagtgaataaggttacgcatttcacttttataatcatctttgctcagtctgctgaaggtaggaatgccttaatatggcatagcacagtattttttctaggctgctttataatttgttgagaatgattgcaaatcttactaaaagcaattcagatacttcaaaaagagctcatcattcatgattaaagacacataagcctaaagaagtatctccagctaattttgaagaatcattaaaatattttgggaatcagccctcttaaacaaatataacaaaatttagaattctgtttacacttagacatttctaggcttatattcattagcccataaaatccagactatagattaaagggaaacattttaaaatgttagctgttttgaatggaaatctttctaaaatatactatgcaattctaggcctgatagtgaacaaaacatacattttctttaagactcaggatctttttttttttttttttttttgagactgagtctctctctgtcacccaggctggagtgcagtggtgcgatctcggctcaatgcaagccccgcctcccgggttcacgccattttcctgcctcagcctcccgagtagctgggactacaggtgcccaccaccacgcccggccaacttttttgtatttttagtagagacggggtttcaccgtgttagccaggatggtcttgatctcctgacctcgtgatccgcccgcctcggcctcctggtttccgttggactttattttgcagctattatgcttgtctccctaatacgcctctacttttactatccttcttcaaatgtgttactcgcagtattctaagacctcagaattacatagtggagtttgttaaaggtatcattatagcatcagaaagtggagacatcaggggcttttttcttcctacttctaattcagggtagtgttgtgaatggttgcagttgtgagaggattaaagattcattaagtgagctgtttagtgaactattttctagtttttattagttttgattctgaatgatgatcgctttattaatgcttcatcaacacactgggatttacagctttcaaaggttacttttatatgcaagattggatttggtctagactgtctgagtttactaatgtttaccatcttgagaactgataaagtgaagacattcaccaaacacttagaaaattttaaagacataccttttaactggctatgacatagcaaagaaatattctctttcttttacaactctgctatttagattctatccgtttatacttctcatcttagttgcatacaaaaattcacatgtgtacacactccccccgtacacatacagagaacaataacttttattatttcattcattcccttggggatcaaatatgtgtccaatgagaagatccaggatgtcatactaccatataccaaggagacctttgttggggaaacaagttgagaaatgatgatccgttaatgatgtccacagcgggggctgcaagacatcttactgacaagagaggaagaaaatactggaagtagtacttatatttatatcataaattaaaagtcagagggctgggatcatgcctgtaatcctgacactttgggaggccgaggtgggtggatcacttgaggtcaggagttcaagaccagcctggccaacatggtgaaacctcatctctactaaaaatacaaaaaatttgctcggtgtcattgcacgtgcctgtaatcccagctacttgggaggctgaggcaggagaattacttgaacccaggaggcagagtttgcagtgagcagagatcacgccattgcactccagcctacatgacagaacaagactccatctcagagaaaagaaaaaaaaaaagagtaaataaagacttactagtaatcaatatccagagcttacaatttagatatttagatgaggtatcttaaatgaagactatttgacaatccagtggagttcacagaagttccttctttaaatattaactttccaattattgaaatattttatgattgtggcatattttaacatatttcaacaagatgatataatgttaattttatacaagtaagactttaaaaattatggatcattagaatactttttaatgagatgaggaatgactgggaaaatattttgaattacattgaggcccacagtttttctggtgacaaagttcttgaaaatgttatttaagatgagttatatagatttacacaaaagccaggcttctgatttggttgatgttttctgtggccatctgtggcagtcagaaagcagttattttggcatgaggttcagagagcttctaggttggtgagcacatggaggtgctgtgagtgtggtgtactctgagagggcatgaaagccccttcccctttactttggcctatggatcccatccatttggctgttcctgagttgtatcctttacaacatactactaaatataaaagaagggaaaaaaaaggcaagcagttatgttgaaaaacctgaaatatactgaattagtctcaaacacaataaagtcaatgttttagtaatgagtgaaaaattaagtgcttttcaaaaggagcccatggagaaagcattctgaaatggctatttggcaaggctgtcatcattttgttttactgtatgttcttttcttaaggatctttgaattgtagactagtttacatactttataaataatctaggttaatattggcaacacatgtaacagatattatacttttataattattcagaaaattatatatacctttaatccctccccaatactcactttaataaatattaatttattaccaaaagaaggtgtgagatctaagaactctgagtcttgtagcaggtaagacatttgtaagggctacttcttaataaaattttccatttcctttagatgtttctaaaattagaagttttaaaatatattcgtttgatgtgattacttaggggctcaagcagagaatttagattgattgggcttgcaataaaaagggactttaaaaaatgacatcatcagaaagaaggcaaataatcagctctttctggatcaggaaggggaattctgacaaatatttatacttatgagacatatacatgggtgcaagagaagtgacatcggaagaaaaagtacacatttttgtatttaaaaatctatcaatattatatatgaacatctgaaagatatttatatataaatatacatgtaaatattatggcatataaacagatttatatatgtgtgtatgtatgtaggtaggtatctacctatggaatatactttttcttcagaagtcagttcttttgctttaaaactttctcctttaggaaaaaaattaacactgaattttaccagttctaatttttttttactttaggtttttgtttatctaaatgttataaataatgagcacaaaataattttatgattattatttcatggatctgtttctgatagatttgttaaattatactttaagttctgggatacatgtgcagaacatgcaggtttgttacataggtatccacatgccatggtggtctgctgcacccatcaacccgtcatctacattaggtatttctcctaatgctatccctcccctagtctctcaccccctgacaggccctggtgtttgatgttcccttctctgtgtctatgtattttcattgttcaactcccacttatgagtgagaacatgtggtgtttggttttctgttcctgtgttagtttgctgagaatgatggtttccagctccatccatgtacctgcaaaggacatgaactcatccttttttatggctgcacagtgttccatggtgtatatgtgccacattttctttatccagtctatcattgatgggcatttgtgttggttccaagtctttgctattgtgaatagtgctgcaataaacatacgtgtgcatgtgtctttatagtagaatgatttataatcctttgggtatacacccagtaatgggattgctgggtcaaatggtatttctggttctagatccttgaggaatcgccacactgtcttccacaatggttgaactaatttacactcccaccaacagtgtaaaaaccttcctatttctccacatcctctccagcatctgttgtttcctgactttttaatgatcgccattctaactggtgtgagatggtaacccactgtgattttgatttgcatttctctaatgagcagtgatgatgagctttttttcatatgtttgttggccgcataaatgtcttcttttgagaagtgtcagtatgatattggctgtgggtttgtcataaataacttattattttgagatacattccatcaataccaatttattgtgagtttttagcatgaaggggtgttgaattttattgaaggccttttctgcatctgttgagataatcatgtggtttttgtcattggttctgcttatgtaatggattacgtttattgattttcatatgttgaaccagccttgcatcccagggatgaagccgacttgatcatggtggataagctttttgatgtgttgctaattcagtttgccagtattttattgatgatttttgcattgatgttcatcagggatattggcctgaaattattttgtcattgttgtgtctctgccaggttttggtatcaggatgatgctggcctcataaaatgagttagggaggattccccccttttttttttatcgttcggaatagtttcagagggaatggtaccagctcctctttgtacctctggtagaatttggctgtgaatctgtctggtcctgggcttttttgggttggtaggctattaattactacctcaatttcagcacttgttattggtctattcagggatttgacttcttcctggtttagtcttgggagggtgtatgtgtccaggagtttatccatttcttccagattttctagtttatttgcatagaggtatttatagtattctctgatggtagtttgtacttctgtgggatcagtggtgatcgcccctttatcattgtttattgtgtctatttgattcttctgtcttttcttctttaacagtctggctagtggtttatctattttgttaatctttttaaaaaaccagctcctggattcactgatttttttgaagagtttttcttgtctttctctccttcagttctgctctgttcttagttatttcttgtcttctgctagattttgaatttgtttgctgttacttctctaggtcttttttttttattatactttaagttttaggatacatgtccacaacgtgaaggtgcaggtttgttacatatgtatacctgtgccatgttgttgtgctgcacccattaactcgtcatttagcattaggtatatctcctaatgctatcctttcccccacccccaccccacaacagtccccggtgtgtgatgttccccttcgtgtgtccatgtgttctcattgttcaattcccacctatgagtgagaacatgtggtgtctggttttttgtccttgtggtagtttgctgagaatgagggtttccagcttcatccatgtctctacaaaggatatggctgcatagtattccatggtgtatatgtgtcacattttcttaatccagtctatcattgttggacatttgggttggttccaagtctttgctattgtgaatagtgctgcaagaaacatacgtgtgcatgtgtctttatagcagcatgatttataatcctttgggtatatacccagtaatgttgggtatatacccagtaatgagcatggaatgttcttccagtaatgggatggctgggtcaaatgctatttctagttctagatccctgaggagtcgccacaccgacttccacaatggttgaactagtttacagtcccaccaacagtgtaaaagtgttccgatttctccacatcctctccagcacctgttgtttcttgactttttaatgattgccattctaactggtgtgagatggtatctcattgtggttttgatttgcatttctctgatgaccagtgatgatgagcattttttcatgtgttttttggctgcataaatgtcttcttttgagaattgtctgttcatatccttcacccactttttgatggggttgtttgtttttttcttgtaaatttgtttgagttcattgtagattctggatataagccctttgtcagttgagtagattgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctagcttttcttctagggtttttatcattttagatctaacatgtaagtctttaatccatcttgaattaatttttgtataagttgtaaggaagggatccagtttcagctttctacatatggctagccagttttcccagcaccagttgttaaacagggaatcctttccccatttcttgtttttgttaggtttgtcaaagatcagatagttgtagatatgcggcattatttctgagggctctgttctgttccattggtctatatctctgttttggtaccagtaccatgctgttttggttactgtagccttgtagtatagtttgaagtcaggtagcatgatgcctccagctttgttcttttggcttaggattgacttggcaatgcgggctgtattttggttccatatgaactttaaagtagttttttccaattctgtgaagaaagtcattggtagcttgatggggatggcattgaatctataaattaccttgggcagtatggccattttcacgctattgattcttcctacccatgagcatggaatgttcttccatttgtttatatcctcttttatttcattgagcagtggtttgtagttctccttgaagaggtccttcacatcccttgtaagttggattcctaggtatgttattctctttgaagcaattgtgaatgggagttcactcatgatttggctctctgtttgtctgttattggtgtataagaatgcttgtgatttttgcacattgattttgtatcctgagactttgctgaagttgcttatcagcttaaggagattttgggctgagatgatggggttttctaaatatacaatcatgtcatctgcaaacagggacaacttgacttcctcttttcctaattgattgccctttatttccttctcctgcctgattgccctgaccagaacttccaacactatgttgaataggatggtgagagagggcatccctgtttgtgccagttttcaaagggaatacttccagtttttgcccattcagtatgatattggctgtgggtttgtcatagatagctcttattattttgagatatgtcccatcaatacctaatttattgagagcttttagcatggagggtttttgaattttgtcaaaggccttttctgcatctattgagataatcatgtggtttttgtctttggttctgtttatatgctggattacgtttattgatttttgtatgttgaaccagccttgcatcccagggatgaagcccactagatcatggtggataagctttttgatgtgtcactgggtttggtttgccagtattttattgaggatttttgcatcaatgttcatcaaggatattggtctaaaattctctttttttgttgtgtctctgccaggctttggtatcaggatgatgctggcctcataaattgagttagggaggattccctctttttctattgattggaatagtttcagaaggaatggtaccagttcctccttgtacctctggtagaattcagctgtgaatccatctggtcctggactttttttggttggtaagctattaattattgcctcaatttcagagcctgttattggtctattcagagattcaacttcttcctggtttagtcttgggagggtgtatgtgtcgaggaatttatccatttcttctagattttctagtttatttgcgtagaggtatttgtagtattctctgattgtagtttgtatttctgtgggatcagtggtgatatcccctttgtcattttttattgcatctatttgattcttctctcttttcttctttatgagtcttgctagcggtctatcaattttgttgatcttttcaaaaaaccagctcctggattcattgattttttaaagggttttttgtgtctctgtttccttcagttctgctccgatcttagttatttcttgccttctgctagcttttgaatgtgtttgctcttgcttctctagttcttttaattgtgatgttagggtgtcgattttagatctttcctgctttctcttgtgggcgtttagtgctataaatttccatctaaacactgctttgaatgtgtcccagagattctggtatgttgtgtctttgttctcgttggtttcaaagaacatctttatttctgccttcatttcgttatgtacccagtagtcattcaggagcaggttgtttagtttccatgtagttgagcagttttgagtgagtttcttaatcctgagttgtagtttgattgcactgtggtctgagagacagtttgttataatttctattcttttacatttgctgaggagagctttacttccaactatgtggtcagttttggaataggtgtggtgtggtgctgaaaagaatgtatattctgttgatttggggcggagagttctgtagatgtctattaggccctcttggtgcagagctgagttccattcctggatatccttgttaactttctgtctcattgatctgtctaatgttgacagtggggtgttaaagtctcccattattaatgtgtgggagtctaagtctctttgtaggtcattcaggacttgctttatgaatctgggtgctcctgtattgggtacatatatatttaggatagttagttcttcttgttgaattgatccctttaccattatgtaatggccttctttgtctcttttgatgtttgttggtttaaagtctgttttgtctgagactaggattgcaacccctgcctttttttgttttccattggcttggtagatcttcctccatccctttattttgagcctttctgtgtttctgcacatgagatgggtttcctgaatacagcacactgatgggtcttgactctatccaatttgccagtctgtggcttttaattggagtatttagcccatttatatttaaggttagtattgttatgtgtgaatttgatcctgtcattatgatgttagctggttattttgattgttagttgatgcagtttcttcctagtgttgatggtctttacaatttggcatgtttttgcagtgcctggtaccggttgttcctttccatgtttagtgcttccttcgggagctcttttagggcaggcctagtggtgacaaaatctctcagcatttgcttgtctgtaaagtattttatttctccttcacttatgaagcttagtttggctggatatgaaattctgagttgaaaattcttttctttaagaatgttgaatagtggcccccactctgttctgacttgtagagtttctgctgagagatcagctgttagtctgatgggcttccctttgtgggtaacctgacctttctctctggctgcccttaacattttttccttcatttcaactttggtgaatctgacaattatgtgtcttggagttgctcttctcgaggaatatctttgtggcgttttctgtatttcctgaatttgaatgttggcctgccttgctagattggggaagttctcctggataatatcctgcagagtgttttccaacttggttccattctccccgtcactttcaggtacacaaattggacgtagatttggtcttttcacatagtcccatattccttggaggctttgttgatttctttttattcttttttctctaaacttctcttcacgcttcatttcatttatttcatcttccattgctgataccctttcttccagttgattgcattggttactgaggcttgtgcttttgtcacgtagtttttgtgccttggttttcagctccatcaggtcctttaaggacttctctgcattggttattctagttatccattcgtctaattttttttcaaagtttttaacttctttgccattggttcaaacttattcctttagctcaaagtagtttgatcatctgaaaccttcttctctcaacttgtcaaagtcattttctgtccagctttgttccattgctggtgacgagctgcgttcctttggaggaggagcggtgctctgatttttagagtttccggtttttctgctctgttttttccccatctttgtgattttatctacctttcgtctttgatgatggtgatgtacagatgggtttttggtgtggatgtcctttctgtttgttagttttccttctaacagtcaggaccctcagctgcaggtctgttggagttttctggaggtccactccagaccctgttttcctgggtttcagcagtggtggctgcagaacagcagatattggtgaaccacaaatgctgctgcctgatcgttcctctggaagttttgtctcagaggagtacccggctgtgtgaggtgtcagtccgcccctactcgggggtgcctcccagttaggctactcaggggttggggacccacttgaggaggcattctgcccattctcagatctcaaactgagtgctgggagaaccactactctctttaaagctgtcagacagggacatttaagtctgcagaggttattgctatcttttgtttgtctgtgccctgccccccagaggtggagcctacagaggcaggcaggcctccttgagctgtggtgggctccacccagttcgagcttcctggctgctttgtttacctactcaagcctgagcaatggcaggcgcccctccccccagcctcgctgccaccttgctgtttgatctcaggctgctgtgctagcaatgagcgaggttccgtgggcgtaggaccctccgagccagttgcgggatataatctcctggtgtgccatttgataagcctgttggaaaagcgcagtattaaggtgggagtgatccgattttccaggtgccatctgtcacccctttctttgactaggaaaaggaattccctgatcctttgtgcttcccgggtgaggcgatgcctctccctgctttggctcacgcatggtgcgctgcccccactgtcctgcacccactgtctggcactccccagtgaggtgaacccggttggaaatgcagaaatcacctgtcttctgtgtcactcaccctgggagctgtagactggagctgtttctattcggctatcttggctccaccccttctctagttcttttaatagtgatgttaggatgttgattttagatctttccagcattctcctgtgggcatttagtgcttcacatttcccctaaacactgctttagctgtgtcccaaggattctggtacgttgtgtcattgttctcattagtttcgaagaacttatttatttctgccttaatttcattatatatccagcagtcactcaggaacaggttgtccagtttccatgtaggtgtgtggtttttaatgagtttctttatcctgagttctaatttgattgcactgtggtctgagagactgtttgttatcatttctgttcttttgcatttactgatgagtgttttacttccaataatgtggtcaattttagaataagtgtgatgtggtgctgagaagaatgtatattctgtagatttggggtggagagttctgtagatgcctattaggtctgcttggtccggagctgagttcaagtcctgaatatcctttttaatttcctgtcttgttgatctgtctaatattgacagtggggtgttaaattcatccactattattgtgtgggagtctatgtctctttagaggtctctgggaacttgctttatgaatctgggtgctcctatattgggtgcatatatatttaggatagttagctcttcttgttgcattgattcctttaccattatgtaatgcccttctttttattttctgatctttcttcgtttaaagtctgttttatcagagactaggattgcaacccctgctttttttttttttgctttccatttttttgggaaatcttcctgcattcctttattttgagcctctgtgtgtctttttttgggggggggcgttgggggcaccgtctcactctgtcaccgaggctggagtgcagtggctcgatcttggctcactgcaacctccgcctcccgggttcaagcaattctctgcctcagcctcctgagtagctgagattacaggcacatgccaccacacttggctaactgtcgtatttttagtagagttggggttttatcatgttgaccaggctggtcttgaactctagaccttgtgatccacccgccttggcctcccaaagtgctgggattacaggcgtgagctgtcacgcccagcctctatgtgtgtcattacatgtgtgtcattacatgggtctcctgaatacagcaccccgatgggtcttgactctttatccaatttgtcagcctgtgtctttgaattggaggatttagcccatttacatttaaggttaatattgttatgtgtgaatttgatcctggcattatgatgctagctggttattttagttgatgcagtttcttcatagtatcgatggtctttacaattcggtatgtttttgcagtggctggtatcggttttttctttccatatttagtgcttccttcagcagctcttgcaaggcaggcctggtggtgacaaaatctctcagcatttgcttgtctgtaaaggattttttttctcctttgcttatgaaccttagtttgcctgtatatgaaattcagggttgaaaattgttttctttaagaatgttgaatattggcccccactctcttctggcttgtagggtttctgcagagagatctgctgttagtctgatgtgcttcactgtgtgggtaacctgacctttctctctggatgcccttaacattttttccttcgtttcaaccttggtgaatctgacgattacgtgtcttggggttgctcttctcggggagtatctttgtggtgttctctctacttcctgaatttgaatgttggcctgtctagctaggttggggaagttctggataatatcctgaggagtgttttccaactgggttccattctccctgtcactttcaggtacaccaatcagttgtaggtttggtcttttcacatagtcccatatttcttggaggctctgttcattccttttcattctctttttctctaatcttgtcttcatgctttatttcattaagttgatcttcaatctctgatatcctttcttctgcttgatcaattcacctattgataaggtatcatgcttcacgaagttctcgtgctgtgtttttcagctccatcaggtcatctatgttcttctctaaactggttattctagttagcaattcctctaaccttttttcaaggttcttagcttccttgtattaggttagagcacgcttctttagctcggaggagtttgttatttctcaccctctgaagcctacttctgtcaattcatcaaactcattctccatccagttttgttcccttgctggtgaggagttgtaatcctttggaggagaagaggcattctggtttttggaattttcagcctttttgagctgttttttattcatttttgtggatttatctacctttggtctttgctgttggtgaccttctgatggggtttttgtgtggacatcctttttgttgatgttcatgctattcctttctgtttgttagttttccttctgtcaggctcctctgctgcacgtctgctggggtttgctggaggtccactgcagaccctgtttgccggggtatcaccagcagagaccgcaggacagcaaagattgctgtcttttccttcctctggaagcatggtttcagaggggcatctgccagatgctagccggagctctcctatatgagatgtctgtttactccctctggaaggtgtctcccagtcaggagatacggggatcgaggactcacttggggaggcagtctgtcccttagcagagctcaagtgctgtgctagaagatcttctctcttcagagctagcaggcagtaacgtttgtctgctgaagctgcgaccatagccgcccctacccccaggtgctctgtcccaggaagatgggagttttatctataaacccctgactggggctgctgcttttttttcagagattccctgcctagggtggaggaatctagagaggcagtctggctacagtggctttgccaaactgtggtggactctgcccagttcagacttcccggtggctttgtttacactgtgatgggaaaactgcctactcaagcgtcagtaatggtggacgccccttcccccaccaagctcgagcatcccaggtcagcttcagactgctgtgctggcagcaagaatttcaagccagtggatcttagcttgctgggctctgtgggggtgggatctgctgaactagaccacttggttccctggcttcagccccctttccagggaagtgaacagttctgtcttgctggcattcgaggtgccactggggtatgtaaaaaactcttgcaggtagctcggtgtcttcccaaaaggccgcccagttttgtgcttgaaacccagggccctggtggtgtaggcacctgagggaatctcctggtctgtgggtttctatgaccatgggaaaagtgtagtatctgggcgggaatgcactgtccctcagggcacaatccctgtgggcttcccttggctaggggagggagttccccaaccccttgggcttcccggatgaggcaacgctccaccctgcttcggctagccctccgtgggctgcacctactgtctaaccagtcccaatgagatgagccaggtacctcagttggaaatgctgaaatcacccgccttctacattgatctcactgggagatgtagaccggagctgttcctatttggccatcttgccagccctttctgatagattttgacatgctgaatgacaacagcattatgagccttttcttatttaaatactggcattatgccttctatgtgaggtttaatgggcttcagttacaatagagggttcctaggggcattattaacatttagaatgatgtctctaagtagtatctttgctgcttctgttaattgatggcactgttatcatgaattatggtgcaacattctaagcaacaaaataaaagttcatgcgaattttactaatttttgtttcattgatttatgaattcaagcatacaaatgttaaaacaaaaatgaaccttaggagtgccttctaaggttctaaggttagaaggtactctttctaacgtgtagttatctgacataggaaactacctttaggggaaaattattgaggggtaaaacatgaaaaatctcttctaaaaatgattaacttattaatcttgaaaatgtatacaaatgggacagcaaggttttaaaaataattcactatttttgcttgggaaaataaaagaaataaaagaaataaaatcagcattattttctttttgttagctatgatgttcagcatgatttacatgatttaaaatttgcaaaggagacaactgttggtctgcattgacttattaaaagtatttccttaagaaccaactcaggaaatcttaattagcattcaggggagtttcaacaaattttaagtttctgttgaataaatttcttccttataattctaactaattttaatattttgattttcttctgtgtgtaataatctagcaactgattactgtttagaataagcaatctgttcaatctttgtgaggaatatttacttctgtaatgataggattgttacagtcatattttttgctttatttttatttagttctgtttgcaatgcattttttcaaacattcatttgttcgttcctgttttattcatttactaagcatttacagaatgcttactgtaaaattggcattgtttttaatacttaggaaaacaatttccagcatatgttgaatgctttatatgtactactaagtgcattagttaattatcttttttaatccccacaatcatatactgggaaatagcctatttattaatgtgggccttgggtaaaaagagatgaatacattgtaatcacttttcttggtaagttcacagtctaatggagttggacccagaaaaataattaattaaaattttatgggataagtgttgtacaaaagcttgtgttcatacttggaccttcataagaaggactatctaattgtgcctgaaggagttagaaaaggtgttacagagggaatgacatttgaggtgagtcttaattgttaaatagaaatttgtccagggaatgaaggcagaaacactgcttatagcaatcatgaaatgatgaaggagcctggtatttggtggtcctggtgagtgagctgcgtggcattaaactcaggtgtttttgtgtatgtgtgtatgtaggtgtgagtgtgggactgtgtgtgtggtctgggcctggaagatgtaagaaggtaggaagggaggataatgaggctggagaggtagattcggactttatagtcaagaccctcactaagaggtttatttatttatatttttaaaagttttattttatttttaattgacacatagtaattatacatatttatggagtagaacgtgatgtttcaatacatgtatacaatatgtaatgatcaacctcaaatatttattatatctttgtggtgagaatattcaaaatcccatattctagctactttgaagtatgtaatgtattatttattgttaactacagtcaccctactgtgcaatagaactggaattcattcctcctatctaactgtaactttatactggctgaccaccctctccacatccacctgtagcctcctgcctttcccagccgctggtaaccactattctattctcaacttacatgagatcaacttttttagatttcacatatacgtgaggtcatggggtaattatttttctatgtttggcttattttacttatggtgccctccagttcatccatattgttgcaagtgacagaactgtcttgttttttaaggctgaatagtattccattgtgtatggacaccaaatttttcaatctgttcatatgttgatagacacttaggttgattctctttcttggctattgtgaataatgcttctaacaaacttggagtgcagatgtctctttgacattctgatttcattttctttggatagatacctagaagtaggattaaaggatcatatggtagttctatttttaaatttttcagaaacctccatactgtcgtctatgatagcttaactacttttcatatccactaacagtgtgtaagagttcccctttcttcacatccttgccagcatttgttatcttttgtctttttaatgatggcctttctaactggagtgagatgatgtctccttttagtttttatatgcatttccctgatgattattgatggtgagcatgttttcatgcacttgttggccacttgtatgtcttcttttgggaaatgcttcttcagatcttttgcccattttatagttggattattttattattattattttttacttttttttgctttggagctgcttgagttccttatattttctggatattaaccccttgttagatgcatagctggcaaatattttttttcccattttgccagtttgtctgttcattctgttgattgtttccctttgctgtgcagaagcttttgtgtttcatttaatccaatttgtctgtttttattttcgttgcctgtgattttgaggtcttatccaaaaaaaccttgcccagctaatgttatgttatgaagtgtttgttttcttctagtagtttcatagttttggatcttacatttatttcattgtggccagaaatgttatttgatacaatttcaatttttaaaattttgttaagacttgttttgtagtctaacatgtggtctatcctggaaaatgttccatatgctattgagaagaatgtatattctacagatgttggaatgttccataaatgtcctttaggttcatttggttagaatgcagtttaactctgatgtatctttgttgattttctgcttggatggatctgtccatcactgaaagtggggtattaaagtcttctaccgttaatgttattgcagtctatctttttctttaggtctattaacatttactttatatatttaggtgctctgatgttgggtgcatacatatttacaattttatttcctcttcctatatagacccctttatcattatacaatatatttttgttgcttttcacagtttttgacttaaagtctattttatctgcaatgaatgttgccacctctgttctttttggtttccatttgcatggaaagtctttttccatttcttcacttttaggctatgtatttacttacaggtaaagtgagtttcttgtaggcagcatgtatttaaatttattcagccactctatgttttctaattgcagaatttaatccatttatgttcaaggtaattgttgataggtaagggtgtactcctgccattttgttatttttttttccagttgttttgtagatcttttctttctttttctcttactttccttttttgtgattaggtggttttctctaatagtgtgttttgattccttgtttcttatttgtattttgttttttataggtttttactttgtggttaccgtgaggcttgcataaagcatcttacagttataacacattattttaaactgataacaacttaccttaaaaagaaaagaatcacacaaaaaaccccagtatactttaactccattccctccaatattttgaagtgttgatgtcacaatttacatctttttatgttgcctataccataattaattaatataattatttttaatagtttttcttttagtcttcatattaaagatacaagtggtttacacaccatgattacagtattagagtaaatattaaattaagtctagtttgtctgcaaagttacttttatcagtgagttttataccttcagatagtttcacacagtagcatctttttgcacattagcatcttttcacacattagcatccttttctttcagtttgagggactccctttagcatttttttttttaagaacaggtctgatagcaattaattgttcatcttggaaggtctttatctctccttcatttctgatggaaagctttggtggatacagtatttttggcagcttttctaactctagcactatgaatatatcatcccactccctttgggcctacaaggttcctcttgaggagtctgctgccagatgtattggaattcccttatatgttatttgctccttttctcttactgctttcaggatcttctctttgttttcaacctttcagagtctgatataacactaccccaagacctttcagagtcttggggtagtgttatttggtttgaatctgattggtgacctttaaaactttcctgtacctgaatattcactaaaaagttttaaatttgaggatcaatttgaatgaaaacatgagccatgcctctatataaatgaatatttagaaaatattttagaagtcatgagattaacaactttagaagaggtaagttgaaccaactgctgaatatatctgtctgatatattcttttggagtttattgtctcactttaaaaattaccaattagaaatattgtctttataaaaactagtagcaatggtaagtttattagaattaaactgtagaactgaaaagaaacatatcactgttttaaattttttaaacaacaaatatactgagtttcctgaatattatgcaactgcatgctatctagtcttgactactgagctactaatcactttgtagcttagaaatgaataaatgagtaaaccttcatttattaccttttgttttcttgagacaaagtctccctctgtcacccaggctggagtacagtggcgcaatctcagctcattgcaacctctgcttcccaggctcaagcgattctcatgccttagcctccctagtagctgggattacaagtatgcaccaccacgcccagctaactttttgtatttttagtagggaaagggtttcactatgttggccaggctggtctcgaactcctggcctcaagtgatccgcccacctcagcctcccaaagtgttgggattacaggcgtgagccaccatgcccggcgtattacctttctttctataatttgactcacagtcagttggtactgattctgccactaacctggtgggcagaaacagtgagcaatatctgacttaatattttaatgaggaacaaaaatagagtggattaactaaacagagaggaataaataaggtaatttggtctaatcctttcatccttctattaagaaatgtttctttgtattaaaacacatattcaactttattattatccatacctgtatcatttttgcagaatcacagtaaaaggccaagatgtggcagaaagagtgaattatagctcaggctgatggcataattgagactgtcagtctctcaggtaccacagaggaagtagagagtattgactactaggcagtgagagttaacatcagaataatctttctgcagtggtctcttgtgtccagagaattgggaggcgggaaggggactggacagagtttggctactggaagggcctggtaagtagcattagttaagcatagtaggagttcaaatgcacaagcgaagagggtactatcatgagattaagaaaacaggaagcttcaagattccagggagttcaatcaaaacatacaaaggttgggatgaattagagtggcttgtgatgactctctgggcactgggggcaatgagatcaccaagtgttctctaagaaaatcagtcatctgtggcatgatttcagcaagttctcaaggctagcacaacactgttcattgagtaagaggtaaactattactacgttttgaaattttaaagttgtagcacaagattttacatagaaaacatcaggctcttgttatttacattattcagatctgtaagaatagttccgtgtccaagaacttgcttccttgcttcctccacacaaatttgtataggtctacttctttctaggtatttttttaaagaaaaaattgttttcagaatgatttttatactgtttcatttaaaaagtattcaaaattatactttttatacttgctctaacaatgactccatacactggcatcattatcgttaatattttatatattaattttaattttactcattggaggtttgaagtctaatttaaaaattaaaatgttagaattgtaatttaaagcaacatttgtaaatgaaggttcaaactagccgaatgctgtaagatgttaagggatacttttcttattgcactggaattgaaaactaaaactaagggcaaagaggtatcagatgccccatattgtaaagggagcttccagtggtcaaagactcactccatttagtttaaatgcctcccgattaggccttgctttttcctgctattacccactcccatgattatggttgaagggtaggtaccctagaaagcagactccgagataaaggtaaagattagcatgcaggatattactcagggaacatttttaggataaaaacctgtgaaagaatggaaaaggaggcaaaactgagtagtgggagaagttgaactctgttgtagtctcaacaaagccctcaggtgaacctttaggaagctgagatggcccttcaaagttgtcttgagttggggcaaggcctgggcctttatatccccataagtatcagcactgggcagaggaccaagactcatatccccaagatattggatatgagccacccagggaaggggcatgatctagagtgaggcagctgttttctgctgaggtaattcttgaaggggctgccagctaaggactatctgctgtcatttgaattggtgttcctttataggaaatgttctgtttctctctggctgctttcaagcttttttttctttgtgtttagttttcagaagtttaattatagcatggattttttaaaaaatttatcttatttgtcttatcttatttggggttcacttcatgaatctgttggtctatctctttcacaaaatttgtgacattgtcagctattgtgtctttcagtactccttcagggcctactctctttctcaacttctgggatcttttggttttgtcccatgggtttctgaggctctgttcattttaggagactctgggtcctatttaaatcccttattttagtaggtagtaactctgttaggtttacatcgtaggtcctagcctactttagtgggcagtagttctaaggacaatttaattttccaagattttttggtcttattttggtgggccttgtgtatctggtgctggtggggctcccaggggtctatactgtgatgcctgaggggacagaacacatttttctaggctaggcttctttatgtttctaggtggggaaaagaaagtctctggtctgactggatgaagagtgcttccaggcctagctacttattgtggtggagattcccctccacacctccctcaccagcatctcccacccacaagtatcctggtgaaggaggggattctcaggcctggtggaaaagaaatgacttctgaggccagaagcttgttgagacaggatgcctcctgtctgtgggagatggaaagcccttcctgggctgggtgcttgtggtaagattccccagtgcctgtgctccccagccatcagtgtcccttggtgttggagaggaaagtcaggtccgtagatcatcctggcaggtgcttgttgaggcctgatgccccgtgctggtgctgtcctgtgtcttctggtaggagaggggagtctcagaccctgttgagaaggagaacatttttcctgctggttcatcagcttatcttcagtggggctcctcttcaatcccagggaggactgagcctacttgggctgccttctgttgctacattggatgtcagggaatgctggccctgggtcaccttcttccttttggtgggaggttgtaagatgccctgcaactatgctgttcctccagacctgggttctctaatcagttcaccctccttttgcacctttcagagttctcctttggttgcctctcgcattatctccagcgtttacagttgtatttagcaggagtgggtgggaggaggaaccagaaaaaacaaattatgctatcttcaccagacttcagcttcatctgagagggcagaattttgcaaaatagaatatcgtaatctctcatcaacttgtaaaaaattttaaaaaaaatcttcaacatcatgattctgatgtttaaatattatgtattataaaaataacaacatatactttatagatttatttactatagttatatctttttttaaataagatacaaggtcttgctttatcacccaggatggagttcaatggcgcaatcatagctcactgtaacctcaaactcctgggctcaagcaatattcttgtctcattctcctgagtagctaggactaataagtgcatgccaccatgcccagcaatgtatttgtttatttatttattgtagagacagagtctctctatgttgcacagactggaactcctgggctcaagcaatcctcctgcctcagcctccaaaagtgctgggattacgccaccacacctggcctatagttatataatttaatgtgactattttacttacctgtttatttccagcaatcgttccagaacagccacaaacagtgactacctgaaaaatggttgttaaataattaaattataatttgtattctttataattggcatagaggtttcagtaatttgcccaaaattatataactattgatgaaactaaggattaatattaaatacttcttttggtagacaccacatctattgcatctggaataccatatgcaaattctcttattacctattgctgcatctgttttatttctggtctttagaagtctcagagtgacattagaattacaactagttttagtaagtattatttagttatcctgagagatttgttaaataataataatttttaaaagcctctgtagtcagtaatcagcttctcaccaatgataatacttctgtctgagattaatatcagtgcttttcaatgcagcagactaaaactaatctctattatagaatccacagctggcctgatggaactgtaatacaaaagtaattggtattttttgatgtccagaggatgcaaattataatttgtctcctgtgtacagaaaaaaagtgtgtcttgtatggtaaataattaaacttgatactcataaagttatatttttccatgtcttaaaggagatgactattttatacttacagtcgatataaatataataatgtatttatttcatccttgaacaatgtaactaacattttactatatattaatagaagccaactacaatttgaaattaaataattagacttatttaggaaagaaaaattatggttttttatttgctacttcaggttatgatgaagattctctatttgattgtcctaaagtcaagaatgaggagtgctaacgatagaaaacttaggacaaatgaaaacatatattttactttcattttgtgtattttgcaataagcatataaaatcttaggttagccagtttgcatttatttgatgaaagccaaactttaatgtagtatttattattgttttcataaatctaaatttagctcaagtctttcagcattgataattaagaaatatatgccctctttaatagcgatgtatgtttaattgttcatattacctgaagtcatactgagaattttcatctttttaaatgtcaaaatttggctaaggttatcaggatattaaatgtaatatttcaaaggagtatgatctcttatagataattccagattttgtgagatcaaaattgctgattataataatgttagtaaataatatgggaaaggtatggcgaaatatttaaatttttacaattttaagttgtatgatgtatgtaaatgctattttttctggtaactttggtttaaaaaccagtaatactgcctttgacattggtgttaactggatacattgctttttgtgggcattggatatccatctattttgaaataatttgggagaaataaaataattccttaagatatagtctagcatactaaaaagaacatttgtttgatgttgggtgaaaggactcaagcattggattgaatagttacttaccagcccatgaccttgggcaaataacttaacctcactatagcctcagtttcatcatttgttataggaaaagtaaaattcccaatttgcaagattatttggaggattaagatatcataaagatcaaatcttaaacattgcctgatacataatagatgcttagaaaattgtcttcaggatctatttgtatattccattatttggttgttattttgggcatattttctaccttgataagcttactaaagtatgtatcagctggtccactggcttggtgattcagagcataactttctaatggaaatgaatcatacaagagctcattttatgatttttataagctggtcacgtcatgagttagatttgtgcaagaagttagttcgaacttcttgatgatccaagcattgcgttagggtgaatgcagagccaggtcagcttctgcatgagccagcatactttagatgtgtaacaagactttaacaaactggaagaagaatattgctttaaaatgatgtgtccagattggaaaaagaagaaatggaaacatatgttccattgaattttcattaatttattgtaagtagaattggcactactagagaaagtcttcatatactacagtagtttaaaaaagagaaatacagaaacagggattatataatttccactttattccttactctatattccttactatattacttacactttattcctttctctataagctggccacgtcatgagttagatttgtgcaagaagttagttcaaatttcttgatgatccaagcattgcattagggtgaatgcagagccaggtcagcttctgcatgagccagcatactttagatgtgtaacaagactttaacaaactggaagaagaatattgctttaaaatgatgtgtgtagattggaaaaagaagaaaaggaaacatacgttccattgaattttcattaatttattgtaagtagaactggcactactagagaaagtcttcatatgctacagtagtttaaaaaagagaaatacagaaacagggattatataatttccacttcattccttactctgacttttttgtgggttggagggtatggaacttggcttctcttatgggaggtgcttaagagtgtgaactttctagtaacattacatggcttcaaatactggtgccagcctttggtctcgaacatgttacttaacctctccgtgttccaattttttaacatataaagtggaaatagaaaatggtacctacttcattagcttctttgggggactgaattagctagtaatacgcctggcatctaacaaaaatgataaatgtaagctatgttattttttagttaggattcggggtataaatgtaaatttgagtaattatctggtgattacttttagccattgcattccatttctctttagccttccattacacttgtacaaaagcagtgggtgcctagtacaatgtttggcatacatgaagcgtcttaatggttggttttagatgaatggaagcagaaagcttagaattatcatggggacatgatatttagccttgaaattcttattgagctgaagtattcttacctatctttgtgggttttttgatagattttccatatctttctagtaagttaatatcttctcaagttttttatttttatttttatttttttttgagacggagtttcgctcctgttgcccaggctggagtgcaatggggcgatcttggctcaccgcaacctccacctcccaggttcaagcgattctcctgcctcagcctccctagtagctgggattacaggcatgtgccgccacgcctggcttattttgtatttttagtagagacagggtttctccatgttggtcacactggtctcgaactcccgacctcaggtgatccacccgccttggcctcccaaagtgctgagattacaggtgggagccaccatgcccagcctatcttctcaagtttttaaaccttaagcttctaaagtatactttaaattttcaagaaatttaattagaaagtagtggaaaatttcttactctaatcttttctagccaagtttttcctttgcatttaagttcaagacctgtcatgctttgtgtctaacaaacatgaaaagaaagtggttaaagagacttacctttagttgagatagttttactatttttacattaaaagaagaccattaaaaagtttatatatttgatatctgtcagaaattgaaactaaatatcttttcatgtataggtgaaaatgtttcattgatgtagtttacatttacatcagaagcaccccattgaactgaaatctcatctaacataccaaaacatttgattcagattatttacaaacatagaataatactgatgatttaggtgttctccaagctatacttatgcatgctaaatttcagctaattttgacttattttaataaacatattttaatatgcattttaaaatagttattaaactcttaaattttaaaagtacatatgtccttttacccataatactttggagaatttttttttaatttttaatttttgtgggtacatagtagatgtgtgtgtatatatatagaagtacatgagattatttgatacaggcatgcagtgtgtaataatcccatcagggtaaatggggtatccatcacctcaaacatttagcctttgtgttacaaacaatctaattatactcttttagttatttttaaatatacaactaaattattatttactatagtcaccctgttgtgctatcaaatattagttcttactcattctttctattgtttttacccattaactatccccacttcctctccacccctcgaataccctttccagtgtctggtaaccacccttcttttctccatgtccatgagttcaattattttaatttttagctcccacaaataagtgagaacatgcaaaatttgtctttctgtgcctggcttatttcccttaacataatgatctccagttccatccttgttgttgcaaataacagattctcattctttattctgacggaatactactccattgtgtagctgtaccatgttttctttatccattcatctgttgatggatgcttaggttgcttccaaatcttggctattgtgaatagtgctgcaacaaatacaaaagtgcagatatctctttgaaatactgattttctttctttggggtatacctaggggtgtgattgctatcttttgggtataatgtaggagtggggttgctggatcatatggtagctctgtttttgtttttttttgtgaaatctctaaactgttttccctagtggttgtacaatttacattcccaccaacagtatataaggatcccctttttaaagaacttattttatagaagccccagtatgtggatacacacacacatacacagacacacacacacaaacacacaaatttttactagaacattatctctaacagcaaaactggaaacaatgtaagtgcccatcagtaatgggagtagttttactcaaactttggaatctcatagggcgttacatattatttcattagttagagtcatggtatattgataaaagagaaatttatgttgcgtggcaaatttatttttgtcataacctcagaagccttaactatttgcatatatttataagaacatggaggccaggcgtggtggctcacgcctgtaatcccagcactttgggaggctgaggcgggcgaatcacgaggtcgggaaatcaggatcatcctggctaacacggtgaaaccccgtctctactaaaaatacaaaaaattagccgggcgtggtggcaggcacctgtagtcccagctacttgggaggctgaggcaggagaatgacgtgaacccaggaggcggagcttgcagtgagccgagatcgtgccacttgcactccagcctgggcaacagagcaagactccgtctcaaaaaaaaaaaaaaaaaaaaaagaccatggagaaaagtatggaagggaatggtagataagaggagttgagtttgtttaatatacttgattctttaacatgttcaaatgagtatgtattattttatattttatataaatataatttattatacttacatgttttatgttttttcattaacaaagtaaacactctgctatattgatcattcttcaaatggaaacagaagaacaggggccatccttatgaccatctgcactaagagagttagcctctgaaggaatgtgagatttaggctagccatcatcagtgaccagtctgtttaaaacatacctgttcaatcaggtcccagcgggaaacagatgatgcagtcaaattacgataattcaagagctggagccaggtgtagtgtaggagaaactcaaggagtttttcatggaccaggggccaccaacagcacagctgttgccacttgaggcacaaagagacaaggagagggggaggatgtcagaacccagaaaaagtcatgttgtaaagaaccttgattagaatggtgaccttctttcaagggacatagtccattcacggtaagcttacaggaagtgaaccagggaagaaaatgttgaatgcattctaatctctcctgtcatctgccagggctccccactgactgaacccaactagagacagatgttaagagagagccttttgatgtcaagtacctagatcagcagccttgggcagagaacaagggcaagtatagagaatgggttttgaggagtaaacaggagctatctggcataaaatagccaactttttattttattttttttttttgagacagagtttcattcttgtcgcccaggctggagtgcagtggcgtgatctcggcccaccgcaacctccacctcctgggttcaaacaatctcatgcctcagcctcctgagtagctgggattacaggcgtgtgccaccacacaaggctaatttttgtatttttagtagagacggggtttcaccatgttagccagggtggtctcaaactcctggcctcaggtgatctgcccaccttggcctcccaaagtgctgggattataggtatgagacaccatgcccagccccaatattctttttgaattaaataatcaaaataacccagaagaggaaaacatagataatatgcaaaatattgatatccatttactttatgggcttacataattattttttaattgacctaagcccaaacacaaaattaaaaaagaaaatctgaagatggcattgttcctcaccctcttctgtacataagtcctaagttcttccttaaactcccatgagggcatagcagtgaacatctcagagtggggacagaaaactattcctaaagatgaacatggccccagacccacaaaacgccagactttggacttggtctgaaatagtggaggttttctgttaagtcctagcttgtttccaaggaatgacactgtaaatcaggtcatggaatgggaagctgacatttactgacccttggcatgtgccaggctccatgacatacattcatgtaagttatcacttttactcctctcagcaaacctgtactgtgaccaatatggtcacatgaatgtatgccatggagcctggcacatgtcaggtttgctgagaggagtaaaagtgattactctttaagaaacagaaactccaagagtttaatttggagtttaaggaactttctcaaggtcaatgatagagtctggaattggagctaggtctgcttggctacatcgtggcacagcctcacttggctgcaagatggtaaaggagtcattatctattatcagaggtctctcacctgtcccagaaatatggctttccccttcccctctctctcattcccttatcttccattcattcccttagttatatatttaacaagtatttattcagtacctactgtgtcaggaatcatgcattgtaccattgatatcaatgaatatggcctctgccttcatggattttacagcttaataagaattctcaggggattcatcgtatggatttccactagccccaagtccttttcatttgaggtcatttgcatctcagtcttcctatatctttattaagactgagaattattttttggcctatttgtttaaataaaagtgtaatataaaaattgtaataaacctttttaaaaatctcacttgctagttcattattttagagaattgaggatactataatattataagaaatatgaaatactggaactaggtaagataatatttttaaaggtgctttctggttttattgaaacaaatcagccagctcccccaaaaatgtggatatatgggtacatgttgaggcttatgttttaatcaggctaaaagcgtatcacattctctcaaataagcatatctttcatttcttaaattgaaaatttatttgtatttattcaaaacctttcttgtcaaagacaagttaaaactgctgttcaagtgtcttgtataattataaccataaaactaataaacatttcaactaattttttccctattcagatatgcttgttcactcttgggaaagccccagattgggttactgaagtaatctcatttttgtaactgagccagtattatcattatcaaaattacaattgatctacagtatagtgtcataaagggtgactggtatgtagcacattctgatttctctcattttgcattagatgcattgcataatagaactgtaggaattgcctgctaatgctttagttcaccctttaacaattaagttaggcaatcttgggtaaagcaacattcagtaggctccatgcatgttgttttctataaccacctttggatgcaattttggggagtgggagggctgcaatacacacacagagacacatacatatatttataatttgttaagaggaagttactattaaacatctaagttgacatattgtatggtgggttcttctgggtctgatcctagacaagtgagttaacaacatctttgatcctctttagctttctacttttgtaaaataaaggggttggaccaaataagtggggtttttgtttgtttgtttatttgtttagcttttagagttttttttgcccatgctacgatattcctagaagtcactgagtacctagtaaggcaaaccaggaccagctgtagctcctcccttgtactttaacaacagtaattctgttttgttttatatgtgaatcatcccaagtaagacttccaatctctgatgccttttcacctatttattagtagtaggggtcattgtattctatttttggcttcatagtgaatgacagcttgtacaaacaacacagatactggaataatcagtcttttcttcaaattctgtagtagcatgaactgtaaagtattaatcatgtgtttatgcctggtttctacatgtgaatccgttaagcctattcttaattttctcgcttcgtcagcttcaaagcaggaaattacaccattgcccaaaatctccaccattctgttgattttgtttgggaggtgtaaatctagtaaagcatagacagaggcctgttgccagattgatagctgtatttgtctgcgtagattgtattttcacagctgtcaggtgagatggttgcttcctatataaagtggttctagaatcatgcatgtgcttgggattttaatttatcagattttttagcacttcctacttaaagagcttcaaactctagggaatataatgtatgccattctgaaaggtggtatttcagcttttgtatctttggggataacatgttgtgaatgaaattggtgttttaaatagagctcctggggaagtttttgccaacagtccttttgatatcccatgtgctctattgtaataagaaagcagaataaataaactaaactaggtggtcaggattctgttaggatgaaaacaagtataatttcctttataatgatgaaaagcaaacaaaactctgtacgaatagttttaatcaatgtttaaagactggtttcccagactcttgtgtgtttgacagatagtcttgggtggggtagaaatggagtggaaaaacaaacaattactgtggagataataaaaattactgggcaaaaagaaaaaaaatatttgaaatacttcttttttttttttttttaaaagacagagtcttgctctgttgtccaggctggagtgcagtggcacaatctcggctcactgccacctctgcctcccaggttcaagtgactctcctgcctcagcctcccggctcatggttgacataagttacctctcccagcatttttcatttgtattttgagaaaaacataaattaatgtgttattgaaaactgccgtgatcatttttcatttaggctaattattccaggaaagggattcctatattgtattcactttttttggttttaatactttaatagtgagtatttatagctatagaaatttgatacttttaattaaaaaatttgaaactaggttcaaatgaaagaaaaaattcttataaactttaaaaatgtaaccacttgtttagggtattggaaatcaattctccatatttgacactatcaaattagcttcagataacccttttcttcattttgtgttcatgttgttttcactttgtaaacagtaaaactccatctccttgcgtgaagttattttagggggaagaaaaagtgcaatacacagattcattatcttgtaatgactcattttagttttgcattgaatcaatctttgagacaattactgtaacttgattttttccttccctccactggtaataaaagagacattttatttcagggaaatgtgaagtaaaatagtcttgcttcataagcatgctcagagaagagatttttaaatcttgttttaaaaatagtggcatcatgttcatgaacttcaagttttctttgttccttttcttcttttcctttttctgtgaaactcaaggattaataggaagcatgtccaaaattccctctaggaagaaatttagatagggacataaatatattttaggcattcttactaagcatttccaaataagctttaagagtttcttaagtaatctttgattttataggaagaaaaagggtcaaagtttgctttcttcacaaacttcagtaaacaaatccctcttgtattaatgaagaaattgactaaacctaccaattatctcactattataaaacatgtcttgaaaatttattagatgcaggccaaaccattgaactcagaccttgcctttaagaagcttccatctaattaggatatatctcaatctattggagataatgaagtagaaactaaattattattaattttagacacacaaaagtcatttcacttctgtaaaatggaagaagtaacgtgaagctacctgactaatgaatgttggataaccagttattggagtgctttgtggaggtaaagtaataactacaaataacaataaagtttcacctttacttgcgtatttttatgtcacttttgctgaagaaaagtgccttgacatttttactagtaaagttaacttttttgttattttttagagaatagaaatggataaaatagacaaatttgatggattctttggaaaaatcattattggatttatagttatcggaacgtttttgaatatgatcaaacagtttaaattaagattctattacatggatagtaatacacatggaattaccttaaaagtgattgtgtactatgtagaatatcacaattttgtaaaatagttctatagcgaagttaaaatattactggatatgcttatgtaaaatacatgaacacacagttgacataaactaacttgatgattggccagaactggaattccaattcttacacctacccatccacccacatctattggacaagtgcctggttaaacagatgggccttgggctgtgctctcaaaacaggcaacctccacctttattgagcaaaacattggatgaaaatagactatattgtcttattgtgctactgaacatggtaatttaagtgaagagctcctatttattattgttgttggttgttaaaaatacctttttccttatgaatgaatatgtgaaaattggaggacaacagatggagtcccagggaactggaaaacctatagatagggaggtaattctcagtcaaatatgaaaataaaaaatcagcaggagtgtgaaatttcatgtggttttataaatgcatgtagctaagattttagaaaatgtttggtttagcctacagacatgggttcatcatgaaatttctcttttccactaaagggtatgagaccaagtagaattctcgaagtctgtcctcatgccccttcaataagttaccacttcaaaagctacaaagctggattcagggcaggaccttaagttctggctaccgtctgtgtaaatatcacacacttacatgtggtaaagtcagagggacttgcagacctgagtgatacttatgacatcagaagtgagttttgtttatggttgattaatgacattgctacttgggccatgtttgtgacaacagcactgagggcaattagcaagagcaacagttagacagtcccatacttggaagattatatgagactaaatttgacactcttaatattgacatctcgtaaatagcatttggtctctatgtattttcatgatattctctttaatgtaacaacaatcagtaaactgtcacatatctaacctcatggaactcacatatctaacctcattgaatcattaacaatgatatttgcacctcttaaattatgaaatgggtggtctgtgggcagcatgctaaaattcaagtaaaagacttcctactcctttttcctaaattatttttttagtcttttggtaactcagttttcacaaagaaggggagtttggttgctacctactttccctgtaatactgcttggctatttttcagtggcaagaaataattcctgtgatacttaagaactctatggaataaagctcagtatagtgtatattgaattatgctttctggttattatatttggataaatttaggcataaggttgtttaatacttcagcagaaacctgcaatggaacttcctaaaaatttgaccttgtgaaagaaatccaaatggaattgttttatatttttttagctcctataaatgtgtgtgcggggttaataaataaataggtaagaaatagcacagcattgtttaacgtttatttctttcctcaaaataaaaagttaatagaaaaagtaatacattgttattatttaagagttatttcttactgcaaaatgttttgtgatagctttgtttcattgtgtttaacttaatttaaattactataatacttttttgttacatcgtcctttgaaatcattgaaattgactaaataatattgttctattctacttgataaaatggagagctcagaagattaatttagatacagaattgagaataaaacagtctcaatttgtgcttaattttattagaaggaaatatattataaaaatagccatttgaagagaaaaaagataaaagtagtgaaatattttaattttcaaactctcataaaatagtaatacaggctgtctttaaatgaaagtaaatattttgtgtttatgtatgtatatgagacatatgatcattattagctttatcttgaattactctgatatactatatttcttatacatattatttaatgtcttttgttgtgttttgttttaaacagcaaatgccagtcttcttggaggaggaggtggtaagtcctgaacatcacttaacttaaaatacattttaattgttataccaactacaagatatttagtaagttctgtgacacttaaaagaaaattaattttgctgtagtcatcaattacaaaaatgttaatctttcaaaaataatttataatataaataccttggtttgcttaaatgttattttaattgacttcgagatatatacagtactcttgtcaaactttgtatttctgcttttggcataaggtgtaacagctataagctatatgaacacacatgtaatacatgtgtgtgcatagttacagagtaactatgtacatattacagagttacttttaatatgaattctaaaacaacagaacatttggaggctatggtttctttttccactataatgactttcttttgcttttcatgactttgtagcctgagagcttaatatatcagccacttactttgaaaaataaaaaagaaattactgttgacactctgctttttctttctgctcagttagaggagaaagagaaggagatcaaagtgagctgagggagacagagattcctgtactgggaatttttttgatactaaaatcttgtaactatttgtatttttacttctaggttaggaagatgaaagctttcatagtcccagtatatataatatagtaggagagaaaaaagtatacgattagaacagagtccttttcatataaggcccagatggacataactaggtttgtttcctctttccctgtcactctctttctcccttcctttcttgctctttcttttttcttacacacagttgaaacagataggattgtgcagagccttaggctttcatcaggaggtttcattgtaatttttatttggaaattaagcatttaacctttgtttctctgtaagaacagttgatttttaaaaaacagaatcttgaaaataagaaaaatagaaaagtgtttgaactaggaagtgctcttcgtattatcacatgtcagtgcatgttctgtaccagagtatcatgaaatgagtgtgggatttgaaattggacttactgtgtggagaccaggaaagcattactaaatatctccaagcctcagttacctcatctttaaagtatgaggataatattaactatctaaagtgtttattgggagaattaaacaaaaatatttgccaagtaactaagtaatagaacagtgggggattcataaatgtctatttcttttcttctttcctaagttattttagaaaatatgaatttgtaggatgtttcattgcacttgttattttatttggggggaactagaagggaaaattttccttagaagttgaatttccagtaattttttctctctgtctcttgtaataggtgaagaaaacatgattaagttaaattgtccatagtgctgattttcttacaagatatattagtattttaagaaacctcacgaatattgttaatagcatagaggaaagttaaaattgagtctatgtaaacacattcatcaacttaaaacaacaaattaggtagacgattcagttattgcttttgagtatttcaaaaaattgacttgactaattatattagttaaaatcactttagccactataacagaaaaagtaaaaaacattaaaatccacaataacagtagtttaaaggagatataaatgtatttctgtctcatgtaaaggtagtctagatacaggctggaatggttgtgtgatgaatcagagactcagctcttacttttctgttctttcctagtgcatggctttcatacttagatgacctcagggtacaggatggctgctggagctctagccatcacaaatatggcacaggtcaggagaaataggaaaggcaaaacatgaaaaaaagtgggctcccaaacatgagtcagttttctttaagcagatttccctggaatcccacattgtctttgaatctggacagtattcattcctagcatgtagtcttttattccaagaagcaatgcactcatcagaaaaaattaccgttctgttcactaaggaggaaggggagaatggaggttgaggaaaacagtgtaatgtacctgccatggtggttacctctatattgtcaaactgatttctttaaatatatgtatgtattgttggtgtgtatagaactgactccagtgatttggcttgtattttcttatgattcctctcttctctgtgagaagatttatgaatttctagcaatgataagacattcaggaataggccaactcagttttctatttagctaaagtctttattttagtgacttcctctagatggttgattttgctcaatttgtcacgatttataatttttgaataataaaattagcaactcagcatcatcataaagataaattacaagtatttaagatggttgtaatttctttcattaaagtaggtcatcgacaggtttaaatttatttatgcacttctggagatgtcaagattgctctaaaacacgtgtctgatttttggaaagctgcatttaaaaattaaatttaaggaatatttttagccttctctgagctgatttttgaccttatgattctatgacaaatctttttaatcctctcagtgatatttgtaaagtaacagctagtaatcatctaataagaagcgattgaattgatgtaattctcttggatttaatcaaacaattccttttttcaacatgaattaaaatcccttcaaaggtccatcaagagaataattttttaattgactaaacaatttgatcaagaaaatttgacaccacatacaaaaataataatgggacctaagtccccttctttagatcctcaggagggcttcccccatattctatatgagtagtacctgatagtgaaatgtagacaaaattattgtatgcaaaattgtattagccataaaatcttagcattttgttgttcttttctgagtgcttaccaccaataagactgatcccctgaaagacttaaaaaatggtcacatatcatcctctcagtgctgattttaaagtgagagatttactttacattgatgtgaattttcatctttgagctagatatcaatctttctatgaatgtattgccactgactgcagttcattgtagtgagcataggtgatgtgattacttctactcagtcatttcagttaaaatttgataacttttaccaattttaccaatttgcttggtaaaattgatcacttctgttcatagtttctagataggttgaaggcagagacagttatgtactaatttcttaatatatagctggtctatagtgactgaattgtacttttcaggaggcatttatattaatgttaaaaatctttgaagttccgttaatttttttgacaaactttccattattattaccaacagtaccctgtatattattttacctgttgttattttaatggttgagagaaacttcttcaaagttgcatagcttatagggcaaagttggaatgagaagacagcgttcttgactgccactccagggctccttgccctggcactgtggtttttaacatgcctctgctctccaggtttgcttttctatgcagagatgggtaattctgtttacaccaggaaaaataagtgagaggacaggaaaacatacagttaagatacggatgttgcattccttggcttattttcacaagtctcaagatctactgatagcttgaaagtcgatacaatggcactgtcttacagtactcttggattgctgcccagattcatatacttttttgtgcatttgagattcagtcttagaaaacactgcatttcagatacatgttcacccatctgtaataagaatgttgtacatgcacaaggtcctgtgatgctggtacttttggaatatatagtaaaatataaatcattgtagccagtcttaaattacataaagaagtagaattagaaagaaaaatcagaactgaagagctaattcctcacttccttttggatcattatataataggaacaaaatttacggtctcttactttagataatatcttttgtttttcattgacgtaatagttaacacaaaactagaacctgctgatagaacccaagcaggatgttgtttatgggatgtgcttcctcctccagtctgtcaaagcacttgagggataatgctagacatttaaaatgacggttcctgacagagtggtaacttactgtcttttgtacacatagctttatgactgccattttaatcatatatacatacacagagataaaaaataaatatatatatttgcatcaatgctgtaatttgataccttattcctgagttgattctgtggcaggttaatagataagtactgttgtctaataagcaagtgctgttatctatgcagtcagccccagctgcaatgcatgcaaagccatttgtccaacgcgagaacagagaggacactgtgagccttcccacctctgatggcttcctgctctccttctgccccttagagtaggcccaaagatggacaaggttcagtgccttgtgttagtacctgctcctctaatctccctcatttctgatttggacagttctacttgcagagaggattcattatgcttgtctgttattaatgtcccttcatacaatgaggctgtttgtgtgacatactaaaattcatgcttgaaaaggaataaaattataacctgggtgataggtgataggtgcaccaaaatctcagcctttgccattacacaattcatccatgtaaccataaaacacttgtacaccaaaagctattgaaataaaaaaaaagaaaaaaagaagagtgaaatcataaaccatgtgctgttatatcatagatagtatttgtgcatctccacacacccatcatctgtttctaaacacaagcacacatatgtgcatacattcattcagcaaatattaattgagttactattgtttgtcagtattgattattgattgggcagtaaacacagccttttccctgtggccaatcatgatccctgttcagctgaattactagagcaattatagttgtctacattctttcagatgttccaaggattctgctggcatagtcttttgagttaaaatgatgctttaacattaatagaatgggcattggatgtcttctttaaaaggcagagcagatatcctgaaaacaactaatttcacaaaaaatctgagttgctacctggaattcctaatgtgaagagcaatgtgtttaaagggctttttgagtgtgtttaagagggaatgatttcataaattttgtcttaagcattcacaagcagagtggagcgccctctcacctccctccacatacacaacggctttcccagcatatatcactccagcgctcaacatcctgcagtgattctgtttcgctcttgttaaacctccagatgtggctgggcttcaggcatgctgggaggaatctaggatagcagtcagcagggagggactgaggcagtttacagagggtagagtgttgggggttacccctcaggagagtcagtcaagcatggctagtagtgactttgccagctggcctgtgctcagcaggggaggggccccagccatgggcctggggaacagcaacagcctttcagtcctgagagagcagcatggcaggagaaactcaggggctctggcctttttactcaggcagggagcagagatgcaggaaaggatgtgatgctaggccacagaaaatagggtttaaatcttaactgcctcggccaggcacggtggctcatgcctgtaatttcagtacttcgggaggccagggtaggaggattatttgagaccaggagtttgagaccagcttgggcaacatactgacacctcatctctacaaaaaataatcaaaaattagccaggtgaggttgtgcatgcctgtggtcccagctacttggaagactgaggtgggaggatcgcttgagctctggacgttgaggctgcagtgagccgtgatcacaccactgcactccagcctggccatcagagtgagaccctgtctcttaaaaaaaaaatcctgactgccttaggtgggattgatcctgggcactgtgggcggataagcctgctaaaggaggccaggaggcccagatatgaggaagaagagggaaggtggttagggaccaggagccaggccaggtctgacaatgctgagttacacactgagccaacctacctttgccctccctccttccctcctccccgtcttctgtcctccctccctcctgcctcccttccttctttgctttcttccttcctttccctgtttccctccttccttccttcttttctttttgtctttctcagtcaacagcaactattgattacttcttgtatactagccttgaaatcagtgtaggtaagattcttagaactaagtgcagccagaggcataagtacttatttacacattaatattttaagaactaaataggttcttcaagcagggaaaatgaaacagaacaaaggaagtcaacagcttatagtggtcagggaaggcttcccagaagaggtgacatgggagcagtcttgaatgatgagtagtagttttcaggaagcagaaggtcatgatctattcagatgtatttcctactctttgctgtagagatcttgctctgccatctcctcactgttctgccatcatatcatccaggtcttggttaagctgttttctttgacagtcccagcatgccacttaaaatggagtgaaaagtgttagggcagaactgaagagaggaactctggtgctggtgatgtgggtagcaaacctccatcagagcaacctgggcaaagtctggtggtcatcgccagtgcgagctcctccccgctttactttctcttgtgattacctcacctgcttctcagtctagggaccatctctacagctgctcactccagttggatttctagtatgtgttttcttcattccacatgaacttgtctagttctttctcttaaaagtttaacttagccctgattgctctaatcttgcctgctttttgtcattaagccttccagatgctcttcgtggtagaggaaggtgaggtggggagggttcaaaatccaagccatgcatctgccttgaactcttctattgtaatggcaattccaaggacataatttgtttattacacttctaactttggttactgtgatcccttcattctaaaactaaacttcaaagttattcatcatgtttactacacatgctcccacttctaagtgaacctccctgttgaaagggcaaccctatgcagattaaatgctccttctcattgtagccatacctgaacctggaagtgtgtattccccaattaaggcagaaatttcctgagagtgagtaatttcatattcatctttatagccctggcttattctatcacatatagtaggtgctttgagatattactgtctctcatcccggattctcaacatgtttatatagttcggttttgaccagtttactttggaaagttaatctctttatcttcaagtgatttctaaatgaaaaaaaaaaacaaaaacccaaacttcagaaatgcttttaacaggcaacctgaggattatattcatatttatacagtaattatttttatcatagtattatcttttatttttaaaaagtttgtatagccaggatctcataattttctttaaatatatttactttaaatgggcaataaagagaacaatatgtaattgaatagatggggaatgaaatacagagaatttacattctacagatcacatggaaagagggaaagcctattgtttcattcatgttttaccatattgagggtatttaaccagttatatcattctcctttttcatagtttgattttaatttattaataatttgtcttttacatactacaggtaacttgtcattgacatcatattactaatatgtatactagtgttatcctacaatacgtttctatttttttttttagcttcaataatatagaaaaattgtatgtgttggtgttcttaactggatactcttttaaggtcacttgtttccattttacttttgatttttagagtttgcgtttttaaaatgagttttataattggtatgtattatttatatttgtatgtttcataattaactctttttaaaaaaatagaggtttagtcattctttcagaaaatgttgagattagcaaatcatgctcaaagataggaattaaaggttgtaaagaaaaagaaataaaaataatggaagccctcttttcagatgtggaaatacgttggtaaaaattctaggctcttataagttctctcactgtgttgggctagctaaatgatacctaaatggttggaagttcagataatatctataaacaaatattttaaagttaggaagtactctaacaggtgccaggatatgtctacatatcttcctaattacatagtagctatagtataatgcttgtgtagcttatctacttgcgttaaaggtaaaatctttttaaaactataaaaaagagaagtttattgagttcccgatttaaatatctctcatccccaaagaatctctgaatgtgacttgttggtacacagtaggaaacaagtttcaagcaaaatactgcaggtcaagcctgttatgttttgggatgactacattatattccttcagtttatggcacagaattgtttttttaactgtatctgatgtagctccacagtaatacaaggtggggcaatttcttagggagccacttttataatcttttttgtttttggcactgttaagaatcctcttcttcatttacccctcaaactgaagatactgtagggatgaatgaatctggccagttcttgatggcaacaaattcaagatctccagggtcctgtcacaggcactgtgggtccctcgggttacatgatcccttattgctgcagctctctttggtcaaaagtcattatttttttaatgagttaggacaaatttattgttttgtatactagtttcctgttctaaaatgatggttataatggtacctaactactttacaggtgtggaataactaattgcccactgtaaaatgttgttgaactacaaagtgttagataaatgagtatcactctacttgtcattattattaatattatagtgcaaatctgaaagatgaaagttgctggataattgcaagatatggtgatggtgtatccaaataaaggggaataacctgaattgttggataacacaaatccagatatctgtgtgtagtagaagagtttgttttacaaaaagattatatagatagctgtgctttaattaacccctcaaaaatctgaggatttttcctacaaatatggatagaggaatattctaacagtagttcatttcatcggtatgtatagtggtcatcataaggaagcgtctttcaagtatttaattgcccagagtaaaaaataattatatactagagtatgaggaattccagcttcatgcaacattaccagtctaggagaaggtgagcttaatgtagtcttcaggacaggacacgtgatgaggccatctcttaaggtatgtgaaaagaagccagaagcagtagcatttttctattcaggcacatgcttggcactggggaggaacaagggatcccacagaatagagttaatggcccacccatgtgtatgtccagcaggcagtcaggcctggaaaaagaagtagggaaagaaaaacctagcagaagcttagagtacacaagggaagggtggtgctgcaatctggaaggtgacagggaagaccaggtatcctcatggggacacctgaccctgagtttaaatggcagcaggagagacctggcaatagtctggagccctctgaggtcagtatatagaccccaggtctgaaagggtgacccaagtcagattagctaagagaaggttgaggctgctagagaatctgagtctccaaaactggctttgagagtggggctgaatggagcttatgcatggggagaatcagtggattcagctatgaacaactgggagagagatgcaagaagactcagaagtgtacaatattgggacgttctccaggagaagatgaacaagaagtgatgtctgaggagttgtagctaaaatactctctcagcttctgccacatggttatttctgaccaacaaaaagctctcagaaatagccatgaggggcacaaagccctcactaggctaaaaatccactaactctgcaacttcctagatgctgaacacaccaaaggcctcacacttacaaatgtggtatgatgtccatgcctgcagggtcagctttgcagaacagaccaaaaagacttttacaaagctccaggtttcatttctagcatgattggaaaaagcataattttctagtcagattttgttaaacaaggaataattctacatctccattagtacaaaagccttgctctgtcattagattatctctacttaagaatcttctagcaggcctctctgcatgccctggatggttgggcactatccctactgtgtctccatcaaagtcagtgcattttcttaggtaactatctctctttcctctaagattatagatttcacaatgacatggactgtttctattgtgttcacttgctgaaacctcagaatcttgtagaaaatttgacatataataggcacctaccaactagctgttggacagatggctaaagaaataatggtaataactaacgtttatggggtgctgatctgtgccaggcactgtgtaagaattgcacatacattatctatgttaattatctcaatattctgagtagatagatattattattcttctcattttacagatggaagatcaaaagctcagtgaggttaggatgaataaaatattgggcagacccagtatttaagcaaagactctctccaactccaaatcccccttttaatcattgtactgtaagttcacgagttcaaattaacttagtattacttatgggaataaggagtatattcatggatttatatgtctctaaaccttcttattctgattttttctgggcaacagattttcttctttgaatttccaactcatccttatgtctaattctcatcctctggaaatagctttacccctcagagttatttcctgggaatagaagaatcagtggtgctaagctaggaatttctaggcttgtctctccttctttctcagtttgaatatgatacagtatccgttatttaaccttaattctgataaaatagtattttcaataatcagaaattctgaggatcttgttgtatttataaataacagaaataaactataaagaagtcctctttgacttttctcaattccatttttctttcacacagacaatcattattcggtgtacaactttttatttgtcatagttttatatacatatgtatctgcaaataacaggcaatattgtttaaaaatgttgcataaatatattatgggcattctaaaatttgtttttattttattattttgctaagcattgtttaaaaatgtattcatgtagatatagaaaccactaattacaaaatgattactctaaggatactttcagtttaattgagaatggctttatgcctataaaattcagttctgtttttgaaaagtagcttttaggaacatatgtaccagttatacaagaatatatcttcatagtcctggtacagctagtctttctaatgaagatgataaaagttggaaaatttgaagtatgtacagtatatagctttggaaggcagcagcagtactaaatttcaactcccacaagtttagatgtgccagggtagtatatctggataatatttagattggtgctcttaaatctgtctagtgtttctttgcatatatcaaggaatacctgtttttggcctaaaaattttatgccaatctttatacccaaacgccaatggttaattcatcctttaaaaaataatacaagataactttgataaaacacctagaaagttcttatgtttgtctcttttcccttgaacagggagaagaactctattacaagtattatcttaaatatactctgaattagtggttctaaaatttgaatatgcatcagaattgcttggagggcttgttaaaacacagattactgggccttatgcccagaatttctgttttagtaagtctgaggtgaagtccatgaatttgcatttctaacaagttccgttttaatgctgaccctgccaatctggggaccacactttaagaattactgctctaaataaaagtgaataaagagaggattttaggttatggcagagtgaggagattggtaaatcctctctccaaaaaaagcagctataaggctggacacaaaatctccaacaaaataaaatcataaccattttagtactcttaacatctaaatagaatataacaatttgagaaggatttacgcttcaaaaactgctgaacttcatagttggaatctatggcaaccttgctcccaccctctccatttggttgtgtggaaaatctgcaagggttgggagtgttggggggtgggcaggttgtgcctctgtagtcaaacaagactcatagactttgagtggtgagtgattaatacgccctgaagagttgtcagtgaaagtgatgatcttggccagatgagggccaaaagcctgaagttatggttgtggttgggaccaatatatttctggctaccactgagcacatgcacagtggagaccaaagagaccctaagctttttatgtactcttgtccaaacctgaggctgtacacatttgcataggagccacaaaaggccaagaagaatataaaagccagagaagacttgtaaatggccttaaccgtggaatgcacttccctacccatataaagatctgtgaacagagaatggaagtctatctggctctagatatttgtgcaaaaggactatccagtcattggctgaaaacttacaatgaatcaggagtaacccttgggaagccagaattaaaaataaaaagcaagaataaaaaaaaatccaggcaaagatgtcagagactgctgatcatgaaggagacgtattttacagatttaagcctgggtaagttaccaaacaactccaaaaccttccagcaccgataactttcagataaaaaataatcatgttctggccaggcctggtgggtcacgcctgtaatcccagcattttgggaggctgaggtggacagacaacgaggtcaggaaagcaaaactgttttggctaacacagtgaaaccctgcctccactaaaaaatacaaaaaattagccggacgtggtggcacgtgcctgcagtcccagctactcgtgaggctgaggcaggagaatcacttgaacccaggaggcggaggttgcagtgagctgagatcacgccacggcactccagcctgggtgacagagcgagactctgtctcaaaaaagaaattaataataataatcgtgttccagagttgcgatactatatcattcaaaacacttttaaaaaatgggacattcaaataaacaggaatctgtgactagtattcagagagaaaaaaacagtcaaaaagtagaatggtgattactgtagaccagtgggggtgaagaaggaatagggagttattatttaatgggtacagggtttcagtttgggaagatggaaaaagttctggagatgcagggtagtgatggttacagttgagttttggccattatttcttcaaatatttattctctttcctctctttctggggctcctgttacatatatgttgtaaaaaaatatgcaaataaacaggtacttgtgactaaaactcagaaagtaaaaacagctgaaaagtagaatggtgatcaccagagaccagtggggcgaagaaggaataaggagttattgtgtaacgaatacaaggtttctgtttgggaagaagaagaatttctggagatgcagaattgtgtgaatgtctttaatgttactgacctgtactattaaaaatggcccaaatggccaagttaatgttatttatatatatatacatatttaccacaataaaaaatgtagacaatagaaactatgactgagtgtctccagatgttggatttagcaaaaatttcagagaattatattatattgccattttaaatatagttaagaaactaaaggatacatatatttaaagaattaaaggaaagtgccacaacaatgaatcaatagattctccactccccactatgttgatggccataaggatggtggcccatgtccgtgatacagtttgctgatgctgcagggaacaacatggaccttgtttttctatgattgagtgcgctggcctgtttgttgtctccctgagaaatcagctcaggggcttgcctttgttttacttaactcagaaatttctgagggctggagtggcctcctgaaagtatttaaaggcaaatatactagctacagcctcctgagataagggatgtgaaatcatgcaaacattagacatacagaaaagcctgggaaagaagaggcatggagggagagaagtgatttgaaaggctttcacatgtgccaggaaatctacaaagccacagataagcccagggctggattcatcttcagaaaagactcaagaaacaagagtttcacctctggttcaccgttaggatcagtgaaaacaggaagtgaaggctaaggaagagttataaatagcctgaataagtattgaagaaatgcctcaacatacagtcagtctgcaaagatgggagattttcttttctctttttttctcttttcctcttctcttctcttctcttttcctttctgctccttttcttttctttcggctctaggcatttaaggaaatacctgtcaaattgttatttgaccactaagctaacagagcagagacctcagtgaccacacttaacaaagaacacagtcttcatgcaaacggtttagaaaaatcactgaacaatcaaaacccatgacagcggccaacaataaacccaagggagggagagagagcagaatctgattttcagagatttgacattagaatattaaaagttcacttttcatcagaaaattacaaggcaagcacctccatgttccaggcaccgttctaggtagtagcaatatacctatgaacaacgtggacaaaaatccttgctcttgtgaagttggcattttattaaataaatatatttattcactaaggccttaatttttcagcatcttattatggtaattttcaaacacatagaaaattaaaacaattacacagtgaattgttcatatgtttaccacccagattctacctttgacattttactatatttgtcctatcttgtatctatccatgtagccacctatttatccatctaccaatccatcctttttgcttatagcattatatttaagaccacacaatgaaaacaacctaaatgttcaatagtaggggatttgttaaataaatttatgtatttgcactcaatggaatcatatgcaaccattaaaacttataattttcagactgaggaaaatctgtatctagttttaggagaaagcaggatattaaactactgtgcatttttattttaacactatgtaacaaactatacaaatcaaaagaaccataagctattgtagaaaaaggaaggatactttatctgttaggctagagggttttttgtaaccatttttttctttccccttttttgattttcattaatgttgttactgcattatttattccatacatacatttacaattttttaattgggacagtaaaatcattaactgtaatgtgcatccaaactatttagcaggacatggagaaaattgtaatatatttgattaactaattgcatattggatattttctagtgcctagatatacaaagatgaataaaatgagctattccttgcccaatagaagttcacaatatgttagagactatatatttccataaaagaataagtatatgatgaacaataattgtgctgtgtatgttatgtagtgattaagagtggattttgaactgattctttagatttgcttccaagacccatttcataccagctgtttgatatttggcaagttatttaacctcactttgcctgagtttcttatctctaatgaagttaaaattacttcctactcctcacatttatgtgaggagtaaatgagttaatacaagttaaaagctcagaataatctctggcacattataaatagtaaacaaatgttagctatttagttattattttaaatattagcatattgttaagatttcatgttaatatattggtattaagattctataatacgttagatttttcttcagaacttctactgattatgtatttatacatattttagtgcatatatgctgatacagtgaagtaaaggtaacatatttatgtttggatgatcagatattaaagttgcaaattttacttcagcccaatatatttatattcccttttaaaagtctttattggcaaaacatagttaaaatattccaacccttagaaacataaggtggaactcatttctaacttaaaaattatttaagactattttagggtacagactgattctcttagaaagtgttctgctttctattatcttagcgttggtgtttaagttgtataaatttatggcagcgtttggaactagctcaaggtttacatttgatcaggatatgtggtcagattaaaagcagtttttccttagctctaagcctaatgtcaatagaaaactatattgaaaagaaaaatgtctcttgagttttcagaatatgttgtgtaattccatggtaaatacaaatataaatattgtgattaataaaatgagaaaaacatgagaatttagatgcttgcttcctaagttaccaaagtgaaaagaggacatttatttttgtttgtctttacctcactttcacaaggaatttcagatggaacagttgccagtttataattctcctcttgaatattttagtgtcattaaatgggaataatttggatcacatacaagattatgatggaaatgatagaatgatgtaatgactttggagcgagttttgtcttgtctcaggagaactcataattggattgtgtttatggaagaagatgaagaagaagagacccaaaaatggaataacccttttatcttcatctgactctctattcttgtcacagtttttatcttcaggagggcacaaatagcctctatctgatttccctatcccatgcatagggttttcttaaagttttttcacaaagaagaatttatttttaaaaattctgttctattcttcatgtgttatttttaaatgagtttcacagagatactctgaagctgaagaggttgtttttaataatctgatgttacatgataagtactggaaaaaggtggatgcagggagtgggtggtatgataaaatgctgtgggtgtaggtcctgaactgcaggttggtaaatgtttttttggtaagtcaggagataatttaagcttacttatgtgattgctctattccccataatcctttgcaatgcttggtgagacagaatgaaagaactccaggtcttagctgtttgttagtgaactgctttttcttagagctgatgcttttggttatcaaggaagtctggatagtgatgaagacaagtgttgacaggagggaggctgaagattagggttatttttttgagtaagaaaacatgtaacttaattgtacacttaaaaataactgaaagagtgtatttggatagtttgtaatgtaaaagggtaaatgcttgaggggatggacaccccattctccatgatgctgttatttcacattgcatgtctatatcaaaacatctcatgtaccccataaatatatacacctactaagtacccacaagcattaaacatttaaaaattaaaaaatatatatgtgcatactctttaggaaaaaagaccactcccagttcagctaatatctgtgatctttttggatattttactcctgaaaatggcttcgatggcttcattagaaacaacctaaaatatttcttttccatagtgaataaattctgaaagatatttctcctcataaaatttaactaattaacctaatgccatccttggaatatttaaacgctatgtctgttgtgtttggtttaggaaaagacaaccctagaacccaatttttttcagattttgcactataaatttattcatatatattaaacaaagttgctgacagaaaaaaaaaaagttgtatatcctattacatgtgtgatttagtaatatcctttaggacacaataacaattatgaggtacaataaaatttcattctgtgcagagcttttcatggaacctctaacctcaattcttccatagcactgtactacaccacgcagtaaagaaacattttttcaacttatttagtatttgaggtataaaatctggagggggaaaaatgaggatttcagttggatttgaaatgagatggagagttaatgaaacagagagatacaggcgggattccttgggctgtcaagagtagggaagattgaagaggcaaaaatgaattcaaagtgcataggcagatgcaaagatatccatgaaggtctatcatccatgatattaactagagcaaataggcaaattttcttttccaaaaggaagctatatttaaagaaaaattaaacataaggggaaacttgagagtgatttgtaggaattcacatcaagcgggtggtcctgtttcttagcccatgctgaagcattccccatctgtcatctgaagggaaagagcattgaattcgtagtatgggagtttcccctgtggaggaatgagaagatgcagtgtgcagctaacaaccaaggcttgggggtggaagatgggaagaatctgaagagcatggaggtattagggccatgttagactgaatgaatgaaataaatacgggttagagaaaagtggagggaggaaaaagtaaaatcagtcaagaattctaattgcttactcatttggaaatgaatggacacttatgaatgagacctcgctgcccagaagataggaagtagcttagaagttgtttcctgatggataaagcagtgtgcagattccagtcacttgggtctgttcttgcttctcatgagcacacacctcacacgtacttgacctgagaggagatgctcttgttggaaactaagatttttttgtcctctcgtgcctcacattatgcagtcgctggaggtgaaagatcaaagctggaaaagtcatctttgaaggggaaacacctttcctcactcatgtttacgatttttttctgtcttggtttcatagaaaaactatgcaggtagccagagccctaagttgttgtgccatctgtaaacctgacatcatgtgcaaataacaacagatgatggaatttcacctagggtctgatcgtgcccagggagacttcataggctccaaatgcctgcttttatcttatacatcgagaagccattcaaactttcagggctctgccaacttggcaagaagaagagttggcaagcttcccatgctagttttcttttagtttgaaagttttgaagtgggtctgaggttgtgataaatgcttgtgaggtctcttatttgttgactgtaagcttttcatcatttgacatgaatgagaaacatcattcctttgcaaggatattcccttttttctgtttctttaaagttatcttagagacttctcagttactgtatgaaaccataaattctctgagcaaatgcctgttttgacagagagctttaaagatacatggcaaaagtttaaacaggtcctaactgatgggatttaaatactgtatatagtaattaaatagttgtgctaataaaaccctaaagcactgcttgcatttttcttctttaatctctcaaatttttctccaagactcaaaattcatgaattaaatgagttagccaagggaaatataattgtgttaaatttcctaagtgctttacacactgatgaaaaaatttaaagtttataataaatctacaaattataggtgggggctcattttaccacatagcttctttaaaatgaaactcccaagcatggtaaagaaattgcatataaatacttgctgcagaagtaagaatacataaaaaaactcactatgtacttgagtctatttgatttgttatgtttagatggctcccatatgaataaaataacattacaacaaagcattttatgactttttcatatggattgattatatattgtgcatctcaaataatctctatctcctttaatattcctctataagtcaccattacatagttttagttcttacataatgggatgctattaaatttcttctcccccttttcttaaaaacaaaaacaaaaacagaaacaagaataaaaaaacactccccaaaatgctatgctatctttttaaattttacaacatttttagccatgggcttcatatctagctcaaggtttattgtctttctactttttctaaatgatttaaggcttctctttctcactggacttaccataaagtgacttcttgctcttctgtcactttctgaaccaaaatttctagcctcattacactgtgagagacttaggaccaggggcagaagagaagccttgactctctttgaggactagcataacatgatatgaacatagcaggccactgatatgtgagcatcccataaataaaagagaattatcgccaagaagcccttactcagccagactacatttccagtttctcttgcatctaagtggaggcttgcatctagttttcaccattggaatgtcagataaaatgatgtatgttctttctagcctgttaggaagcagatgtgacttctccatgctgcctttccctgtcagctgactggctatagaagactctctggacatcacaatgtcatcctagccacaagatcaaaaagagtagagtttctgtgtcaccatgtggagaaaagttatccaccaatctgaaacaattacgttagactactgcatgggcacaaaataaacctctgttctgttaaaccactgaattttttttatcgcaggtaatgttatcttcactaatacagggaagaagtcctgctgcttgtcagacttagtagggcccactaatcctgttgaacccagaagaacaggagcaaagctgctctagtgtgttgaatggcgccaataccttgtgaatgagagaagtctgcttgaccaaaagacctaggatacaatggatgccttctacaacttcctcttagtgactataaaacagagaaaagcctcttctaggacttccatggtagattttccactgcttaagcaatagcatctgcttagtgaatatgtctgctaaagaaaaatccagacaagttaatattcacattttatttaagaatattctagatgaggaagcaataattgaacaactagaagtgtaggctgtcattaaattagagctaatagaggaactggaagagaactttatcaaaaagagaagtgctctcaagaagactgaagaaaatcgtgaaaaaagagcattcaaaagtattctggaacttaaactgaaaattctacaaagctcaatagatgagctgaaaaagaaagtcactgtgttatttatcatgtaagattaatgttaggaataacacataaaagaaatatttcacaatacagtgcaaaaatcgaaaaaaatccacttaattgtaaaactagctctgaaaaactgtggggaatatatatggagagatccaatatttccacttcttgctctgtatacaaaggaattgaaattagtgtgccaaagagatatctgcactcccatgtttattgtaccattattcacatagccaagatatggaagcaacccagtatctatccgtagttgaatgaataaagaatatgtgagatacacacacacgcacacacacacacacacacacacacacacacacgatggaatattatacacccttaaaaaagaagaaaattctggcatttgtgacaacatggatggacctggaacattatgacattatgctaaatgaaataagccaggcacagaaagacaaatactgcatgatctcacttatatgtggcatctgtaaaagtcagtctcacagaaacagagagtgaaaaactggttagcagaggctggatggggatttggagagaagaggagctgttgattgaaggatactaaattccatttagactggaggaataagttttagtgatctatttcactgcatggcaaatgaattataaggtattatgtatttcaaaattgctaaaagaattgatttttaatgttcccatcacagaaaagaagttggtaaggtgatagatatgttaattagcttgatctttctacagtgtatacatagatcaaaacattacattgtacattatatattatataatatattttatataaaatataatttattttatatattatatactttatataaaatataatatactttatagtatctattttatatctataaaatcattatctctcaaataaataaataaataaataagaaagaaatttacctagagagcaaaatgccacatttataaacctttaaagcacttgggtatcatattttgcttaacaagtattgctcacctcagagtcttaaaatgttctatttaataatactattattttatctttcaacatttaatttttaaaaatgtaatttttcactctgatgataatttcttttgctgtgcagaagctctttagtttaattagatcccatttgtcaattttggcttttgttgccattgcttttggtgtttagtcatgaagtctttgcccatgcctgtgtcctgaatggtattgcctaggttttcttctagggtttttatggttttaggtcttacgtttaagtctttaatccatcttgagttaatttttgtataaggtgtaaggaagaggtccaatttcagttttctgcatatggctagccagttttcccagcacagtttattaaatagggaatcttttccccaattcttgtttttgtcaggtttgtcaaagatcagatggttgtagatgtgtggtgttatttctgagggctctgttctgttccattggtctatatatctgttttggtaccagtaccatgctgttttggttactgtggccttgtagtatagtttgaagtcagataacatgatggctccagctttgacaacctacagaatgggagaaaatttttgaaatctatccatctgacaaagggctaatatccagaatctacaaggaacttaaataaatttacaagaaaaaaagaaccccatcaaaaagtggacaaaagatatgaatggacacttctcaaaagaagacgtttatgcagccaacaaacatatgagaaaaagctcatcatcactggtcattagagaaatgcaaatcaaaatcacagtgggataccatctcatgccagttagaatggtgatcattaaaaagtcaggaaagaacagatgctggagaggatgtggagaaataggaaggcttttacactgttagtgggagtgtaaattatttcaaccattgtagaagacagtatggcaatcccttaaggatctagaaccagaaataccatttgacccagcaatcccattactgggtatatacccaaaggattataaatcattctgctataaagacacatgcacacgtatgtttattgcagcactattcccaataacaaagacttggaaccaacccaaatgcccatcaatgatagactggataaagaaaatgtggcacatatacaccatggaatactgtgcagccataaaaaggatgagttcatgtcctttgcaggtacatggatgaagctggaaaccatcattctcagcaaagtaacacaggaacagaaaaccaaacaccatgtgttttcactcataagtgggagttgagcaatgagaacacgtggacacaaggaggggaacatcacacaccggggcctgtcagtgggtgggggactaggggagggatagcattaggagaaatacctaatgtagatgatggattgatgggtgcagcaaaccaccatggcatgtgtatacctgtgtaacaaacctgcatgttctgcacatgtatcccagaacttaaagtatagcagaaaagtttaatttgatgtattgtatataggatgaggtagaagttcatttttttccacatgtatgccatttatcagtgccatatactaaaaaaagtatccttttcccgttgattttaaatgcagctttcatgatgtattctatccttttctggtatatattttctgggctctttttttttaaccaatattttgtctattccagtagccatatcatgctatttggttatgatgtcttcgagactgttataatgtttggtgaaaaaagtactgtcagtactgttttcttttttgtaaacatttttgactttctattcattaattgaattttaaaatcatttgtcagtttacaatggttactggaaaacattgacgttgtaattctatttttcattgcttactttacatattttatatgatttaacacttttaaaaataaagatattatacctccattatgaaattaatttttacatgttttataatttatattgcttttgtaagtaggactttttaaaatatccactattatttgattattattgctattattgaaatgctgctgacttttttatatgtatatttgaatccagctactgtatttaattatctaactaactcaacttctttcttaaattggaaacaaagactgtcttttcttcacaatatttttacaaattatgtcatttttagagtcatttcattagatagaacttcaaaggcaatattgaaataagtatgataaagcagccttctttatttttttctttatgtgaatggaaatcatttcagtgttgtcctgtatttggtgtttgctgttggactttcataaatagtctttaagatgaatcttcctatccatatgttaagtagagttttattacagatggctactgaatattactaaatgccttttaggtgtttattaatacaattacatcatttttctcttcttatttgttagagaaggttatggtatcctagaatcagagagagaaaaagtcaagaaggaaagagtggcacctttatataaaaatataaagcctggcttatgccctggtgaaacattcagcaagggagataagactaaagtgtttatatcagcactcataggatataattcacatgaaattatgcagttaagagaggaagcacagatatgagtgaggtctggatttcacaggaaaggctttttgaaaaatcacaatccttaaagctggaacaagataggacaagcttattcatgacattatgaaagcagagaaaagattaaagaactgaaaattgcatatatgtggtggcgaaaaagttattcagcccctagaaatgaaaatactggtgactttaaatatatgaaaacaatacaaaagataatttgttcttcttcactagagatagacaagagaatgactaaagtactaagttaaacaaagaaaattatagcaatgtgaagtgttagtcactggaatcttttacctcccaacacagttttctgcaattttaaaaactttctcttctgcttgaaagcagggacaaggagacctttcttagaatcaagattcattgattttatgaagtatattcagaaaaaccagttctgctgcttagtgatctgtttactcctgaaatcctgaagtgtcccaaactgtagggaataagatcagaatgtgtagggtttttagaacctagaacaccatgaaattgcacaaactagggggaaaaggactgaacaggcacttttcaaagaagacatacatgcagccaaaaagcatatgaaaaaatgttcaacatcactaattattagagaaatgcaaatgaaagccacaatgagataccatctcacaagtcagaatggctattgttaaaaagacaaaaaataacaggtgctggtgaggttgctgagaaaagaggatacttacatactgcttgtgtttttgtaaattagttcagccactgtggaaagcagtttggcgattcctcaaagagctaaaaacagaattaccattcaacccagcaaccccattattgggtatatacccaaaggaatataaattgtcctaacataaagacacatgcatatgtatgttaatcgcagcactattcataatagcaaagacatagaatcagcctaaatgtccattaatgatagactggataaagaaaacatggtacatatacaccatggcatactatgcagccataaaaggaacgagatcgtatcctttgcagaaatacggatggagttggaggccattatctgttcctgcatttgcaggaacagaaaaccgaataccacatgttttcacctataagtgggagctaaacaatgagaaaacatggacacaaagaggcaaacaacagacacgggggccttctggaaagtggagggagggagaaggagtgaatcagaaaaaatatctgtcaggtactatgcttggtacctgggtggctaaataacctgtacagcaaaccctgtgacatgagtttacatgtatagcaaacctgcacgtgtacccctacacctaaagtaaaagttttttttaagtgcacaaactagaggcttcttttaaaagatggtggagtgtaaagccaatttatttgcactagcttcttttgaaacccaacaaaaacaacaaaaaagaaagaaaactcaagaaaaccatcagtttatttaccatgattcattatgcctgaattctttactctgatttatttctttgatgcttatccttgagtaggtttgtttgcttgttggtttgaaagacaagctcaagatatttcactgtttgaggttttttttgttattattttttttttttctgtttctacagcttcttttctggcctagttgaactacttttattgatcagaattggcatgttacaatctacatactaatccacatataatctttcgctccttgctcctagtttttcatcttccctggtgaactaccgattctttataattcagctcaaatattaataccacctactttgtgtaaactttcctgacttccccaggtagagctgactcttccctcttttgctacctttgtacctttaccatttctttatcttccacctgtaatgataggcttttactttgtttttttcttgtttgttatagaccaagttgggatcagtccctgctctacttacctcctccctgagaagcttctttcttcaatcaggggcaatcttaaacaggacattagcactagatacacacagacacagatacacacacagacatgcacgcgtgcgtgcgcgcacacacacacacacacgcacacacacaccccccaaataggttttcttgaagttttacagaaaattcctggggagacatggaagaggattaacatgatgcactccaaagcacagacttaataaaagtgcattggctacctctatttttccccaagcaaaatacctcatgtttttctttctcataatgtcatctcttccatatgctttctaaaatgtgcccttcctcattctaagcaggttagttgtcaccctcagcttgcataagccacccagcagagcaaaagcctctgttgtttctaaaacctgccctcttgggggcctcttccttccccttaggttgcttatcacagtctccagtatttgaaaattcatctctcttcttttggggagccagtaaatagcaacaggagattaagctgctaataataactaacatttatagttagcttattgtatgccaggcagcatactaagtactttctatattacattaaataagattatctttatatccctctacctgcaggtttgtctcctacggaagactgtaagcatttgcacagtgatgactatattatttttttctgtattcttaatacttagcaacatgcctggcacatagtaagcacttcataaatgcttgttggatgaatagtgtgtatgcattgatgtgatgtaattggtggtgagaagaatcagcctgttcacagtaactttagtcatagttctttttatatttgttttttgttttcacttcaccatggttgtcttccactattcatcatgtagtcagtacaagccctggttgtcactctgttagccatggatattttcagctcttatattctgacaactaattattccatgggaagtcttttaatcaggattctctttgtttatattgaaatgactaatatctttctcacacatctcatttcagcaatatgagttgatgctgtattttggatcatgtattttagaccaggtggccaggcagcagcactccccaccaatgcagacaggttaggttttcagtctgtgcttggtgcatctctagggggttaatgaagccttcccgtcgaagccgctgtgatgagaggacaggcaggactcctgctccctccccacctgctctgagttctaatccgagcagctcttcttctgtctggtttacatattcatcttttgggtgaaatggtgttaaatataatatatttgaaaacgattgggttaaaaaagctattctatttaaaatatcaagatggccatacataacacagatagataggtcctcaacattagcaggttgggtagtgtagtcaactgctgaaaataaatacagcacaacccaacaaaacacctttcccctcaaacactaacaaagtaaaataaaataaaagcaaaaccctgaaacccaagcagaaatgtaaagctgaagagacattttctagattggtcagtcacagcagtgtattcagaaggcagttcttcctccgggtttgagaggcctgtagccatgtatacagaaactatcttgggtaaggtgcctctactctgtcgggcttactatttaagatccttagtgggtgtcagaggcctttggcctgtactgcacaggtcttttcttgtttgtggaacgtcaaattcattttctctccaacaggccttttggtttcttaaaactctccggttcttgtccctgcacgtttttccctctcaatggcatttgactcaggttgccagtcattaatttccttgtatggaattaaggagatcttctggtccattctgtggctagaggcaataagagaacccatcctcatagatctagtctcaacatgaagcattagaatgtaaactcccaactctagaatataaataaggtcactgaggacagggatttctaactgttttattcatagatgtttccctacctcctagagcagtgtttagtaatctgtaggcactcagtaaatattgtttaaatgaatgaaggaaggaaataccggtctcacagtcacgccttttatacttttgagaatgaatttctcaactgtcttatccctcgatctgttattaactatgctaaaaatatttcctggctttgagtagcattgtagaaggtcctcttccattttccgattttcatagatgatcttccattaaaaaaagacgctggcatgtttctgctgtagaaaaaaggaagcaaagggatagttacaactccttctactcttctcccccagaaaaacctttcgaggcctcaccaatagatggcttgctttctcctccaatcaccagcagacagaggggccctggtgtactgctgtgttctccacaccaagggggaaatgaataatgtgtgagattcctctctggaatgttgagtgtctcaaccttccttctacaattatattttctgcttcacggtgatgacagcatcacctgtgggttcagaatcagagacctccagcttctgtccccattttggggtaatgtatgtgccacctttcttggattttatttaatcagtgagtctcctccccaggagattggggactcaactatctctaaacattttctcatcttttcttcacctagggttcctgggctcctgttgggcctcactggaagctcctagggttaaaccaaccttgggcattaatttcagtgtctgttctccacagtcacaaaaatatggacctctagttacacttcataaaatagcagagatcctacctagtccactgacagatgtcagcatagcatcctcttctagaaatttactagcttatgttttctgggtacccccaaattctatagcaagatctaattctcagtgcagatcttaacaccgtatctgagtattttgtgtctatatgagtttgcctattcataagagtccagcgaatggtattaaacatccccttttgtctcctgcaattgcccttagatccttcctgaggatatgccagtctagttatgagaggtgatccggacgttgttcatctagagttaatctggacattgttctagataaaacacacataaaaccatgaactctaaaatgtcctcagtcctttaaggatgatagaatgtgcttataggttatagctaggttgattatataatttattatttaaaacatgacaccttgaaagcaaaagggaacggtatttataattacattgcctcagaagtcataaaccaggacctgtagtcactctggttatggcagaaatcttgcattggaaaatctttccttcaacttatttcaccctacatggtgaaaattttttaaaactcttctttaaagtagtctttcaccttaaggattcactttttccgaaccaccaatgtcctttccgatataattatgtggtctaattcacccattccttcacattgttcatgttcttaaccactttctctatctttactagagttggctagggctctagagatgtcctaagctttttcttgaatagcagctgactggacaagtgaagactttcttttctaacttatcctaataaattggaatctcacttttgttttgtttcaacgccaaatgaggactagcagtggcaagataagggtggaacagaggaggaaaaggaaggacaggataaaggaaggaagcctaccacttacgtatacatcacacctgggatgctcatgctcttgtcccctgcctgcgttagccttggactcactgctcccttgagatgccactaagagggaaagggagagcatatttagaacactcaccccaccccaactttaccaccttcactgatgctcctcaagtccttaaccttctcgctagcttccccagcctccttcctggtcttgagcagcattcatgcggagtctcaaatcagagccccttgccctgcttcctcacttgcctcatactgtctctgtattgctttcctcttgcaagaactcgttcaccacactaggagaaaagcctagaagaaccctattcttattgctttatggatgagaatgtaaggggttaggaagagcccccattttcttatctttatgttgaaaacgcagggtgatatgtggtcttgacacatcaatttagaattccgaatttattttctcatcaaaacccctttataactggccatttggtttcaaaatactacaagtagtacccactggatatattagctatattggtgtttaaatagatgtttatattcttatctatcagtctaattaccatgtataatagtatttccatacaaaaatctgagcttagttcctcaagattgctcagataaaatttggggagattgtctatttataattaggtctatctcccttttttgctagttctcatttgaatacattcaattccaagctgttaaaagttagcaatgctaatgatagtgatgatcactaatgtttattaagcagccttcatgtagcaggtgctgcgttagttactatattgtcattataattcatatctcactgtgatgaaagtattatttccatattacagatgaggaaagtgaggcacagtgaagaagagtgaggggcttaagcttatgtaatgaataaatgataaagctaagattcatgcccaggcttgtcagactctgaaattggcatatttttacaatgccatgtggccacctgtgcctggccatattttaccatgtgttaccacgctggtgtgtctattttaggttaggagcaattttagagagaagcagtgccctaatctgcatcttcaatgccatttaggtatgttagttaggacagttggatgctaaagcacttaaagtaacttttaggtcatttgcattttccaacagtggtaaatgaagatatcaaataaatcatatattccctttgatttggagttgcttgctatgttctctcccttctgctggtttttcattcattgcagccaatagctattggattcatgttgttggctaaatctaccctttttctaatcatgcttcctgaaggttggagggggaaatatttgccataaaattgatttctaagggcagggcaatgagtaaggccgatatcggaatgttgatagaaaaaagcccttcttttgtcttgttggctgtaaaatatcttgcatggcccagagtacaatgaacttaaaatacaaggagagcgcagtgcaagtcaccatgatgactctgacatcagtattttccatatctcttttaacccaattgtgactttgtagaatgtaaattgcatagaaaatatattttttcatactgtctctaaatcctagtttcctttcttgtcatattcttttttttatttttcaattaaaataggatcctgttttcctttcttttcatagtctttttttatttctcaattaaaacaggatgggtaaaaaggacacaaattctgccattgcaaatgatctatcagttttgggggacatactgactcaatgaagatccagtgttgtctttcaaaatttcatttacattccgctcattcacacttttaattgttattcccttaaaaattaataaataaaaggagccatcttgtttacatatttctgcactttttttcttcatagacagaagtctttcaaatctgattcatatttcttttcagattgcactcttaagttcaactcttcacggacgtctataatattccttatctcagctagttctccagaatatgcttatgaaacagaaaaggttcccttgtccccctcacagggcatgtggtgggggtgtggctcacttcttcagtgtcctgctgctgaaacctctaggggagcatacaaactgacaggctgtggggctccaaacccacgacagtgtctaggggtgaacgctgagggccccagtgggctgaagccccagtgggcgtgtgttacagggtgcttttttagtttagccatttgtaggtggcttgtattagctcagttagactgtggtcttaattgcagagacaaagggctttctgtatcctgggactcttgccttggtgttgtacggatcatatgtggacttggagaatgagtgcaaggttttattgagtggaagtagctttcagcagatgggggagccagaagggagatggttttcccctagagttgggcctccgcttggcggactgggctctcctccaactgccccagccaaactccatgtcgttctgctggttggtggcctgctggcctgccgacgtctgtcagtttgttcttctcgacgtccagccacctgtgtgttctccgctgatgtgctcctctccatatccagttgcttctgtgtttgcctgctagggtctcgcaggttttcgtaggcacacgatgggggtgtggcagaccagggtggtcttgggaaatgcaacatttgggcagaaaatgcctgtcttcacctaggtccatacgggtggaaccctagccagggaccatgctctcctcctagcacttcccttcctgccttctgtatcatttaaagggaccactctcttcccttcccagcactcccatatcacttacaaccaacctctgattatataggcaaaaaaaaccatggttctagtgaacaacctgaaaaccacaaataaaagatgcatcaacgaattatactgacattataggaagatatgcaaatgtactatttctatggaatgaatactctggggacaatgtctcacgctgtgcattatggaatcatgaatttcagcagtttcatttttctgtgttttacattaaaatagcaaagaaagagtacatgtctagaaaactatttcttagtgacctgttagacacatgccagaatgtctaatgtttttcacatgtggttcacctgagcctgtaagatttgataatgcaccattctgaaataaatgagtgcctctaaatgtagtaacacttctcatgtccacttaaaggtcaattatttcaaccattatggtttaggaaaatgggctggttaaataagctgagtaaaataagcagcccagctcaccaagaaaggacctgatttgagagaaatgggactaggcttgcttttctcaagtccatcctcaatagccatcagtatcatataaactaaaatcttatataatcttattttaatctcaatataagataaaatctgacctttaataagccccactgtctacactttttttttttttttgagatggagtttcaccctcattgcccaggctggagagcaatggcatgatcttggctcactgcaacctctgcctcctgggttcaagtgattctcctgcctcagcctcccaagtagctgggattacaggcatgcgccaccacacctggctgattttgtgttgttgcttttttttttttagtagagacagggtttctgtttttttttttttcagtagagatggtttctccatgttggtcaggctggtctccaactccagacctctggtgatccacccgcctcggcctcccaaagtgctgggattacaggtgtgagccaccgtgcctggactgaagtctacactccttaacatggtgtacaaagttcctgatctcgccactgccagcttttatagcttttttgcttatcctctctgtctactacttttagccacctgaactgctaatatttccttccaatgtcctttgctttcttagccctatgtctttgttaggctgacttttctttttctccttgagatgtctttttttctttttgcgggggttgggggggcccaacatttctcgatctcatttgtggattattttcaggatcactgtgttgtccagaaaacggacatggaccattgattaggttgggttgggctgtcttctctaatccaacagtaatagaataaccaacacttacagagtaatgtgagaggctcttggtacatcctgtaggtgcaagttatctaatttgacccctctacccaccctatggaggaaggtatatgaggctgggtcttatgtaataataactagagcacggattaggtactggcttttcagtatcttttcctcccatgcctttatccctatatctgcatgtataactaggtccagaggtgggtaaaccttgatgagttcattcacttctcatattcagtgattgctcaggaaagggcacgagattgggttgtgatctagagggcactaggggagctattaggtaggttgcctttacctagaaagatgagatcgtctgtatgagagcattttgcacactgaaaaagccatcatgctagttttaggcttcaagtaacaagaaacccaaaagattaaacaacaagatttattatctcacatcacaagaagttcagagataaggcagttccaggattagttaattcattagttaataacaataaatatataattaagaacccaggtctcttttcatctttctgccctgccacacttagtgtattggcttttgtcttcagggttttcacctcgtgtttttgatatggctaccacgactcctagactacctcattacacagcatttacaggccaggataggctcctcttcatgtcattatatgacaataattttcatgtcctttttaaagcataaaataaaaattcccacacacctccaataaaactttctgttctgtcccataagctagaactgcatctcttgcccattcctgagcagtcagtgaaaatggaagtgaaatgacatgattgccaagactgatcaaggtttattccctagaaggattgagtttcccagaggcacatagtcattcaatgtttgaatgaaattgggattttggtaaaagaagaaggggctaggtcatgtctttttattaactagtggtacctgccacagcactatacaaatatgagctctcatttttaatattagtatatcaatgtttaatatatggcagtggtttcagaaagattcatttttgagataatttttaagcaaagagggtaatagtgttttctttcccatgttttaggttgggttgcctcagaagcagaacctaaaacaatgatttgagtgcgactagtttatttggaaggtagaggcggaggggaagtgatacaaggatatagggaagagaatggattatcactgggtgaccgaagctcattgccataggggcactctgagaaatggtacagaattacatgcagagttatccctcagaaggaggaagggagctggggtaattgtaccccagcttttgccagttatctgttgagaaactcagggaagtgtgttaatgtccccagggcccttgtgatatggtgttttgcagcttgtggggaagctttcaggcaaagacatacagatattggaagctaaaagtcccagggaactgataaggctcaggggatgtgagaccaacaacaactgccacattcctttatgtccataacacaaaataaagagcagaaatgtcacagagcctgcaaagggatggagatttgtttcgtcaagaagggaaagaagcactttcatattttttatttagctctcaaatggggtactttctaaagctgtgtgatttatgtatgtattatagccagttgtttccctgcacactgcttacattcatgttatattctggcagaaaaaatctgattttaattgctctaaaaatacatgttcttatctgcaggatttgtattgaggcttactgagagcagcttaaaggtcaaaaccttatatttaaactattagctctaattgttagcggagtacattttaatgttacagagttggttaaactgctggtatccttccaccttccaagatgattaagagcgcggaaaaataatttatcttaaatttttaagtgtgtgtttaattttctcatttatggcatacgtaacagaatggcaattaattattaagtctaaagaaagagaatcattgttcaaaatcagtacactatgcttcatttaactcctataaatatcacattctagagacataaacttgcgcagtcagtagcaaaaggtggttgttaataatctgttagtcactgtgtacactcaattggccaagcattttctccacttattcttttgttattttctcttttattgtcccaagaatacaaagcaattagccaaaattatatgacaatctctggaaattattttattttccatttgtggtttggggacagggaaggtaggaggaggagggatggaaagaacttgtcaaaaattgaggcaggtgtagtagattgaaatagtaggatctcaaaacatgtccatatcctaacctctggaacctgtgaatgtgaccttatttggagaaatggtctctgcggatacaattaaggatctcaagaggaaataatcctggattcagggtgggcttaaagtcagatgtacatttgaaacacagggatacacagggaaggtcagagggatactggagacacagtatcccagaggacaagagcttgtgaagatggtcacagagattggagtcatgtggtcccaagcaaagggatgcctggagtgaccagaagctggaattagcaaggaagattcttccctgtaccttctgaggtagtacagccctactgacacattgattttggacctctggcctccagagatgtgacagaataaatttatgttgtttcaagtcaccagttgtgtggtaatttgttacagaaacccaagaaaacttatatagcaggtattttattagtggtagtaatgataatggaggtaacgttttgcctataattttatagtttaccagatgttctcatctatgattatcagagtcaaatggtaagctgaatgatacatagaaattaaatgtcctgccccagctatagccataagcagtccagtatctcagacacagagccactagcccacaagaagctacctccgggaagggaaggttgaggagcttcctcaagcctctaaggagtaacaaatcctggtggaaagttttttctccccaccccatattttctaaagccagccttataaaagctgtgcttccattttctcattaaacgttcctctcagccagcactcgacgttcactgtgtggacacattccaatgagttttgtttttttctttaccatatggtgatttcaatttgtactcactgtagattcattcatttctttattaaatgcacatttacttcatacttcccaaaggcctaacctgtgcttatgctgaaggacaatagcagtataatgattttagtacccatgtttcttagaaacgtagccttcacattttgtgcacaaaacaatcctgtataactaatcttttttttttttttttttgagatggagtcttgctctgtcacccaggctggagtgcaatggcgcaatctcggctcactgcaacctccgcctcccgggttcagccattctcctgcctcagcctcccaagtagctgggactacaggcgcccgccaccatgcccggctaattttttttttttttttatttagtagagacggggtttcaccgtgttagccaggatggtctcgaactcctgacctcgtgatccgcacgtctcagcctcccaaagtgctgggattacaggcttgagccacaactaatcatttttaacaaaaaaatttaaggacaagatttgtgcagtattaagagccattacttattactgtgtgactgagatcatttatagtcattcaatgtttgagcaggttagttttcattagcagtttctcccccctcttggttaagagagtgaatgtttcagatgtggtgacttggttgcctgttgttcaaatatacgctactggcagtttctcaaaatgtcaatcacttcatctctgctttaatttactacatatattgctcagagtgctgaattaatgatgtgaacttgaagtttcaggtcttcaagtaatccctgggtgatgcatcgggattaggcctttgtagtagaaattatggacatgcgtgctgagctttttgtgtcttgctattttttcagccttgtatgaagggccaaaagatgtgaagccttattaaacccagtttatgggaatctgttgttttggactgagctcctgcaactaggcccataccagaccaaaccagaatggagtcactcttgctgggtgccatgtaataaccaaactgaatgaccagttttccaaaaaacaggagatttcacagcaaccaatcagaaagggctcagtctacctaaagcctggaggataaggaaattctgtctactttaaccttataaggaaagtaactttgaaatgaccaatctgcttttcgttctttatttcttgatccttatttctgctttctttagcaatttctgtctataaagtcaacacctgctgctcggctcatgggagtttctcctgttttgtagacaggatgctgctcaattctgaatcgctaacaaaagccagttctatctttaaacctcagttagtgaaaattttgttttttgacaagctataagaagcacatagccacatgacttatgattatacatttttagattatttcttaactattaagattctcaaaaatgtttaggaaaataaatgacctctaggtttaggtttatggtggactaagtggtgaaccatttgatcttgaaaaaagaaaaagaggatgaaaagtaacaaagttgcactcatccctgatttctaaacatctggtcatattaaaagattctcatgtattccagaacttaaagtataattaaaaaacaagtttctcttttttaacttttaatcctaaatagtatgtagttttaaattctcatatactattgtatacctcttttactacaatcatcactttctttgcaaatattttcattggaatcactagtaaagccatatattgccttattcacagtccaggtaaagaatttgagagccttcttacctgtgtttggacattcattttttggatatactttaatgtgtccacatggatatacttttggatacgctttaatgtgtccacatggtaacttgaagcaatagcaactatgtttaacttatcaaattttccataaaccaatttgatggtcaatccctgtaatatttagttcttcttctgcacaagatatgttcttgttacaagtctttctacttattaaaaaaaataccagttaaaagagaaggacatttaggctctatcttttaaaacctaaattattaattacacgtatgtttcttgaggatggtgtggagatccagctgtgaaagcctaaaacacaggaagggccacaccgtcagattcgagcgttgctttatctggaagggtaatttcattttcctcagtgtgagtggtgaacaaagaggaactaaaggtagagaccagatggagaactgggtcacttttctgggtcttgttgtatttggatttttattctttgactcaagttttgtttcagatgtggtgaactttaagaaaggaggatatgctgacgttcaaatataaatatgtattatgttcttacttttatccatgcttctgttttcctccactggtataaaaattgccttaaatatagaaaagaaatttttttctacttaataatgtatgttatgtataattgggatcaatgaataatctcgttgatcaagagtgtcttcaaatacagatgtattttagaagggaatggagattgctttatgtttagcatttcaatgtgtagcatttcaattgagcatctactttggatcagatcctcagagtctaaaaatagttttaaaataatttcttcattttcaaggggcttaacattaattgatggggagtaggggaaggatagtttttgaacagaaaaataaaagacagttactaaagagaactatgaaatatattgttgtccttggagacagagtctaaaaatagttttaaaataatttcttcattttcaaggggcttaacattaattgatggggagtaggggaaggatagtttttgaacagaaaaataaaagacagttactaaagagaactatgaaatatattgttgtccttggagacagaattagggacaatagatgaaagaggcaaggagagaggttctgacttattaccagaataagcttgataatgatccaagcataaaaaacgatagaatgactctgtctattgggagctgatgagtactttctagttagaaatatttatgcagaaaatgaatgattttatctgagtactactacttggtttagaggattgaaggaactgccaagattcctttagaatttgagattgtatttttgaattagttaggcatctttataggagttatcttggctgggcgcagtggctcacgcctgtaatcccagcactttgggaggctgaggcgggcggatcacctgagatcaggagttcaagaccagcctggccaacatggtgaaaccccatctctactaaaaatacaaaaaattagctgggcgtagtggcgggcacttgtaatcccagctactccgaaggctgaggcaggagaactgcttgaatccaggaggcagaggttgcagtgagccgagatggcgccattgtactccagcctgtgcaacaagagtgaaactccgtctcaaaaaaaaaaaaaaaaaaaaaaaagagttatccttttctccttgaagtcttgccaaggacttgggtgggcactgtgttggttaggtagctaggaagctgtggttgattaactgttaaagtcttgagtatatagtgaagaagaagaaacagggcagaattaattatgcattaaggcctcccagtatcttccgttagctgctgtgattttaccaggaccctcactttccttcactttccttggattagatggtcaggtggcactgaagtgacttgtaccaacaggcttaagcatgagaactaacctgatcatattatatcctaagaaggtattctagaattgaatttgtagaagatttcactagttcttcaagtatatatttttagattcaagtattaaagttagcactaatgtaattcactttgtttatggagaattgtttacttattagaatctataaaatagttttgatctaatggaaacaggcctgttggttataggagggaaatgtatcatggtttgacaaaaaaataaaaaataaaggagctggggcatgacagctcttagaagtaaaatcatttgaactatttgtcattgggagaaattacctacagtatcaaagagttgtcacaaagaactttcccctgatacccaacaacatatatgtgtatatatatatgcacaacgttgacttccagtgatctccatttaatataaaataattatctgtgacaattattctttaaaaatgcattctccattaacataagtggaatttcgactagccaacactttgaacttttatgtctcaagtggaggagtttactgggtacagaaaaatgaaggaaaatccatagcctgaatagaagagaaatgagcttagttttatattatactttaggaagaataaagaataatatatgagagttggaggtgtagagaacatatgtgaaatagttggcaattatttattttattccctttgaggacagttcatctttatacataagtattaacatggttaaatgcaaggaatctttaggagcaaaatgataataagaggttatttttatctttgaacaaaatctaacctaactgggctgaaacccaataggtaacattggtgtgtgtgtgtgtgtgtgtgtgtgtgtgtgtgtgtgcatgcatgtgtgcctgcatttatgtgtgcatgtatacattaagtcacattttttatatttgtttcacttttgattgaaggcagatattgttggagaacagatctatttgtgaaaccttattgggaacatccaaattggcaaaatgacttggtgcccatctgcagtaaattaagatgtacatctgactaggttggggcttcatgccagtgcctgtctcaacatgttcagtttttaactgaattctgtcaaaattccgagtcagataataattaatgccacagacatttaatgcatctttattatgcaagtgcctgtctttgtgactgtagatttagtcagaaagggtcagggtggcttcctggccatgatattagcctagagctctccctactccctccaacccccttccttctgttttctgttcactctcattctaccctgggattgatcactgggatagtggttggaaaatgttacttcattggtgaagaaagctcatatgagatctatgttgtttgaaagcattatatggtgtcctagttaggattcttccaaaagcaaaacctgacacagtgactcagatatgatagtttatttgataggtagttccaggaaacaagaatgagggagagtgaggcagctttaaaaaaaggattttaatgagcagattaaggataagggtaactaggactaagtcctgctatagatcttgtataaaatagcctcagaattgtctacacctagggacagggaagttgagtatttgttcacttaccccattcttcattgttggtgttttctcttgggggtgtttaatctctggcactttcagcctgccctaaacatggactgagcaggtggagaggcagaaagacacaagtgctttaagttggggagctgttggtgtgtataggaaccagatagcttcaggtgaactcagaggtgggctaagaggacgtgaagcagggcatcaccaatgtaagttccatgcggtttctattgaaaaggagcttcagggctctattaatgtatagaatgtctacttctgttttctccagctcatctacttgtctcaaaccaactaaatgaccaaaaggaaaagttggaaatggcaccagtggttcatcctgctcattttccagcatagtccgaaggtagacaattctcatactttgcccattttagacagtcttcctcaggatacagatggcaggaaggaaacaggaacctctcagaaatccgatgcagctccttactagatctctattttcaccttctttgcctcttctcaaatgtggatctcaaaataccatctgcttaattgacctaatagcaattgtagtggtagtgctatttgctatcttttctcgagtgcttaccatgttcccaccattattttagcactgttctgtataaataatcagaacaatcccatgaaggggatactataatataatgatcccattttaaaacatgaaaagaaactgaggtagagaacgattacctgtccaaggtctcaaccgtgggagggggtggagcatatgacctgagtaagctgtctagagtctctcgtacactgaaaccaatgcacccttttctcagggctaaacccagctcttggccccagggcaggactagaatatccctggtcctcatgccagaaggcttgtgaatcaaaggctggagcaatggaggagagatggcaacttattgtcacaagccttccctctgttacacttcctctcttcagtccattctccatgcatcatctgaaatgatatttaaaatgcagaaatcagatcacaatacacccctgcctaacactctctaatgagtcctactgcacttagagcaaaatccacaatttgctcagctactatgagcctgctcttgcctgtcttctagtcttcacctcccacctctctacgcatgactctctcagctctaaccacaccggccttctttctattccaggcgcataaggaactgatacccacctcaggacatgactatgtcccactcactccttcgtacattgtcatctcactgtcctcttgttatccttcagatgtcagctcagatgctgcctcctcagacaggcttctgctgaccgcccccctctcttactctaggcatcttattaccctcttctgttttctgtatagcatgtatcccattctgaaaaagtacctcatttattttcgagcctacatgtttattatctctttccgtgctccccacaacccagtctccaaatgtaagctccgtgagagtcaggactttgtgtgttctgtttcgctggtgtgtccctagtgcctagaacttcctggcacataatgagcattcagtaaacatttcacatatgactggctaactgctgagtaaggaaatgagtgaatgaatgaacaatggattaaaaatgtagatactttatcttagacaaaatttggcaacagtagaaatcaagacctttctctgtccagcttatgtgactctgttcaaaattatctcaattgtgtacaatattttgagctacaaacatttttctcctcaaaatctcatttttttcttttatttaggggaaggaaaaggcatagcagttgtttcctgaagcagttgttcccacatacacaagttgacacctcttttagcttttctgaccaagtttcaataatcatacacagaattttagaaataccttcttctggccatcctcccttgactcctgcttttccagtgggagatggagctgggaggtggtggtagaagaagggagagtgttgggggagtgagggaaggacctgtgtgaaaaggattggatttgaccatttagggaagggggacaatatgaaggccctgaaaaccagctattaatgatggggctcatttctgcacaggtaaatatatcagcactcatgccactaagatattttataaaaatgcttcctgaaacaaagtagttacttctaagtttccctagggaataacttttttaaaaattaaaaagatgcattcaacgtatgtgccataaatcctctatttttgataagcactgataactcaaagataatgctgctaatgtatagacaatttactttgttttcttcagagaaattgagaacttaggtcttgctttgtacacaaatacagaggtaacaaattctgataaagatgtgaatcatatttttttccactggttagtagagaggtagattgggaggaaagcattagatgtaatggcagctgtggcccgttcctggatgctaagcaaatctgtttcacatgtgaacatgttgggatcttttacattttgagaccgttttgcccttcttttaaaggtccttatagtctcataactcacagagaattatggtttagtttcagttaccagtaatattgtaaatatattcacatacatttttaaagacattatggcaatgtccttaattaataacatagccatcattttataaagagtcccaatttattaaaaataaaaccctaaaaccaaaaatgatgggataacatctttatgttgcccttgtttgcattcaggatgtttccaagtttatcatgtctgtgacctcagttacgtttacttccccagatggttttttaccacatgagcaattaatataattggagactatgaagtgtttatgtcaaggcaagaagcagtagcagcttcaatgtggtgactttgcaggcagtcaaacatatttcactgtgtgcttccaacctaacccttcccctgcccttccccttctatttttatattaaacagaaaaagagagttcacaaaggtgctcagaaactggcagtttctttcagaatgtggtatatttctaatttccatatatttccttcaagtggaatggccctgggagcacaattaccttcaatcttgacaggtataaaaaggccaatcctgccagtctctgattgaaatgttagatcaacttttctgaatctggcatgatgggtgacaaaagacagggatgttgctgggtcaggtgaagatgttgccataatcccttttacctattttgagcttctgagcaagaaaatcctatatcaaggtacattagcaccacctgctatcagcacccttagagaggctggcaacagagaggttctttaacttttataaccgtgctctacattaggagaggctcaaggaaagaaaaatcaggcataatctctgaagactttataatgagctcatgttctcattcttcatatagattccatttttctgtatgaaaatggtctgccaactgtccataattagccccatcttacttcacctggcaatatctagtgcttatgaattctgttggtagggaatatctttatgtggtgaatgcattctgcaaaaagtatacatcaaaaattgtaaatcatattacatcttaattacagaattgattcctctgaataataagcttataataaagccttgctagggtggtttcatatccttaaatccaaaatattgtgtttgttctttcactatcaatttgtatagactttatgtgacaataggtactctgaaaggggagcacacatatattaatttgcatttgatgacatactttttagaggtgcatttaaggtcttcccatttggtctggcaagttctgtctgcatggatctctcatccccaggatatttttagtgctccctctctgtttcttcctcttatctcccttcagagtccatcttgtcggggaagtcttctccgaccatctcatataaacctcccacccataccatgctttacttttctcctattacttataattacaaggcatattatgaacttattttctatcttccctgaactaaactctataaaactgggttttttctttaacttactgttgtatcttcagacctaggacagtgcctagcacatgtacacacagcacacatcacacacacacacacacactatataatgaatgcatggatatgtgaacaaaatgatgtgcttgagagggaatggtgtctataaaaccgccggtattatcagattcattttgtgtggttatgtttcctgaggagaaagagacgtattactgtttacttttggtttttatgtttatctgttataatagcatatggtatatctggtatatctaactgctcaagtcttaaatgtcttaaaaatattgattaatagatcctttaaataatatgattctaagactcatctgttctgatcatcataatactacaggggaaccacaagtcatcaaatggcatgaaactcaaaactacagaatgtaatctgggagacttataggcccaattttaataaaccacataatgtttttaaaatgtataatttcattgttaacatttgagaaattcagtatattgcacataaatatctggattcccagcctttcttgaatagcctgaacgtctgctgacgcgagacacctatgcctgcatggcatcagttagctggagctgaatgtgggtgtgttgaccgcagtcgccatcacacccttttgtctttccctcaccgcactcctatgtatattttgccaatatggcactgtcagtgtttggtgtggtatccctgctgtaaatcaagctaatccataggcatcacttcatgtgctgctctttatttatttactgaaatggagttgaaaatatttgttgaggttaaggaaaaactatgttctttgttgcactttaaacattctaaatattttggattagagaaaagaaaagggagcttatactaagtttttattttcctgaaaataatccataacttaatgttctatgtactgaaggagtttgggtgttcacaaatacacatatttatcaaaattcaatgaatgaatacttaacatttgtgcatttcattgtatgtaaatgtaatataaagtggaagcaaatgttgaactataattaatcatatgcatgcaaaagtatttaaggagaatttttctgtgtctgaaaatctctttgaaatgtaccaaaatcagatggattaaacaatggattgaaggatggttagattaatagatatgtgataaaagaagcacaatagaatagtcatgggagaatccaggtagtgggtacatcggattttactctacagttctttcaactttgctgcataattgaaaattttataataggatatagggtaaaataatctgcaattaaatatgacaattttcatactgttcctgctttctggaaagtttttttctaaactaaatgtacaattttacataatgaattaatgaaatggtaaattattataattttcagattctgctgtaggtttaattttaaaataatcttttattttaaaacaaccaattatgatttggagatgtaattatgggatttttaaatttttctgtattgtcccttttgtaccttattttcttcctctgtcctatacaatgatcaccccttattctcaaggcatacattccaagacccctagtggatgccagaaaccacagatagcaccaaaccctatatgtattatgttttcctatctgatgatgtaagtgactaatggactggtagtgtatacagagtggacatgctggacaaagtgatgattcaaatcccaggcaggacagaacagaacagcatgaaatttataactagttggcacaacatgcaatttataactatattttcacacaaccactctatctcaaataatattccctggtctctttaagttttacatcttttaagctcctatatgtagtttatgaattaattttaactggttattgttttactctacactttttaaggtgaagccatttaggattttaatgttttaatcatacatagtttttaaaataattggcatattgatataatgaaaagttctgtttttctctcatggactatttcttccatacatttagaaacttctattttacagttataaataggaggttgtagaactattaaaagtaacttaattgtaaatgcagatgctcctcaacttgcaatagggttatatcctgataatcataagttgaaaatatcattaagtcaaaaattttaagatagtattatatcaaaacaccacttacgttacaatatcagatgtctttgaagcacaagtccttctctctgtagataatacttagggaagatcatggatttcatttctcctcgttttctaacatttctctttcctatcagtctcctttgcatccagatgaagtcttatcaaaaagaatttccctcaaacttgtccatatcattacaatttagtagaccccaagtcagtcaattcaactaatattcactaaatgtctatttggctggcttcttcctgggaatctggacacaaataagacattatccctgctctaaaggaagtctcctgctcctataaaaggctaatgtggcaaaaagcagacactgacaaacattaagtggaggaatgttccatgttgatatactatccactttctgatgactcttttcgaaactattgttaggttgataaatatattcttggatatttattattaagtagctgaaataaaaatgattccttcttttttttttttttagaaaatagggtagggctcagcatgtgaattttgtttttaaatcattttaattttactttttatgggtggcagcatagtatggtagaatgagcaaaatgagtttaaaatcagacagattctgtcttctaatcttattaattcagtgatctagatctcagcaacttatttaaatctcccatgtctctcttttttcggctataaggcatgggtaatatagctatatgtgtgagaattaaaattttagtagaataatgagtaaaagtttcgagtccatatggtaggaacccagtaagtagtgagcactcttattattgttgcaatgatgatgatggtgataatgatgatgatttccatttgagttgcttgagaatcacaccctgagacaaagattctcctataagtaatttatgtgagaggtaatctcaaggaacactgataggggagtgaaaaagtagggcagagaaggaaaaaagccaataaggaaggcaactggagcttaatgatgctgtggcattctgagagtcaagtgtacagaatttcccactagagataagggagctggagtatttatccgtcaactcctggcagtcattagttgagggctactctgtgggggtattaattccttggcatttacagccttccacttgcataggcagagtggtgtttggcaggcagagaagctttcaggcaatgaaatacaagtgctaacagttggaagtcagctcggcctgcctgaaatggtaagagctgagggcatatgggtggagcactaatagtatctgtccagatgatgatgatgacgatgagaccacttgatgaagatgggaacactatattcactctctgagagatgaaatgtaagtgtagctgattaaatgtagggagaagcctgtctaggaaaaaagacactgtggtctctgcccactcatacacacaatttaccctacaggtttgagattattcttgcccaggccaatgaatcattttattgggcacagagttctatgcaggtatcctgtctggtacctgggtgggttttgggtattgttggctgctccttggatctgggagtccagttttcattcctctgaactcacttcctaaagctgtgtgcatttagctagcagccttggtctcaggtgatctagtcattacagcctacaggatcagattcagctgtaacccaaaggtcatgagcagaaggaacagctccaccagtcccttgcattgtttgaggagattttttaccatcttccagtttaattatgagatgtggcttctgggcaagaaagcaagtgagatctactttctgcattttgttttgttgataattgaatcatagtaattaagtaatcatgccgggtgtaagcaataacttttatgaacattaagatagtgcatttcataacatctaaatgctttgtttgttaaagttcacttttgagaaattgcaatcagtgttgggaaaacactattaatttgaaggtgtggaagagagagataaggtacctcatttagaattgtatatgtcaggtaactattatctctgggaagcagtgaaggtgtcttatttaataaatctcagaatctatacaagccataaaccagtatttacatatatgggtatagagatatctgtatacatgtgcacatatattattttagccatgttctagacacttaacaaagatgggattgcattgactggccgcttgtagtgtaaaagagaaaatgtaaactgtaatcagtgtttcatttaaatttataaatgcactgtattttttattttgatgaatgggaacaaattattaaggtaataatacattagctataactatgtttaaataagtccagggaatcaggtctccctattaattttcaaagtgtaagatgctatccatccacattgtagatattaggaactgttgaaactctatgtaaatatagtaaaaatttgttgcaaatggaaatatgaagtaattgctagaactttttttttgtattgatagcattaagtattaaggctagctgttgcagtagctataacctagttatagcaatatgcatgtggttgactggtatgtgctttgccacaaaatagaagaaagaatcctccaggagaaatattttgcaaatctgcttttcaacagtaattagaagatgggtgatattttgctactgttcataagtgtttctcttaatattttgactggttcaaaggaaagaagggccaatatccatcatatattgttagggaacatgttttaggattgcagagtgagaaaatagagactacatcttgctatccacattttccacttttctctcagacagatcctgattgtcatccctgtttagcctcctgcctttttactcaactcttccccctacctggatggcttttccttcttttgatcccaactttcccttcctttgatctcagctaaactccttcagttagcctacacttccatcttttattctctcaacttttcttttccatagggtcataattatactgcacataacttgggtatcctctaatcattacaaataatagccattgttcctagcaaaaatgtgtgtttatggcagcaattacattttatgtatctttggttagtccctgcacagtgttagcttatagtaggtgctcacccaatatctgtattttctcttttttttttcaagatctaaatacaattatatttttaaacgttgggtccaggctttacataaaaatatcatcctactttgccccctaagtttctaaaatatcacgtacttttcccccaacatctgcagccatccagaaatttgttggaaacttttttgcattattttaattcctaatccctgcctctttgggctcagtgacaaacaatcaaaaccaccaaaaatgtggttcactcgaagtcagatgagagagcctggctcaattaatcttataggatgtaagcagtgctgcatcaactggctccatgcaggagggacacgtgaaggatctcatcaaccagttatctatataatcctcatgataaatgtgcatgcatggcagaaactgaatcaggtccccataaacaaagtccatcatacagatcacatactcccagatctttgtttctgatctgatctatctcttccagggtcataaatcccttcaggcagatgttgtataaggcttattctttgagctgttgtattttgcttcagtcaactgagctgcaaatcgagtctggctaggtgttggatggtagagcaaaactggaactttttcctgatgtgacagcagtggctcctgatctggctgtctcctcgccagagctagcctggtgggactgagatacgtgaagcagagagatgtcatccgaggagtggaattatcagactgcactgtaattgcttgttgaatcagttatctgttattgcttaacaaaccactccaaaacttggtggcttaaaacaacttactatttcccatgatcctgtagcttggttgggctcagctgggagattctcctcgattgtgtacctgaggtcactcatacagttgcattcagctgagaacttaagaggggctggaatttccaaaatggcttctctttttccagcgtctcctctgtatggctctaatcatcctgcagtctcgtgtggacttggcatcaccatgctgggctccaagatgggggagtgaaagtaccagtcctcctgagggatagagtagtaatcccagatattacttccactgcatttggttgctcaaagcaaatcaaaaggccaactcagaattaaagtgatggtaaaatagactacacctcttgataagaggagaggcaaagccacgtcgcaaaggggcttgtgtaaaaaattggaggaattattggggccatatttggagacttggccccttcacattttgtatctgactttctcataagacttttatttcttcagagcaagggctatgccttcttcacgttttcagaatcagagtatgaaaaatatttgctgtttcttgagtaaatgattactccatgatagttttccctctaccccaactgccaattataaactcagatttacattcagaatactggtgtgaagcatttctactatatctttttttttcaatcattttcaccttttgcatttatcttataaatctaacactataaaatacattatctggccgggcgcggtggctcacgcctgtaatcccagcactttgggaggctgaggcgggcggatcacgaggtcaggagatcgagaccatcccggctaaaacggtgaaaccccgtctctactaaaaatacaaaaaattagccgggcgtagtggcgggcgcctgttgtcccagctacttgggaggctgaggcgggagaatggcgtgaacccgggaggcggagcttgcagtgagccgagatcccgccactgcactccagcctgggcgacagagtgagactccgtctcaaaaaaaaaaaaaaaaaaaaaatacattatcttagttttttttttttagattagaatgctggcaattcactgggaagtgatccctggaagtattaaatgaacagaggagtgggagaagtaaaaaagggaatggatgaggctaaaaaaagggtgacaagcaaattaacctggagcaactggggttgtttctactggggaactctgcacgtgcctcggagctatcccacctgaagggtgagagcactggaggacatgaatttcccagaagttatggtgctccatgattacaggcaaagcaagcccactctagtggccagagagagccctcaggcaaagagacacatgttctagaagtcataccaacagcactgaatggtccaagtcatggagatctgggcagtgcaccagcaatgactgccatgcacaccattctcgtctgagacattatcagagaacaaaccacactcaatttattggtggtatcaagtatctaatgagtttataggctgggctagaatctatatttggggggagaggaggaattacttaagaaggtagtttcttcatatgttctttgacccctttaactgttaatatcatattgtcctaacaaaataatgaaatagaaaaaagtagacctaagaataaatactgtatatactagttttcttttaaattaaaattattaatgtgttttgtaaactgttcttatcacctgttttatatgtaaataagtaatatttttacatcaagcatttttaattgtttattgccttgctgtaaaattgattgttatgattattttagtaatttttatgtgatttcttttaaatcacatagggataattatgcttggcagattacttctacttttttttttcagatgttttcaaggcagagtcagaattaataaattttagccctctgcccaatccatgataagaaggtaagatttagtcattgattcactcagcatttaccaggtatttatcttatgtcagtcactgtgctaggtgctagagatgcaaaaaggaatacaatgtgatctttgcccttgaaaaactcaaatcttagagtcattcaaatatcactgtggtgaaatctcttaatttatcaccattgttagtaatgcatagtattactgacacattgataaccattttcatatcaatcacacctttttataaccataaccattttcatatgaattacaccttttttttttttttaagatggagtcttgctctgtcacccaggctggagtgcagtggtgccatcttggctcactgcaacctccacctcccaggttcaagcaattcttctgcctcctgagtagctgggattacaggcgggtgccaccatgtccagctaatttttgtatttttagtatagacggggtttcaccatgttggccagtctggtctggaactcctgacctcaggtgatccgcctgcctcggcttcccaaagtgttgggattacaggtgtgagccactgcacccagcccaattacacctttaagcccatgtagtcaatcattcagctccacctctaatttaatggccttcctttccctgtcccttccttcccttccctgtctcttccttcactttccttcccttctctttctgctatagactgaatgtttgtgtccctctgaaaatttttatgttgaaatcctaataccctatgtgattgtattaggaggtggggcctttggaagataattaggtcatttggagacctccctccctcttcagccatgcgaggtcacagtgagaagagaagacataagtctgtgaaccagaaagcagtctctcaccagacaccaaatctgccagtgccttgaacttagacgttcctaccaccagaactgtgagaaataaatttccccctcctactaaatagttttagctaaaaggagtaccaagaaaagccctgtctcctatttggaaagaaacataagggctttggactctaaattcacaaaagcagcatttatagtttacatctattgttgcacatcattgtaactccagtgcctggaaaagtatctgatcatagtcagtattcaatggccttaggtggaaactgaaagcaaggaggcatagtagagtgtgattagaggtgttgactggagatttgcatgttttatcagtagcagtttttttttttttttgaggcctaatgatgctctgcttcctcatgaatttcattccaaatgaagacagtaactaattgcattattttttgaactgcttatatttgctgttaccctttcttttatgcagaagatattcaagttggagagggaaattatgatttttttttcctttttcaatgaatgtaactgttaataggtttggatgagtaacttctgtgatataaggtctccgtacaagcagttatcatgctctgtcagtctttctatgcaattttatcatgtagattgttttgggaaacatgaaaattaagatttaatttgtcctaggaattggatccaaaatgtaatggaattggttccttaatgcagtgcatagttgtagagtatagtgtaaattaaatcaacttgtgcttcaataatctctttattagttttcaaatattgatttaaataatgatattaaattgtgtatagttgaaaagatggcattgctttcactgcaatagatgaatgtcatgaaaatgttcttctcttgtaatggaatcagatgtagaacatgataaagaacagttctcttcacacctcataatttctgacatagtaagttatgttgaggaaaataggcacattatattgacaatatatttttgtttacaaatatgccaggtggcctggtgtacagattgattgagggtgatcactactgcccatcacaactattaccttttgcaaagatggccgaagtggaagggaaaacttccctgcacaacttttgtggtggattactgttgagatatagctatgcattggatgttttggaaaaggaatatataagaatagacctttgtatttattgaggaaaattaaaattataaaagataaaaaggcaacttaatattctctcatttaaattttaattaactttcaattttgaatggtgttttcctgagctgttatccagtttctgctctaaagttggctgtaattttataacattcttttgatgactgtatgtgcatgaatatgtctgtagttattttgaaggtaaaactctacttatttcacttttttgagtgaagtattaaattgttttcaagatagcagtgactgaatattgcacttaatacaaatgtttaatttctttaatcctttttacagataaaagtatatgctttttatccttttccttaaaatgacaaaggcttctcctcagggagatcagaaagcataatgactggcatgctgaacctggtatctgaacatttgttttttattctttatttcatgtgaccttggaataattcagtggctcctagattttctcaaaaatgactcaatttttcattcatttcatttaaatgaccctttgagttatctcgtatgctacctgtttttatctttataatacagtaaaatttaaactattcatatctctatgtgggggtgggggtgggggcagataagggtcatagagaaggcacctctttctcagaaaagtagcaaatgaccaccctccatcccaaaatagatttagctacaagaagagtaaagtgcacatggaagaacaaaaaagccttttggtgtacaaggatttcagactttgttgggcttcagcatcagtagagagtcttattaaaaacactgtcatacatcacttaaagacaaggatatgttctgaaaaaaacagatcattaggcaattatgttgttgtgtgaacatcatagagtgaaccgacaaaagcctagatgggatagcctactatgtacctaggctatatggtatagcctgctgctcctaggctacaaacttgtacagcatgttactgtagtgaatactgtaggcaattgtaacaaaatggtaagtattgtgtgtctaagcatatctaaacatagaaaaggtacagtaaaaatttgacacaaaagattaagaaatggtaattgtgtatagggcacttaccatgaatggagcttgcaggactgaaagttgctttggatgagtcagtgagttagtggtgagtgaatgtgaaggactaggacattgctgtatactactgtagacttttataaacacagtgaacttaggctacgttaaatgtattaaaaatattttttctttccccaataataaattaactatagcttattgtaacttttttatgttatatacttttaattatttttaacttttttactattttgtaataatacttagattaaaacacaaatacattgtacagttgtacaaaatttttttctttatatccttattttataagcttttttctatattaaaatttctttttttttacttaatttttttttgttaaaaactaatacagaaacactcacactagtccaggcatacacaggaccagggtcatcaatatcactgtcttccacctccacatcttttcccagtggaatgtcttcagggccaatacatgcatggaactgtcatctcctatgataatagtgtcttcttctggaatacctcctaaaggacctgcctgaggctgttttctagttaacttttttttttttttttttttagtaagtagaagaattatactctgaaacagcaatcaatagtatggtagatacagaaagcagtaacatagtctttcattatcaattattatgtactgtaaataattgtatgtactatacttttgtatgactggcagcacagtaggtttgtttacatcagtatcattcattgtgctatgatgtcatgatggctatggcatttctatgcaatgggaacttttcagctccactataatcttatgggatcaccttgtatatgcagtccatcaatgatcaaaatgttatgtagtgcatgactgcacctactccaaaactacagaagtggaatttagagtcatgggaagctggataatgaccatcaaagttggtcttacatgaggtaggacctggtccaatttgaagtaagaaatcagggaactttccttcaacacttatttccttccatggtctaagacatttcaaaattctgagcatggttttccatttatcacagagtttaagttactattcagtgttgaaattcctggccctcaatggcattatgaatcagctgttcatagaactcaactttcttgaatgggccatttcccaggtcttctacagctgttttgctcatttttaatcccttcatttgccagcttaatatttgctagctgctgttattggggaattcagtttttcccccatgtccctatcttttgccagtttttctcttcattcctcaaaatcagtagttctcctttctcaaaggttgcctatgaatcatccatgatttgtatatcaccctttgggaaacacgaatattttcagaaccctcatttctctgtcgttaaatgaggtcaataatgactgctgacgtttcctttgactctgaagggcgtggtcaggctagatgagaaaattcttacagaatgtggtgtgctgtgctgctgtcgccactttgctgggagactgaagctcagacagctaagcgatttgccagggctgtgcaacccatctgtggtgggaattccagaattccaacctggagaatctgacttactcttttggagaacattatatttgataaactggaatcattgttttgagtgctcccatggctctgtaggccaaaacagtagaacttatgacagtagtttggtcttcaggaactccacttaaccccaaactaccctccagttttcagagagcactggggaaaagggagggatgagtgtgtattgaattatctgaattctgccacttatgcctaagagatatgtatgagagaatctttacattttgtacacattattctaaaattccttttagtccttaaacaactctcagggggaaaatagtacagaattaaaataaaagttcttaacatttgtccctgaatatatttttagaaaaagtatacttgaaatctgatcacctataaggaaagatttatcaggagagtttaaatttttatatttactcatattaaatgcatgtgtgttttgagaccaaggttttttgtttgttttaatattttggggagacatacttccttcaaatatataggttagaggtagggggtagggatggttagtggtataaaaaaaaacagaaagaatgaataagacatactgtttgatagtacagcaaggtgactgtagtcaacaatgacttaattgtatattttaaaaaactacaagagtgtaattgggttagggtttgtaacacaaagaataaatgcttgaggggagggataccccattctccatgatgtgattattttacattgcatatgcccgtatcaaaacatctcatgtactccacaaacatatacactatgtacccccaaaaacttaaagaatatataagtttaaattagaattcccccaaattctagtagtagaatatattcttttaaaattctagtagaatttgggagaattctaatttaaaccaattctggtgttcctgagttatgtgagctcctccaagttccactgttttgtcattgccaactcagggagtcaaatatgtacttatttagcattttctgagccaggtactggctctgagaggtacatactttcatttaattcttcaagagaattaaaagcaaacggagcccatatgttatagacaaggaaactgaggttctgagatgttgagtagcttactcaaggttgacctgagactctaaattaggttcatcctccttgaagacacctatattccttttgttctcataaaatagcacatccagccagcattccatcccagatattggcactaaggagaggcgtgggaaagggcatggacactttctgttaggtacatgggggacgttgtgctctagcttatacatgactgtaaaggcgcaaatgaaaactcttcctttattagtacattttcttttgcatggttatctgggatgagtatgtggtgaggtggggctgtgggaggaagctgctgcaattagttttgcctcaggtagaatgctgacatcagttgtaatgagattaaaatcttctactcagctgttgcttgaaatattctattgtgttctcatccaactattttaactaattgaagtgacttaaccatataattattttcaaatgtttacaattacttttagataaatataaatgaatgtttgcctgcatatgaacaacaaaaggaataatctggtaccttcacccaaatagtcaaaccctctaagatattggtagaaacatcagagtgtatcagtgaaggtcaaaggacacaaataggcatttttaaatactaaaatgaaatattactttcagttccaccaaaatggagtagcctcattccttccgggttctctcccttataactaaaaatttctagatacagtgctacgaagatggcaaggaagtctctcaaagatcaaaagaagagggtgaactgctaggaatttttggaacttgaactacaaagcagtgagttccttgaatttttgtgttatctgtcatatatcctgagctaggtgctacagaagcctccaaactgccagaactgccagaaagtacagataaagaagctccaagaaagtcttgttttctttaggcaaaggaccaggtgaagggtggctttacaccagaaaatttttggcagtatctgccaaacaccactggaaaactcacatcttactccctccatgatttcagtggtgctaaacagaatttgatcccgtcattcccatacattgatactgttagacttgatgagttacatgggtatattgttattttctagagcagctgctaggaaaactatccaaagcaatatacttttgaaaagataaagaaatcaagatagaaatttttaatatgatcaagtcacccaaaggaaagtaagagaaacagaggaaacaaagagaaaacaagtaataaaatgacagtcttaagccctagtatgttaataaacccaattttattactttaaatttaaatgatctatggaaatgcaagggacccaggatagtttaaacagttttgaaatgaaagaaccaagtttgaatacttagattttctgattttaaaactgtaaaactatggtaatgaagacaacatggggctggcctaaggataaacagatagattgatggaatagaattaagagtccagaaataaagccttccattgatgtccaattgatttgcaaccagagtgccaagacaattcaatgggagaaagaatagtgtttttgacaaatggtactgggttaactggatatccacatgcaaaagaatgaagttagatcccttccttacaccatatataaaaattaactccgaatggatcatagatctaagtggaagaactaaagctataaaactctcagaagaaagcataggtgtaaaattcatgaccttgcgcaatgaattcttagatatgataccaaaagtacaagcactgacaacaaaaagaaagatacatacactggactttatctaaattgaaacttttgtgtttcaaatcacaccacaaagaaagtaaaatacaggtcacaaaatgggagaaaatatttgtaaagcatacatctgataagaaacttgtatccaaaatacataaagtactcatatacctcattaattaaaagacagataacacaattttggattaggcaagggttctgaatagatatttctccatataagttattcaaattgctaataagcacatgaaaagatgctgaacatcattagctctcagggaaatgtaaatcaaaaccacaatgagaagccactttcattcagtaggatagctattaccaaaaaagacagataataagaattgttgaccaagataaggagaaattagaacacttacccattgctggtgggattgtaagatggtgcagtcactgtgaaaaatggtatagcagttcatcaaattgttaaacatagaattactatattagctggcaattctactcataggtatatacccaagagattaaaaaaatttacataaaaacttgcacattaattttcataccagtgttattcataatagccccaaaatggaacaacttaaatgtccatcatctcatgaatggataaacaaaatatatccataaaatggaaaattgttcatgcttaaaaaggaatcaagtactgatacaagacaaatgaactttggaaaacttacgctgaatgaaaaaaaagctagtcataaaagactacatattgtatgattccatttatatgaaatgtctagaataggcaaatctgtagaggccgtaagcagattactgattgttgggggaaatagggagtgaatacaaatggcatgagtttctttggcggatgaagaaaatgttcagaaattgattgtggtgatggttgaaagagtctatgaacatacaaaaaccatttaatcgtgtatttttaaagggcctggtatgtgaatcaataaagctaaaaatgtaaatggtctaaataaactaattaaaagacagattttgacataatagataaaaaacatgacccaaccatatgctgtctataaaaaatttgcttcaaatacaacaatataggtaggtagaaagtaaaagcatggaaaaatatataccatgtaaacatgaatttaagaaaaaaattgttatattcttaccgataaacttcagaggagagaaacattattagagctaaagagagacattgtataattataaaaagaacaatttatcaggaaaacataactattgcaaatgtgtgcacatcaaataatagtgcctggaaatatgtgaagcaaaatgaaacattacatctaaattttcttaaattctttaaaccttactccacgtataatagtctttaattatggcataaactaaaagatttatgtctatactaagtttcattcctgaaagagctgcttctgtctttttatcctcaaaatacaatactgtattaggtattgaagtgtttgtgtatgtgtatgtgtgtatttataccatatagacaaggtctatgattctgtaatcatagaacttacagtgatgtgatccttttcaagcttcatattataacacacacacagacacaaagattcacaaatgtactgaatcgatttaattccatgagttgtaacgttcttgataccatatttgttctaaagcagcatttcttagtaattaaaatgaatgagaagatctctacctaaagagatagtatgaactttaaaagcagaagcagagttcagtatttatatttggtagcaataaactacctgttagaaatatttatcaagtgaagatataattgcctgctttgtctgtgaacctcataagtacaaaaattgtgttctttgaatttacactttttaagggatgtatgttaaacattttagcagtgtatttttttaaattaaaatatatgaatttaatttacacaaataatttattttacataaaaacattctagctagcatctagcagttttaataccttatacattttaatcatatctgctagaacaagtaatctctagagtggtcagctatggaagaggataaagttagtagacctactaactttatagctcatatatattttggttatatactcgaattcctattactcgatgcttcaagcattatcttttaacctctgtatacaaaattagaatgtcagcacgtttacacttttctacttgttctccctctactttctgtttttataacttactgatactaaaatgttcaaagcttatagtatttttatgttctgtaactataattctcacacttttttctttagttatatacataaatcattttagggctgacctccaaatttttacaatagactctccattctataagttgactggaataatttctaacaacatgaatcatgcatgacttgtacataccctttgggaaataccaggattctcagaggttttacttgtgtcattaaatggagactgtaatggctgctaccatttctcttctctgtctctccggtgtgaaacagggctcaggggtacacataaggctgcaatctggtcctttttcttttctctatctattcacatttctctttgttttgacctcctgaatgtgaaaatgtttaatagcatgtatatttacatatttaagtattcaagctctactgcttagttcttaatagtatcttacctgtgcattttcaccagccaaagattttgagaggacaaaagaggggacaagaacttgctatccgttttaaagaattttctatagagaccttttaaaagtaagatgattaggatttcattaaaaagaattttaaatatgttaaaagcatgagtttttgcagctgctaggcagaaagacttgcttgctaaccacactttgtttcttgggaatgaatgactgtacttaatgtacacacacacacacacacacacacacacacaggtgcacgcatgtgtgtatacatgcccggatatacaggaactaaagataggataaaaaactgacctctagaatattcagatacagacatcattctgtggctgcctcaccaaatcatatgtggttggatataagaaagtacagcctatttctgggatttacagagataagaaaagggaaaaataggaaattttaaaatgtcacaactcattttattaatgattattactcagctttattattttagatagtaatgcatttcatgtttgaatatcacaaagaaaacttttctgaagtgattttcttgagaatattgttatacatgttttctgcatcctcccataggtctatgaacataagagtttatcatattttacctatcctgttaccactacctgtggacagtgttaattgatttctaggaaatgccgacacttattttagcactaatttcacagagtcatttatttccaaggtttatataacagtaaataaactaataaaatatattgaattttaatttgcctttttacctcttaatttctctcttatgaatagactttagaatttgaccttattaatatactaggaaactcagaaattagtttcatgaaataatgtttgatttattttcattcatttgataggacaggagctttaacagatggactgtcagatccaaataaagttttattgctttattgttatgtgcaataattaagatattgttcagatagattgacacctagactctgggagacttatggtgtggtggtgtctagatagaggtatatggagaattcgtaatactgcatgtgtaccaaagaacacctgtattgttataatttgtatgtaaattgtatatgaacaattgtttataatctaaagtaatattatttagaagcattttattacatttatttttagatttgtaacctgattagaagactaactttttcaaatttttctttttaaatgtcttgatttttgagaaattttagttcactcttaagttcccttaagattatggagtagaaaccactgtaagcttaggaaaatattttgaaataatttgtgaaatacctttttgtatcccaataatttctattgtcatgagcttttgaatgttaacaaaatgattttcatctctatgttaggtttaggtgcagggtatacaaatgttatatttttattttcagtacagtacaggattctacaggggttttcattgttcatttggggggtaaactttttatttccttttctaatagctaagaggtataaattttgatggtattattatctcagtttacatatgtttcacttgtaaatattgcattcatgaagaagaaacaccacaacaatttaaacacataaaatacttcatgtgagttacttgaaaatgacaaatcgaaatctgtcacgtaataggaaaactatgctttgaagcataatctctagtgctgcctcttctctattacagcttaaactgtactctgcatgtcatacataaagaatgaactttgcagtcagttaaaaaagctgaaacaattggtatgagaaacataccaagaaaatattctaatcataattccaagttgaggtcaaaaaaataaataaaccagaatatgagccataatctttttattttttttaactttaatagtccttagcaataatcaacaatttactgattcaacaggagacatgttactctactgccatctggttattctaaatagaacctatccctctggacgagcaaaaggcgtaatgattggatagacgttttggcagaaaaaagacttttttaatgtcttgggatttgggaggtaaaaccaatggccataattttgaaacatctgctcttttcatgatctcgtctacatggaaagagatttggaaacagaacatcctcaagcattatttttttgcagtgataaaaaaatttcattttgtctaaatatgtaagtagagtcaaattcacttcttagtaaaacctattataccattatataaacatgtagcttgcttcttcttttgaattcaacattatcttaagttggtatatttattgtttatacatctacctacaaccaaaaaggtgaggagttttacacaaaaagagtatagatataatttttaaaaattgttaagtaacacttgacagcaaaaggatgattgcacccacaacacatttgtcagggatagcaactgtagttggcaacaaaaatgaggcctatatgctccaaccctgggtcatctttctactgtttgaaattggtatccaactatctattggatgaatgtccttcttatggaaataagaagtgagattttcagtcaatcaccctagaccctaaattggttaaatttaaaaatgaatgggcctgctctcctccttcttgctgggtctcttggcttcctgggttgtttccatcctttctcattctttctttcccctcagagtcagggactctagaggaaaacctttctctggatttgttgcctgtcgtgttcttgccagtcctcttctggggatatgctagattctggttttgtgctcttttgccttgcttagtatgaacttatggaaatttggtctggtctgagctttctgagccctgtgtctgccccattcctcctggatctgatttaccttctatctcagcattggcataaaatgagtcaggacctgcagtcacacctttacttgggctagattagactgtagaccttaccattgcaggagtagggtggaattgacctcaattctgccctcacattccagccctcctaattgattttccaccagcatcttccccaggttgttccctcctcctctgcctgtatgactgactggcagcatgaagctagggtacgttagtccctggtagggggcaaagttcttgcacaagtttccaggaagccaagtccaaaagaaaaaaagacacaagagtatggtaatatgcaggggagaaagaacgtctccaaaagggaatggaatttatttttagatctagaaaaatgtcttcattattttaataagtaaaatatttaaacgttagcagttataagcaccactacatatctattagagtggctaagattgaaatatgctgacagtaccaaagtctggtgagagtgcagagaaactggacatcaaggagtttggcagttactctttttaaaaagaaaaaaaattagttaaactttttattttgagataattgttggttcatatgcagttgtaaggaacaatgagatcccatttatgcttgactcagtttcccccaatggtaacattttctgaattacagttcaatatcaattctataatttctatttggttctttttttataagttctatttcttttcaaataaattctagtttttcatttgtaaagctatatagtgcagtatcactgccaggttattaacattgacagtcaagctatgcaatcctatcaaattaccaacatcgtttttcccagaattagaaaaaacaatcctaaaattcatgtggaatcaaaaaagaacctgaatagtgaaagcaatcgtaagcaaaaaggataaagctggtggtgttacattacttgacttctaactatactacaaggtatagtacccaaaacagcatggtactggtataaaactagacacagatcaatggaacagaaagagaacccaaaaataaggctacatacctacaagtacctgatatttgataaagtcaacacagatatacactggggaatgaacatcttattcaataaatggtgctgggagaattggagaaccgtatgcagaagaatgaaactggacccctatcttgtactgtatataaaaattaactaaatatggaccaaagacttaaatgtaagaccaaaaccaataaaagtcccagaagaaaacctaggaaaaactctattggatattgtcctaagcatagacaaagagtttatgactaagtcctcagaaaaacaacaaaaacgaaaatagaaaaattagacttaattaaatgcaaaagcttctgcacagctaaagaaataattaacagagtaaaaagacaacatatagaatgggagaaaatatttgcaaacaatgcatctggacaaaggtctaatatccagaatctacaaagaactcaaataactcaacaagaaaaaaacaaataactctgttaaaaagtgggcaaaggacatgaacagacatatttcaaaagaagacatacaagcacccaacaaacatgaaaaaatgctcaacatcactaatcatcagggaaatgcaaattaaagccacaataccatttcacaacagtcagaatagctattaaaaagtcaaaagcaatacatgttggcaaggatgtagagaaaagaaaattcttatacactgtcggtgggaaggtaaattgtgcaacctctttagaaaactgtggagatttctcaaagaactaaaaatagaactatcatactatccatgtatcctacttctgggtatgtatccaaaggaaaataaatcattatatcaaaaagacccctgtgttcatatgcttattgcagcaccattcacaaaagcagagtcatggaatcaacctaaatgttgatcgaggaatgactggataaaaatatggcatatatataccatggaatactactctgccataaaaaagaatgaaatcatgtcttttgcagcaacatggatagaacaggagaccattatcctaactgaaatgactcagaaacagaaagtcaaaaaccacatgttctcacttacaggtgagagctaaacaatggacatacatggacatgcagagtggaataatagacattgtggactccaaatggtgggaagatgggaaggtgagaaggggccaagggataaaatactacctattgggtacaatgtgcactatttgggtgataggtacaacaaaagcccaggctttaccactacaccctatatccatgtaacacaactgaacttatactcctgaatctataaaaatgtaaaaaaaaaaatttttttttaaaacgtaacactttcatcaccacaaggattcctcttgttttccttttgtagccacattcatttccctcccacccctccctctctttaaaccttttgtcatttcaagaatgttatataaatagaaggatataatgtaaacctttgggattggcttttttcccctcagcatgaatctcggaaaattcctctagattgttgcatgtttcaatagttggttcttacaagtcctaaactattctaaaatcaaaatttgtcaacaataatatttttaaacagtgctaacgtaacaatgttattaaagttcttaaaaaatgttgaaattttcttctacataaaaagttaaacattttatatggtgtgttgattattctccatttactctcctcctactctaagtccccctgcctttctctggcttgctgcatgacccaaggggcttacttttatgcagtgtatcatctgggcccctcctcttccacatatccggctcaacagagtttagttccttcctttctttttacccctaagacctagaggttgagacagcattttcttattgttggaagatttgttgatgcctttaatcttcctgcatctttggacatggctcctttatttaattcctttcactcaaagttaaaagcctttgagtgtactatctgtttcctgccaggaccctgatacatttaacaaaaaatagataaattggatgacaaatgatatactgggcaaatatttgtaactcgtgtgataaatataggtttattttccataatatacaaagagttcctacaaaaggaaaataaaaaaccaaatgaccaaaagaaaaatgggcaaagggcatgaacaagcatgttacagaagacaaattccaaatggtcaataaacgtgaaaatatgcttctgcattagtattcagagaaattcgtatttctgtagtcctagctactgggaaggctgagtcaggaggatcacttgagcccaggagttctaggcttctgtgtgttatgatcatgcttataaatagccaatgcactccagcttggcagcataacaggtccccacctcaaaaaaaaaattaggattgctgagtcaaaagttatgtgtttgtctttttaactgattatgtgagattgctttaaaaagacattgcaacaatttacactaaagcaacaagatacatttttcaaccgtaagatgggtcagattcccctttaggactgaagcactctcccttctgctgagagtttggtcaggcaataattttcagctgattccttctccaagaattttcctcagagacagctgccttgcctaagattatggcctctccctgaggatggcctgccagcaattactcatgatgtaacatacgaaagtccaactgccttgcctgtaggttggaaaactctaaagggctattttccagggaacccaaaccacagcacagcattaacacttaccatgtgtaatccttaggaacataggaattctaatagtataaattgttgcaatgtctttttaaagcaatctcacataatcagttaaaaagacaaacacataaattttgactcagcgattctaatttttttttttgaggtggggtcctgttattttgcccaagctggagtgcagtgactatttataagcatgatcattgcacacagaagcctggaactcctgggctccagtgatccttttgcctcagactccctagtagctaggactacaggtgtgtgccaccacacctggctttagcaatcctaattgtcagaatatttgagaattaaaaattagaaagcattagtacataaatatatatatgtataaatgatgtgcactgctattttatttgttggaataactgaaaaaggcttaaatatccatcaatagatgaatgatctaccaatagaggatattgtatgttgggatattttgatagtattaaaaagaatgagctagatccatatttaatgggatgtggaggatgtccaaatgtcaatgatacagtgttgtataaaaataaaagaagaaaaacaagttatagatttatgttggcttgtgtgcatgcgtgtgccctgctatagcttattaaaggtcaacagatctcagtgactgttagaatgacgtgttttattgggctcactcttcagccagaacatgctagcatggctatacttgttatttatggtgatgaccattttgattggctgggtattttttctaattaggcagtgcctgtgctgtccttgttgttaattattttgatggttggctcctcctttaaagtgtattgtcagctgactgacaatttttgaaagcctgtttatgtagttggcttcagaagcagcaaggattcaataaaccacttttatattcagattatgccagatatttggatggaaaagggagtattcattccagatattatatctgtataacaaatataaacaagttagaattataatcaaaacttctaattctatctgttaagctctttgtagacactccctcttcattatgaataacataggtaaggagagagaaattatgcattatatagttaaacactggcaaaacattatttctcattctcctactattggcttctgggttaccagagcacatacttaggactgccaaattctgaagtttagaaaacactgtcataaggcataatgtatccattagaaatgcattaggaaaagagagaagtaacattttattagggcttttagctagttggtggagtaataagcatacttttgtgttacctttatatgatttatattacttttcttctagagaaaacagtggaatcaaagagtattttgatcagttttataaagaaatagatgactacttaagaaataaatatattcaggttagagtttgctcatttgtatttgatatgatctgacactgcagaaggccaaaggatctcattattgcccgggtctttacaagaaaggttccccaatgcatgacatggcaatttgtcgcctttatttagagggatttagacaaagcttgcagcatttagcattccgttcctttgacagtaccttttaacatccttcttattgttctatttgtgggtcaatgcaaagcattcatgaagattttgtggtttagggagcaagtgaggctgttgtctaatttgttgtaattgctcaacttactcaaatagtttaatttacctctgaatatgttcagcagcttagaagaaaggtgtttgttcaaacatgaaatctttataattagaaaaaaattattatatgggtttgtgttatgtaaaccttagtgaactttctcccaatctaatttaattaatctttaaataacattggtttagttcttttggcataggggcaaggaaatattatgctttgaaaatgtaggcttttctgagaagtaacatacatttttctacgtgagcgactttttccttaaatctctttctaaacagtcatttcaacttctgcctgagggaatggattagctgtatcattcctcactctcagattaaccccctccctgcaaactgctacagccccagtcagcattaaggttaccaaaccatgagggaggacacaaaatgttctttctctttccaactcaatctatctttgaagtgccaaggagagatattctggcagtacgtaaatctgaaattctgttttgcttcaaaaaaacaaaaatgaaattctcactcagccatgattctcttacaaccggcaatctttttctgtcctttgtctacctcagtgtcttggaggtgtctcattagtgggctggtatttctgacagaatgctttttaagagttacatttctagctaaatctatgctgcatttttagagacaaaatagcatacagggaaaatgaaaaataacaccagagtcttgaataatatcgttagctcaccttccatcagttaattgtatttcttctcttaaaaaaaactattaaaacttcaatttcacattatattgctttcacaaatacattggctaatagtatagatattgagccattactgaaaatgaatttttgtgggtagaatttgcaaccaggaagaatattaaaaaactgaatactttgtattcctgtgtgcctattcagtatcctccacaacccagcatcattctttggtgaagaaattgtttactatacttgggttagcaacatttaggtccccccaccttttttttttctctttcaatttttagggatgctgaaattaggtgtgagtgttgataatgactgtttctgcctctgcttatataatcaaagtaaaatggagttaggttaagttattttagagggagcttactatcttctgtgtggccaaatttatccaggagcttaaactttagatactttgggtcccgggactagcatagactgtgaagcgtagagctgtgaaagaatttggatcctaagggaaaaaagtttggaaaccaaccatagaaaatgcaagtgcaaaccacaaagaatagttaaaatgaaaaaaaaggggcagtgtaaagcatgggaggaactgagattcttttcctctgctgttggaagttctaccacatcagaaacatatttggtaatagaactaaagctaaatatatagctatcctctaactagcaattccatttctaagtctataaccaacagaaatgaatctatatgttcatcaacatgtgcaagaatgtgcatagctgcacttagtaatagtcccaaagtggaaacaacagtacaatagatgcattaattgtggtacactattacaaaaaatacagaaaaaaggatgagacaactgtacgtatatacaacggcatggattaatttcacaagctcaatgttgagtgaaagaaaccactggataccagtaagaacattctattgttcaatttgtgtaaacttcaaaagcaggttaaactgatctgtggtgttgtaagttaggatggtggttagcattattgttggagggtgagtagtaatgacaagaagaggaccttcttgagtgctggtggtctgtttcttgatctaggtgttggttacctgagtatgttcactttatgatttgtacaatttgctgtgtgtgtgtttactccaataagaaagattaaaaagaaagaaggaagaaaaatcagctatagaaatgaagaggattggcagtgtaaaagtgtcatttttttttccccatggtaaaagattaagaaagagatacatgattaaagccaatgaaaatttgggagtcaaagttttaaactctcttagcagccaaactaattgtttgaataaaatgcatgctagttatcacagtgtttcaaactttcctgatccttagaacactaaggaagatagtctcaaaaatatttactccctggtccttctgtgggagatttcagtttagtctgtttaagatggggctaggaatctttattttaaaaacacaacttagacaagaattagaataatggtcagttcaaaagagggaaacagaattatgtgatttttttttacagcagccaagaatgatgtagcctggtttattcctacttctccttcatctaccccaatcctcccacgtatctccaattccaatttgagcagtgattctgaaactttactttaagcacttgttaagaatgcagatatcttggccttactccaaggattttgaattggtaagtctgaggagaggcccaaatagggctatgcatttttcataagtaccttcgaagatgctcagattcagaagcagttggtctcagatgtacaccttgagaaagtcaggcctggagaaaaagaatgtactagacaaacagatatatttggcttagtttttttcctttcatgactgggctggttatctagcactggttatatttaagtccctaataaattttaaggtcataggagatgaggagtgtatcttatatccttcttaggagcaatttcacagcacctgtaattgtactgcttagccagtaggtatttttgaaagtcatgaagtccagatgattaaagttatttttagttttattataatcatggttggaaattaacctggaaagcactgagtttccctgtgtgtatatatatcacttgtaattaaaaagtaatctatttccccagtcattaaatgtttattgagtatctattatgtactggttttctgaaatatcattttgtccctgtcatttcatggtctctagttggagcatgcgtagcaaagaaaattcatgttccaaaatggcacaaggagggtcttaagcatttttaatattccacttatcagaattggaatatagataagtatttgcctgctcccagttctttgataggcattctattaaaatcaaaggcaaatgaattgtcagaaatagatttagcttacaatatagatccactagtccttgcaagttggagtcacgggctagttctacaattaagaaagaccaattattcaatctcttagaaacttagcttacctaataccttgtctttatgtattatgtaattgtttttattctaggagaaggtactttattagttcaagactgcccagatatacagtaatgaaaaagaagaaaaaggctatcatcactctaataaaatgattagttatgttcggtttggaagtgtttgctcaatatattttgtcatagacagcataggatcccagacctcttgacatttctttgccacctagattttatagtcctgctggtacgtgcaagcaccttaaagaagaggctaatactggggaacactaaggtatatatatttattatatcatctctatttttaaagtataggccaatcatatatggatttctctgtaaaatgaaatagtatgagagtatcatagagatcagttggtgttcatttttgaagaatcttgacattgaatttaaatatttacagcctggagcaattaggattctcaaatattgctgatgagaaagtaaattagtgtaaccactttggaaaactgacattagctactaaagctgaacatatacctatacctaccctatgaacagcagtgttactcctaggtgtatactcaagaaaaatatgtgaaatattcagcagaagactgcataagaatctcgatggcagcaagtactctaatctcaaccaatagtagaaaagataaataaattgaatgaaaatgaatagtctctaactacacttaatatggatgaatctcacagacataatattgagaaaatgaagttagatgttaaaaagtatattctttgtgattctgttattcaaaaatagacaaaactaatctcaggatagtggttaccattgggggtttgtattgtgactggaagttggcatgaggaaggattttgggggaatagtgattttctgggttttgatgctggttagaatggtgtgttcagcacatgaaaattcactgggctgtgtacttatgatcagtgctaatatataatactccaataaaatatttaaagatattttaacatattaaatattaaatattaaagatattttaataatataaaatatataaagatatgaattggaatcagtttccagtgtttatcagttaggcttgtttacatgcacctacttgagaatttgccagcctcagagaaaagtagagaatagtctaagtataaacaatatcatttagatgtcatgaaatagccttttttttcccttttgcatagtgtttagtgtgtgatatgaaggtgttgtagccaggtggaataacatcaggatttggtatcattagatcatatttgagttctagctctctccttaaaacactgtgaggtcttgggcccagtcacttaattttctgatttgaaaactgagtatagtaatacctaagactttataggtctatggaattatgtattattttatataatgtttgtttactagaatgcaaatctcatgggggcagtgatttctgtctgtttcattgattgtggtatgccaagttcctggatctgtgtctggcaagtaatcagcacttactatatatttaagtgaataaattactaaaacaaaaatatagaaagaactaaaatagaaaataaagtatctacgtacattttagctgctgctcttttaaactttattaaaagtcactggaaacctgagacttgttgagtttaaaatattatggataaagggtaggattaggccttagagaaaagatattattttttttttcagatatacttgtcaaaatggatgtttctttattcaggtgttccttctaggatgatagaatcctgggtcctagagagaatacttagtgctatactgccatctttttgaaagtattccatacctcacaacagagtagactgttgaaaaagtcacaaaacaactgtacttactgaaaaattagatctttacaccatatatccaaaaaatgtatagctgctggttaaacccatccaaagtccagctttgccttagttcactggtaggagccaagctaggacgggttccagaagaagagttccaaagtccagaggaatggcttgttccagttatgggatcccttatatcgaggctcagctgtgacttatctccctgaaaaggtagcaccaccttcttcagggttgactttttgagcacatgaagtagtagccttaaccacgtggagctgatcttccaagagggcctgatgctttcaaggtcccataaggcatagagataatcaagaacgacactgctgcctgtgagacagtgccgtttctccatggtggtcaggtgccaggtctgtgagcaggagacattcctgaggctgttttccctgtaccagctcaggctctgtatcttctttctgctctcgttgctccttgggctcagacctctgctacttgcctggacttccacttgaatttttccatcgtcttgaattgactcattcagagtgttacccagtcttgttctattgaaccttactctctcagctgcatctcaaatcaaaccatagcatttaccctgccattcattcattcattcattcattcatctaatatatgctaaggtctgtagggataattggcaataaatataagcagttatctgaggctctttgtcctggctgcagtgcctcctgcttaagtcctgcagagcccataacagtctaggtttttctgatgctcttttcacttgccccctagtattctggctaaggcacattaatgatgtacacaaaactgttttctcagtctcttgcattttgggagtgattgaaaaattacatatataaattataaaatatattattatgaaatatattataaaacatatgcaaaaacatacaaaatataatatatcacattttataaatattcacggccgggcgcggtggctcacgcctgtaatcccagcactttgggaggccggggcgggtggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcgccactgcagtccgcagtccggcctgggcgacagagcgagactctgtctcaaaaaaaaaaaaaaaaaaaaaaaaatattcacaaagtttttggtctctgcacccctttccacttttaaaaatgatagaaaactgcaaagagttttgtttattgtattatatatagcaatatttaccaaattggaaattaaactgataaaatttaaaatatttatttactaattaccttaatataataaacccattatattagtataaataacttatttttaatgaaaaataactgtgttttcccaatgaaaaaatttagtacaaagggtggcatcattttacagttttgcaaaacactttaatgtctggcttaataaaagacagttggattcttatatctgtttccatatttaatttgttgtgctatcacacatcccgtaacctctggaaaacaccactgtacactcttgagatatgaggatgaaaaagttaaatgatgtcttagtatttatatgaaaatggctttgacttgtgggctccctgaaatagtgtcaggaatgcccaggggtccctggaccacatgttagaaatgatgccagaaactcacaattttatttattccttgttacactgcattcgatcaattgaattttagtgagtattcattcaaagaatcttagtagtcctccttctaataagaaaatagtttattaatgttggcatatgtacattttataaataaaattttaatattcattattaatgtaggaaaaaattatagtgccctgttacttagagctttatttggatgaaggatgtattaaatgtaattttaaaaagaaaatgttctacacaggtcaatgacctttataataaacacattttattgcttaaatttagtgcagtaagattaccaagacaaatatttatctttctgtcgaacaatactaataatgctgcaattaattatagaacttatttgaagagagttgcatttatattaaaatacctgcctatatcatgggcacctaaatatatagttgtcttcattatcacattggagagcctaggttcctcatgttttgtaaaataatgattttttcacaggcacacgatcttttagatagcatgcatcaggaagaggtaccagcatgctagtttcttatttaagattccccagccccacgactggtatttatgaaagagaagaaaggatgtcattacttgttcctcaagatgacacagagaggtttatgctgcttgagcagaggcttcagaatgtgaagactcaggcccaggttttgatgtgatttgatggccagtagcaacagagctgccactcttcatggatgattaaagacaaagagagtgagatggcatgaaccacaaagccctgctgccacctgacagatttttcctccgattcaaggaagcccttatgagagcccctttatgtgagcctggttcccttgccagtctatttcaaatttttttaatctctgctactggattgaaagtgtaactgccactttcaatatgcttcagaactgctaatggcaaagttgcttttgggaaccagttgattaatttagacaatgcaaaatatggaggtcccaagtcaagaataagctaaacgactttgccttatttggatataattaaaaggcatggatccaacgtaaatgtgtcacttcccagtgacatctgcactttctgtttgcaaacactgttatataagggctctcagaggtcaagagtgcagaggccacccccttttaaaacttctggtatattataaaaatggagaaatgaaaaagcagtgttaaaaaggaattttattttcagggcttatattggaagaaataatgctttaaacacaaattataatgcaatagaacttgggtattctcaaagtaattacaggatttatttgaacctatctttagtaaagtttgttactcaaactttataaatatacctaatagtagtcatgagtttgaattgtatggtaaataccatgttcttttgatctagtcagaatattccagttatttgagtgaatagcctcatttggagataaatcttaaacttgagtttctttctgggtgtaattctgaaatgatagggtcttctgcttcatcttaaaggagtgacatcacttcatccaaaagcagatactatttaaggtgatggttttaaatctaaggccactggatggccaaatcattgaggatataatattaaaacaaagagagattttaaaattctaaaatgctatatgtgagtatcttataaatgaaatccagaaatatgccaacagttttttcataatatgctcaaccttgagaaaaaccctgtttaatatctaaacatacgtatcaataaataattttacattaagaattactttcctcttgtaaagcgtatatttcaaaaccataattattttaagacctaaaagggattataataacttttcatctaagctttataattgtggttttggaacttaggtaactttttggaactatataagagggactggatgtggtggctcacgcctgtgatcccagcgctttgaggggctgaggtgggagcgattgtttgaggctaggagtttgagaccagcctgggccacagagtgagaccctatctcaaaaaaataaaataaaaaattagccaggcatggtggtgtgtgtctgtagtcccagctactcaggaggctgagggaggacgatcacttgagcccagaaattcaaggttacagtaagctatgatggcaccactacactccagcctgggcgacagagcaagatcatttcttaaaaagaaaaggaaagagaagagaagagaagagaagagaagagaagagaagagaaaacaactatgtaagaaatatctgcttcaagttagaattcagaaaaaattcatgaaactagaaagaaaagtagaagaaatggatatcaattccctcaatgtaagatgaagacacttaggctaaatgactgaattgattcctccatcaagcttcttatagagctagatccagaacccaggatttctgaagtacaacctgttgttctttctagtctatgacttgccaccttcttacaattttacatagtcaggaaatggtatggaactttaaaggctcttccaagaggaaagagaattgtttgtatttaaaaatatatataatatatattatattttatattacacatatatcaatggcaggttttcttttcacaaattgagaaaaaatttagttcatgttcaaatacaacataaaaataataaatataagctattttaaatgcctttatttttatctattttttgatattacagtagtcaggtacaaggaagtttattattacaggcgatatactttcagtgaagagaaaattgtgtgtatgctttattttgtatattgtaggcagggatttttagtgtttcatttaagggagggattgataatccaggtatttttgactgcctctcagatattctttgttaaatgtcatttatttctttaagaatcctgttcagtcaaatatttacttgctttttaacaaataataactcagggcccttcattcctccttttacattattatagagtagaatttcaacaacagtgaacctaattacataagtctttgtttttatcaaagtttttagtgttttgtcagccaaaactctaaaatattacaaccaaatatcagatggatttagttacaagcagttagatttattttttaagtgtgaatgtattacttctgaataaaggaaagagctgatatcggggaaggtaaattcaccgaaacctaaggcagataattcactgtagatggataataatttacttttctatagctttgctattttacagggaggagcgtgtgactctggtttatgtgacttttcagctgtttcttctaagaattccttttttcttctctaaatcttcttaagcttaaatgttcttcccatgtttcttggaagtacttgcaaattttatggaatgcacttctttaaagctgctgctagctaaaagtcctaacccctacattttaccatttcattctattttaattcaggtatttgcccatattaaaaaacataacacattcatttttttttctgggaagcaactgtatccaattctttttttttttttttttttttttttgagacggagtctcgctctgtcgcccaggccggactgcggactgcagtggcgcaatctcggctcactgcaagctccgcttcccgggttcacgccattctcctgcctcagcctccccagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccaactgtatccaattcttaatacacactctttgacaagtgcaaatgacattttataatcagattgaaaataaatgtttaatacttgctttgtgtgcttttgagggaaaaaccgtttcgatatttgagtaatacattttttgttgattatcacattttgttcttaatagaaagttggtttttcttataaagatgtaatttgattctattaactttgtctttttaaataagttatattttaaaaacttgaaggaaaagcccatttttatgtattgcaatcattttgtatttcaaaatctactttgcatatctttgtatacttgaattaatataaaagcttgataaagagatgagaattaatacactcaacctgtgaggaataaagtagttgtattgttgatttaagcttgttgaatgtgatatctcaggatgctaaagaggcagaccagcaggtttcaggtgattaaagaaagtccctcatcttggaggaacttgaaggaacatgttgctatttaagtggaatctaatcagtaagaagaaaagcttggatgtaaaaagacggaatgtttcatgtcattatttacaaagcaactgaacaaaagcttagcaagataattaagtgccttgatgctaagtagaatttttcaaagcaggttgattagaggtcttcttcaagaaaaaaaaattaaacatctaagtacaaatagtctagttgaaaaggctaactcagttacatagatggagaccagtttgaaagaaaaatcacagtattgtatatggtggctgatgttcacagtgatgcttttaattgctgagcaaaatcccgatcatccctgggtagttatagcactaagagtattttactgtgttttaagtttttgaaaactgaaaatccgtacagacttaatatgcagtggcactgaatgtattattccattatcttggttactccatttttcaattggtctgaataaatagaatttgattctttttcccgttgcctgaaaaaaaaaaaatcaaaagtaaatattatcattctcaatataaaatgttatttgcaactgtcaagcaaaaattggatgtcatgtcttgtatctgcattttgtatttcaagacactcctggtgataacataaggagactggcatgcccaggattgtgctgtgtaaacaaatgctggcaaagccctggcttctcttaagcaggtggtcaggtcaaaacactgatggcagcattatagctaaaaatgaaaactaggaagtcgtgaccttaggacctacttttctaccaaagaaaggaagcttgaagttaacaagtttgtgccaaacacttcagtagacatatgttcttttttcagtgttcttttactgtgttaacattttaatgacctcaagtttacttagtaatgaatactttgggggcaaacatccagtagcagattgcttcatttattaccaatgaatttatttattcagtcagtcattgcagagctttatctctgaagaacacatttgaaaagctaaactgatcctctgctcacctggcagtccactgtgagaatataaaacgagtaactataataccaatctacctgtgggcagtttgcaaaggctgatgtcgtgagtgccatatatgagactctttttgaaatctaaaacaataacccagcccagacattttcagctaaagcatatgatctaaatgcttgaattaaaggaaaaacactttggattatagtccccattagtacttaaaacactcttggttttttcacttgtgctttgcttaagccaatgtgtctcaaccttagctgcatattagaattacctggagaactctaaaaaattctcatgttctagccacactccagaccaatcaaatcagaatctctgattgtagaacttgagcatctatattttgtaaatctctttacctgattccagcgtggagcgaaggttgacaaccactgatttaaccacttgcaatttcttcattcattgtattatttatttttcttggccttttaaaaaacacactgtagcatgacttccttaatttagaatcctgggatagagtttctattttaaaatatcccttttattggaattggactaaggagcattataaaaggccatcatttaggatttatattacttttacattatttaaatatataaaacttagtcactgtggtttgatttctgtggacactttgatggacagagtgcattttaatatgagcattagacatcttttatgctttatttcacattctcccagccgactcttcccatcatccattgctgttgcatcagctgaacagagatataacctgataactcctcaccttagctgtacctgaaactgtttcttcctcggaggtgtgttggctactgctcttgggagtcaggtagtccagtgcatccttatacctgattcagttcttggccaatatgggatgggagcaggtaggagcatgctcttctttctatgtctcaggcagacagttctgaagttattctacacatttcctgatagcatccccagtaagattaaacgtcagttgctcacgttagtcaccagcccaactatacacccttggattggctttcccccttcctgttttacatttacacttcctatcccattcaactctcattctagttttttgggaaccacttctctgaataaactatctgtgcacaagtcctcatctcaagctctgcttttttatttcatacaagctaagacagtatgaaagagaaaaatcatcataggcatgttttagtgcatgctcccttctctattgtgtttttaaaatcacgttatttttctacttaatacattcagtttatcatattatgataagggacactttactcacaaatctcgaatgctggaaaagagccctatccccatgttatctgttaccatgttatccccatgctttcgtctgctgcccttattatcctctgtgagttggttgccttaagatcctcctcctgatgtctcccagcagcgtgacctagattcttgatcagtgtccacaccgaacattcactccaaactgtgcagcaaacattttatagactcaagccacataataggtccataacatcagcataatattaaatggaatgggagagatttttgcagagagaaaaatggtgctaatgcagtgtgatacacttggtgtagtggaaaggcaagcactttacagttagggtcccagtgtagggtaattgtgtcttctgttgcccagaaaataaatacagttaaacatattaataaggaccacccagatatttttttcctccagcattgaaaccaattgccatttctttgttgagcatcagatgtttgaaacatatatatgtgaccattataatgacattgtttgccatgagatactcatataataagaggcacacaggaggaggcacagctcccaaatcacacttactctggggcatacacatcaagtgaaattgtggcaaaaatcctctgcactcttgatcttttctctccgtctgtcactttgtggctgagtgcatgtggttgagtgtgcagaagtactcatggatgatgcaactctcttgtctgagcgtatttccaggctcaggaactaaggacgtgtgactgtagcagatgactctcatgtcttgtgttggatttccttggcctctctctaacttgagaaacagctgcagtggacagttctgtgcaagctcagattcatctcaagctaacagcatttcatctccagcatgagcatgtcttttagcttcctgcccatggccttcttttatgttgctggagttcctaacccacagaccgttaggggccagaataatgaggatgttaatgcctcaaagaccaccatcaatcatcagggtccagaaccttgaataaactccccagcctctcatcatttaggtgggcaaccctgggaggcatctgtacttttctcagcaggtcccaatggattcaagccctagtttcccaaagaagtagcctcagtaatagatctgtatattggcctaatcttcttccctgtgtcattctcctcacaacttcagtctgcttcctgagatcatctcccaaataaacaactgatgtccaggttcttgcctcaggctctgatttcagaggaacactaatgaagagcgatgttaggtcagtaatgtaatctctctgagtcaatacttactcatctatgaaacaggaatattaagatctaccttagaaggttgttgaaaggattagatataatttatataatgcatttatccctatccatggtacatgactcactttaaacactgacaggtgtcttaagagatagacaaatataaatagaaacctaattctaacatgatttctatagagaagacgagaaagagacagagtgaacagacctgaggtgctacatgcatgaatacttgctactggtttccttttatcttcctgaggcagttaccataggcatgatcaatcctcctcagaaccagcctttgcccttgtgttacccggcatgagggtgccctactgttctgctcctccttcccctctctagcaaatgcctccaggaattagggatgcaatttcattttcttagttcactcaccttttaactatgcccattactattccattttattctaaccaatgaattatattctactttcattaagggctttcctatccaggaaactcaagtgggtccaaatttcccacaagcacctcatttacccagcagcgttttgtttagaaattagctcttctatacatagggcatgccgagataactgaagcttatttatttaagttatgcttactttagaaatacaaatattaaaatacaccaattttgtattaagctaaaatatagtaaatgtgggctgtgttttagttagggttgctataataaataccatcgactgggtagcttaaacaacaaacattaatttgtcacgattctggaggctgggtaacccaagatcaaggtgtgggccaattcagtttctggtgagggccctccccctagtttgcagatggccatcttctttttgtattcttgcatggcagagagaaaaagggctattcttcttcttcttataaagacatttcatcatgggggctccaatattatgactaaattacctcccaaaggccccacttccaaataccatcacatatagggcttcaacatttgaaatttggtggggggacacattcagtccacagcattgagtgacaaatctttaaaaattggtgcatctttttagccttcttttatataattcattgagcctaattaaaagtttttaaatttataatttagagttattatacctagcaatccagtgatacctagttgatgagaagttaaactagaaattattgtcagttctgtactagttacttattaaaggcttgttgaataaatcattgaatgatcgaatgaatgatgcatgattcttccctggggtttcttctaactctagaattgtatgattctatgattagcaaatcctttgggaacaaatcttctttcaacaaagttggtctaaggtcctccaggaaggtggaggtgccagtatccttagttgtggactgatgtaattacagctaaggatcatagtttagtttcttttgttggccttgctagagcagcccagttgtggctggggtaagggaacaatagctgagtcccgaagttgacatgctttagccagaatttttacataggcggaacagcgtaattggaaggggatctagcaagtttgtcttggagctgggcatacataaaaacatattgttttttacttagcacatgtgcttcttactggaggtgttaggatttatgaaaattatggagtgctaacatcttcctgatcacactgtgctaccaacataaccccatttccgaagagttaaaattaagccttttagaatcatatgtaaactatgagagtaggttcttactaagggtttctgaggatagcataagaggaatattcaggtgctttagtgcaatgacttgttttagatatagataattatataggtaatctttacagatgtataactatataatatataatgggatatattatatgtattttggctttacttcttcatttataagatatttattgtatatatttgctcaggtaactactgccaataatcaataagtgggacagatatggttttgtgacctcatgaagtgtacagaaaagattaaatatgtaaggtgttcctataccaaagatggaatcattttaaacctaccattgcaaagaaaaatagtttttaaacaaagctgtttttcaaatacaggatcttggtagattaaaagatttatgttgatattacaatattgttaaagaaaatgctgagttttaggtgagatattcaaggtgtgtagctttctatgtaatttccttaacttgaaccaactgttattaagaccttttgaggccaaccatttaaacaccactaggtaacacaaaaaacaatgatatctgtgacattgtatgtatcaaaaattaaatgttataaggacaaccagtgcactaagtaggatacacttgtgatggccttgtttgtgcttattttcttgttttgttttaattctttacattttggagaaaataggagaagattcatgggttggttaccaaaagggaaatgtgaattagtgaagtgagaaacaatatgtatattttcatcttgctaaataaatgtggtctcaagtcttgtgatgaagggcgatgagatactactaagtggctgtgtgtatgtgtgtgtgtgtatgtgtgtgtgtacaatatatctgttagctctaatgatgtgtttgcatattctttgaataaatgactcttttatattcttagaatgttctagataggttgatttaatcagtaacatctttccttaagtttcctaattctagggtgccatgtgaaaagatgcagaagaaaagttatgcttacacagatgacattcaggaatgaatactttctgctataacaataaaaaagtccagtactagtttcaatatcaaaagacgaagagaaatggttatttagaactctgtgcatagaataccaatctggctttctctgtagttaactgattctgaataaagatggtgatttgatcaaatttcaaacattttgaattcctcagaatacccttaattggcacagttttgttctttacaccctttgcttcactcttgctttacaaaagttagtgaataaatgaatgatccatttagtctcccaaagttttgatatactacttttgtcatatctagaatctcacatatattgaggtttattttagaggcttttgttctgtgtcactgtcctgggtccatatatcaactctggattcaaattattttagttactatagcctcataatatttggagaggctgataataccacattactcttctctttcagaaatttccaggattttgacataatatattttttttcagataaacgtagaaattatttcaagtttcaaaatgtattattttcttgtttagtgtattttataatttaatttagagaaactagattttttataatatcaggttttattattcactaacaacacaggttttctcatttctttgtgtctttttaatagcttttatagaactttaaaaattggctgcacacctttatatttgtttctaggtgattactggtgtctattgatattgtgattaaaatgtttgattcattagattttttaccttgatatatagaaatatcattaaatattgcatattcatgttctcataccttagctactttgaattctttttggttatacaattttttcagttaatattttttagttttcttgtgaactattatattgtctgcacttaattagagcttcgtctcattttcacaatttttcaatgaattaattattattgttatattggttagaattgagttgttttatatagcagcatatcactaaataggcattcttagttaagttcagacataaataaaaatgctttgacatttcgtcattaaaaaggtttaatctttttaagttccagggagaaatctttttcagattaagtagatttatttttatttctaggttatgcagaggagaaatgattgttttattaaaatgtataaacagaattattaatacatttatataacacatattaatatacacacattccttcaaatgatttaatttaaagaatttcattagtaaattttataatgttggactatccctgcatttaaaaaaaataaaccctacttgatcatgatacattaatcttttgatgtgttgctatatttttgcatgctgtttttaaaattaattttaaattgagatatagtttacatacaataaaattcacccttttagtatataattccatgaatgttgacaaatgaatacagtggtgttatcaatacccctttaagtgtgttgctttgatttgctaagatttatgattgtagcttctaattctgtaagggaaaaggaccatacttttctattttccaatgttatctgtctttttctggatctggtatcaggcttattttaactttataaaaggaattaagaagatttttatctatgtatatgtttaggaacagtaaataacgggatgatcatctgtttcttaatgattttatagaacctgcttcttcctaggagtaaatctttgaccatcctttcattttctcctcatggtttttccctctggtttttaaatcttcttgagctacttttgattatctctattttcctagaaaatcgttcatttaatttaaattttcagaattactggcaaaaagtttaacaattgtgtaccaatgtatgtttttatttacatttatcttgttctaatgacatctggttaagtgtattttcttctttaccttaataggtcttaaaaattgttttacctatatttttaaaggacagctttacttttataattagctactctttgtcttgctatttagttcttttctggctttgtagtttttctttttttctctgtctggtaatgtcttccacttacactgtatttctgatgtggctggagtgcagtggcgtgcgatctcagctcactgcaacttccgcctcctgggttcaagcacttccctgcctcagcctcccgagtagctgggattacagatggggtttcaccatcttggccagtcttgtcttgaactcatgaccttgtgatacacctgcctcggcctcccaaagtgctgagattacaggtgtgagccaccactcctggccaaggctatatattatctacgttacatgataaacattgtacgacatgagcatgtagcattttataaaaatattcattgacatcatctcacagcttttgatatgtttcttgtcattaatttccaagtaacttataatgctatttttagttgctttacaaaccaataattattagacatttaaaaacatttttgaatgattaaattattttagagaggggatacattcttgtttttatattaattttagtttagtcacattatctcagaaaaaaagtgtcctgtatgactttctgtttctgtatttgaaatcccaatttgaagatctttgtattctaacacatgatgtttaaattgtattatttttgtttgaaaataatgcatttcaggattcatggatttttctcttgttttatgtatatctaatgattaaatcaactttgtattaagtaaatcttataatcactcaattttttatacacttgaatgactaatttctgaaagagttgtgctaaaatcgctattcttttaaaatggtgaatttctccttttttctatctgttattgctttatcagtttttgaagcagtgttagcataacatctcaataagtgagcaatttactatataattatttggttataagttttgtcaaaacatctttcttggtttcattttatgctttttacattgaattctattacatttggtagcaatgttgccatttatacttgctttttgttatccttgtctgttatactattatattttccagttttaacgtttctgtagcatttagttacatatgtagctctagccattctgagagttgctatgttttaataacataatttaaaccatttatatttattataatgactgaaatgtttatacttattcatgacattatattgttggttttctctatactgttttcctctctttggctgtattagacgtggctagccagatgcctgattaagctgaaaatccaggtaaaatctattttaaattcagagagaaaagttctaaccccaaccagctggaaaatggtacatctgtgtgcagttcactaaatgctacatactgctgtatggcatgaattctgcagcactttataaaaatatgccgttctcatatacaaaggtgaacttactgacccttccatctgtgagacatgtgctttgagctgcttttgatatgttggtgaagtgttatattgagccatggcatacatttgtattatagcttcttggggttagaatttaaaactgtggatattagacagttttttctctctctagctctaaaaagaattatatttttaatatttaataatctatatcttttggtaactcttgagctattttgactacattaaggtggtcatacatatgttacccaaactggaatgcttttgatcatgaaaagtgacactgttaataattcatgctggataaacacatatgaactgggaccatctagggcaaaatggaatatagagctgtcctaaccttactagttagaggaaagagatcataggtataacataaatgaaaatttgtactgtcactcatttacccataaaaatacttactaggtaaggtggtaggcagaacattcagcctgggtttagaggtttgtggggcagtaagatttgaattaaagaagagattatgatgctgtggcatggcttaggtaggacacattcaaactcctagcctaccccgtacacttgagtagctgtcagggtgaaactgcaaacagataccttcagaaaagaacatacaaatccagatttatccattttgcatactattttactcatttgtctgttatttacttattgtggtcatgttactatttttcccgtatctgtatattttaataattatcttatattgaatgaccctgcttgcccagtttttctcttttctctactgtaagcaacataaaagaaaatatttcattttatttgtattttctgctcttaactataatattttgcgtatttagatgtgagaaaatgtaatactgtcaggtcatttcttaaagtatggccttgtgtgatcctaaaacattactgagatagtttaagtttcaggtaaatggtggatgattgttacaatcagtattactcaatatattaagtccacattaggtctcaaaatcttaggtctgcatttgattttagagacatacattatggtgtgagtcatttttctataaatcaggtaaaaaatagatacattttgatgttatacgaaactgtatttttctaccatagcagttactaaatatacaaatgatatccttcaagaaagaaatgataaaactgttttaaattcttttatgagtgtattttaattataatctacatataatgttaatagttttcttatttgattagaggaaaattttttgggctaaactttattttattttgaatagtttagtgccattgagcttctttctgtatgtattacaaatttaatacatttaatccattttctccctcattgctttctttcccaaaaggacacaaggctgttaacataattatttggtctggagatgtcagaggcttcgctcaaattattatatatcaactttatttgctctctcttattctgtatagttttctttttgtaaattacgtagtatagctagattggctccctgtaaatatatctcatagcacaagaaatttaaaatatttccagcaatgcctgttttaaaagcgatttcagctgcacctgtgcttaaatctggccacctctagttcagagcaatattcaaacaccaaaagccaatgatgaactggacattactaccccatgtctacaaaggaagaacattaacttaacatagtgtggtgtctagaagaaaatgtacagcctcataaagtttgaggagacgtttttatgcactttaagcttcagtgtaatacctttataagacaggttctgcagagaggggcaatattatcttctcaggctagctagtattacaacacactttcgctgtaatagtcaaacaaacctttattgaaagccaaccatataccaagcagtgttctgggaattctggaaaaatataaaaatatgaaataatttgagatcatgtaattatgtaatgagtgagaatacatttaagtgctacagtacttccaagaagggagagtttagtacttgatcaagaaatttagactgaatgtgaaggtgacaggaaatcattgggcagagaggagaaaagaagatatgctggatagagaggactgcagtggaaggacatggcaaataggaatgcagagggcatgactagacatgcatttgtgttcactagaaattacagttaatggatttggataggaagggtttatttggagttcctcgagaacaaaactaaaaaaatatatacacgatatggttaatagaaggcagtcatgaaggatttttgaatgagaaggttacatgaaactatctgtattttagaaagttaaatatgactatgccatctgtaagctagattggaagaagcagctcaaggatagtagttaacaacatagttgttaagttttaggaacttttgggcatttgatttggtccgctagaagaaaggaacattattgcaaagaggaaatgcatattccttagtgtctctgggtttgtttgtttgtttttctgagacacaatcttgttctgtctcccaggctgaagtgcagtggcgtgattacagctcactgcagccttgacctcctgggctcaagtgatcctcctgcctcagcctcccaagtagctgggaccacaggcgcaggccaccatgactggctaactttttaaaaaagatttttgtagcgacagggccttgccatgtttcccaggctagtctgggtattgtaagttctcactttggagattgattggttttattggtctgcatagggatcatttattagcagtagctacaggaggtccatctcaatgttattaggttacattttctgtactgtaagcaatataaaagaaaatatttcattttatttgtattttctgctcttaactataatattttacatatttagatgtgagaaaatgtaatgctgtcaggtcatttcttaaagtatggccttgtgtgatcctaaaacattactgagatagtttaagtttcaggtaaatggtggatgattgttacaatcagtattactcaatatattaagtctacattaggcctcaaaatcttaggtctgcatttgattttagacacatatattatgctgtgagtcatttttctataaatcaggtaaaatgtaggtacatcttgatgttatacgaaactgtatttttctaccatagcagttactaaatatacaaatgatatccttcaagaaagaaatgataaaacttttaaattcttttatgagtgtgtttttatcttaatctacatatactgttaatagttttcttattcgattagaggaaatttttttgggctaagtttcctataaaaggcagatgtttttaagagtacagattgtgtataataatgaaatgtatctgtgcaagtaacattctgatttgtactttaattgctgtttatatacagtgtgaattaagaataaaacagtgaggtgagggagggaagaaggaatgaggaatataattagcatactcagtagtttggaaatgtaactgttttaattaacagctttgtggtggcaaaacaaacgtgctttgggaaagctaagaataactaggattgtggcatcctccttgggaaaaagttgtttataatcttaatgttttatttccttttggctgacagacaaaagaaaacaaagtatatgaaatatttgtgtcagaagatatttatatgttcagttttaccaattttatgcattattaaaaagatatttacttattaattcaactaaatgccaagcatactacttctactaatattaacctttgtctttgtatccttccagaattgcatttatatatttataagaatatgtatatagagtctatttattcatatttttaaaaaagtgatcacattgaaatcatgttgttttgaaaattgtcttttacttaactagacattaagaatttagaattgtttacttgcatgaatgggtctgattgtcaggtgatttttcagttcaatatttgtccttccctttgtctaaaatggtcttgatttacatttcttagctctaggcatgactagtagatagggctagaaaacaggctttcagagactaagactctcaaacagataaataaatatactaaatgagacatggtaagtgctgttaaagacatgccaatgaagatagtaggagtacaaaggaggagaaactaactttgcctcagggagttgtaaggaactgcaaggaccttctgctgacttttcctctaccctcttcaacctggttcttcacctctgcagtttgttttctctgttttctcctgcctaatactcactcatctgtgatcttttcccttatattttctctcacttaattggcattggtccacttcttttaaatgaaaaaagaagatatttagaaattacaaggcatttatggtttattaaaatatggaaaatgctttttttagaataaaaactaatataacacttcctactcctttgtcataatcaaatagatacgttaaaattgtattaattttttaaaattttccctatctgcaaatatgtggtgtccatcacaatctaagtaagaccatctaaaagtaaaccttaatataacatattttttcatctcttctttaaaataaatacatatgcaatatattatttgttgtggttaagttagaaaatacaaagaagactgggcgcggtggctcacgcctgtaatcccagcactctgggaggccaaggcaggcggatcatgaggtcaggagtttgagaccagcctggccaatatggtgaaaccctgtctctattaaaaatacaaaaattagccgggcatggtagggtgtacctatagacccagatactcgggatgctgaggcaggagaatcgcttgaacccgggaagcggaggttgcagtgagctgagattgcaccactgcactccagcctggatgaaagagcgagactccatctcaaaaaacaaacaaacaaaaactaaataaataagaaaagttatcaaccccaaatttcactgccattatttcaccatacacttttcctgtctttttttccccctctggtataaatatatacatagaaatactaacaacaaacacatttgcataaaaatgggtcaaaccatatgtactgttttatattcagctttgttcactcattcaacaatcaaataaacaactcacaatcaaataaacatctcattagtaattgcacagttgtcttcatttttaatgatagtgttgtaggactctctccttagttcagctaaaagcccgggggtccttgtcacagggccatgaaaaattaggcgtgcagacaatttgaagggtgagcacggtggggtttattggacgaaaaggaaaaaaatacacagtgactctccacaaagccagagttctgctagtgcacttcctgcctggcagactgaacccctgtaccacctaggaagaagaggggccagcctcgtccccgctgcaaacaacgcgaacttctgtggctccatcccagtgtgtactcctcccagtgtgtagcaggtcagttgcagtttttagtttttcccgggaacccccttacacttggctgtctcaataacatagctttctactctgtgactatataaaatttctttaacccctccatatttggttacgtttctaatcactgaccgaattagtaacatctttgtcaagacagctttgcatgtatgtcgagtcgaattttctcttcaggataaattactagacacagaagctctttgtcaaatgttacgcacttttgaaggttcttactacacattgtcgaattgcctcccatgttttgcctacgtatatgctgactagctgttaaaatactgttctgttgaaagacatttatgcatatatgtaatctttatattgtataccggaaccaaattaaataattgaattctatacaaaacatatatattattttgattctttttcacagttaaatggtcccaataacgaggaacattcctatactttacttcagagaggagtttctgtcttcttgtaaatttcccatcaaaatgcaaatacattgcttgaatgggtttaatattagtggatctttttggctttcctatttatgtgtttccacacatacacccacacacatttatatatatatatgtaatttttttattttttagacggagtcgccctctgtggcccaggctggagtgcagtggcacgatctcggctcactgcaagctccgcctcccgggttcacgccattctcctgcctcagcctcccgagtagctgggactacatacaggcgcccgccaccaagcccggctgattttttgtattttttagtagagacggggtttcaccgtgttagccaggatggcctcaatctcctgaccttgtgatcctcccgcctcggcctcccaaagtgctgggattacaggcgtgagccaccgtgcccagcccatatatatgtaattttttaaacatatatatatatatatatatatgctttttctgaaggaatgagcacttatgacttaactaaaatatttttgaggactaatttttttgaatgcatttttttctgtcaattactcataaaatttattattatggcctttttaaaatggagcttttgtctttcttcagtacttttatctacttattctatttaacaataacttaccaaaatattatgtttacttattcacttttattgctatacttacacttttagaagtagcagagtataaagaaatggaatctgaagagccagttttgattccttgatattacacctgctagcttgtgactttagacaagttgctcaacttctttgagattaagtttgcccatctgtaccatggagttaataacacctacctcattgttttgccttaagaatcaaatgaagtatgtttgtacatggggtttgtaatctgtaaaggccttcacaagatgcagcctgttatcatttgaacatttcatatccagaattacttctattgtgtaaattattatgattggaaatttgatgttaagtatcaaaattttaaacatcactacactgaaattttaaaatgaagtgtcatcttttcaaaatgaccgttttatcttacaaatatcatttgcaaataatttctcccttattaacttttattgtagataaaagatatattttattgatgaatattttaaaaagcataaagccattatatttgaggaacaatttttacattcttatttcctttctgaggatgtaagtgatgaattcttgatgaaatagtatcagtattgcttacatacagtggatatattttcattactgtataaataaattactacataaatatttgtttgaaaccaaatacatcttatgtgggaatgaaggcagtttgttgttcttggcttcccatctctgcccaaaaccatttcttaatctcttaatttctaaatacaatagtgtttttgaagaaatatacagggaagagtgctcaaagagtgagttgacttggaagtgtttatttagtcctcaaaaacatgtgcaaaatatcaagaaactttgtcatcttcaaatctggaatcattttagaagatctgctttgaaaattaagcttctaacattaagaaactggcttatccaactatcttgtttcaaggaaaatagaggaggctagttggctgaaatgaaatctggttcattattcactagccttagggataatcacatttaggggaaaggctataattagctcaacttgccttttacctcatgtgtggcaaaatctaattgtttcttctttccttttcctttttttggtaaagtctcctaatattgttctcaacttataaatttcagatttccaaaatattaataaaaaatagagttgtttgcaataattaaacaatatatattgacatgaacatagattcaaaaatttgtatctttaaaatttatactttggtgctgttgattgaacttctcattatactcagttatttattgtactatggctctttgttcaactgtgagtaattaaaaatataatcttacaaagatctccaacataaacaaatctgtgcttctctacctttgtttgccttcttacagcctccagaaaggactgggtttggaagtttattttaattagagtttaagagtaatgaacattaattacagtcaaacatatggacattcccagaagcatttctacaagcactatgttcattggcagactcacgcaaacttcatgatcatattaaaaattcttcctgcttaagaccattttgcttaggcatgtgcaagtttccctcgtattttttctgatatttgtggtttaaaatgtaaaacaaaagttttatcttctttccttttatatatttttatatttgcagtaaccatttttccagaagtatttatctatctttcaggttttttaattgaccttcattatgaacattctaatatttctgctattatttcaggagagttgaataactaggaattgtagttcctacagtctatgatttttaaaaatagagatggtaatatagaatataattttattctcgtaatatgattttttatgccccgtgcataagtatatcttgtttatattttgcattcctaatccttcatattgatttagccaacatttctcttaggaaactaagtatattaattgatttacatgttaattaagtaattttcactaggtgtacttactgtgaaaatgtaaaatttatttgctgtgaagctttcccaatagcctaagtgtatacaagaaatgtagtagggagcagtttgagaatttggaaagcctttaatggaggctgtcagacttccttttgccctgcaatttcacattatatgtgttctccatggtgctatgacatatgccacaaatcttgggctagattcgaagatgaagaattatatcatgtaaatcatcagtttgatagaagagttatactcgaagcacatcttaattatctttatattataattatatgaataagataagatttggatattggctatatttacatagatataaatggggatactatattgatttatacattttggtgagaagaatatgtatttctgttaaagttaccaaaaggtgtctgggtatgtcagggtgaggcattaaccatctagcagggatacaggtacacccaagtagttataaatgtatatattaagtatataagtatgtattaagtacagtaataaaaatatttttaaaaaactgtagaaggtggaggaaaggatgtagggggcaaagcctgggatgcaaaggcttccaggagagagggcacttctgttgtgccctattaaaatgcatggtaagtactgttaaagcgttgaggacaggagtgatgaggaagtggggagttagcttttggtgggagataggagaatgattatcagaagatggtgcatgattgggactttggaggatgggtagaattctgaaagacatcagtggagtaaaggatatccgggtagtcaagtagcaggagcaaagccaaaaatgtgagaacatgctgaacatttctgtaatactcctgtttggctgtgaagtatgtaagagggagataatgctggaaaaataggtagagactggattgaggggagcctaaaatgttaaactgagctgctggactcccatttgtaggaagtttttcagcagcagtgcgtaggatggcttagaaggtagagagattggaagcacagccatgtgctgtgtgtcaggaggcagtaattggattctaacagtgaggggcagatttaataaagccctgaatagggcagacagtgacagaagtaatgggaaggtgggaacagatgcaagaggcattgtggatgaggaattgacaagacttggcaatgcctcacatagggaggcggacaggggaggatttcaggatgagctgaggttttgagcccatgcgatgtggaggagggtggcactggcaactgagatagctatcactgagtaggaacaggactgtgaattgaattaaggtggtgaaaggacatagaggttgacattttcagcagtcactaggaattaagaggctagagtataggagaactcagctactgagtccaccacactgctggatagtgctgccatgataggaaattaatattttcaggaacaaatgattaaagttttgaaaatgtggcaaggccgtcatcatcaatgcaatgcacacaaaaaaactggatgtgactaatcggatgtcagtcaaatcacttaatctttcaacagcttaattttcttagctataaaataggaaaaacagaaccagttttgtatccatctcctaaattccaggattatattaaagctattgctttggtaaaaagtatgtaatatgcagctacatatatatatatatatacacacacacacacacacacacaaatatatatactatatatacacatatatattagtttattatattgagagaactccagaaagaaaaaaaatacagttaatgttttactttctttaattgtacattgtaagatattgcagatacaaaaatttttaaaaagaattaatttttattgggctcttactctgtgataggcacaattctatgtactgttcaaatgttaatttagtcttttaattaacaccaagacattgtattattttcattttacaggtgaggaaaccaaggctcagagaaattaaatgacatttataaagctaggatttgaacgcaggcacacagactccagagccaaggcacctaaacgttagttcatgttgcctcacactgagtaaacatctgctcctgagcaggctttattttgtcattgcatttgtattagtgtggccttccctggtactctcttatttctaaaactcttgcagcccaggtatactgtctttgctttaatgcacattgcatttctttgctctgaaggtaaattggttgagggcttgtctcatgtattatatagaaaattccatggcatagagagagagcacaggctttgcatttagtccaaatgcttgctttaaatggaagcctctgtcttgttgactatgagaccttggggaagtgtcttaccaccctgaatcccggttctcatctgtaaacactgagttatagagagttaaatcacataatatatatatataaagcctacagcatctggctcctaaaagtcaagcaccagggctgacttatcccttcagcacagtaggcacagtgttgagcagtggtccccaaccttctggcacccgggaccggttttgtggaagacaattttttccatggtgtttgggagtgggagatgttttctggatgatcatcaggcattagattctcataaggagcatgcaacctagatccctcacatgtgcagttcacaatagggttagtgctcctatgaaaatctaatgccaccggggatatgacaggaggcggtgctcaggtggtaaggcttactggccattcaccttctgctgtggggctgggttcctaaccagggtactggggttggggacccctggtatagataagccacaatacttttaggaacccaaaaaatgttttagtccaaaacagtattttttttttaatatcagaagggaaaaaacaaactttcaggttaaataaattgttgaatatatgatactattatattcatgttcatgccaatacaattgtaaaatataattttcttatttcttttttaatggaggaaggggcccacagtggcaaaaagtacctcagggccgtgaaagtcataacttagcactggaaatcactccttacttaggttctttaaacctcttctggtgtctaggtcataatgttttcttcatgcattttgttgattcattagccaactaatttctagcttatgtcaattaaaataaaactgacctttgttccctcatacaataagatttttctaacacccccttcctaaatagttaatttccttttctgggttacttctgtaccatatgattaagcatctcgcaccatatataaactatttatttgcacgtctatttctcctccttgacgctcaaagcttcttgagaacatggatcatgtcgtagtgatgcaggacttctgctccttacttcagctaaatctgatttcctgtctcacgaccaggaaaaattaggcatgtggacacattgaagggtgaggagggcagaatttattgagtgaaaggaaagctctcagcaaagagaggggttctgtaaagcaggtctgcccctcacaatgaagtaccagcacatgaaccgaagaggccaggctcctcccttgcatgaggcacaaattcctggtggctgcaccctatcctgaggtactgtttgcacatgcaggcccttagtctgagccacattgatttatttcccttactgcgcatgtgttaagggatggactttttcaccgtgggcatgtttagtcaaaccctctgtgcacaatgacccggtgggtcggaacctctggggactcttccctatctgcctaggtatttggccgtctccttgcctctatcagtagccactgctatgtcctcagtaactggcagaatacatgacatttagaaagtcagtcatgaaagttaggtgaattaaattgattctgtttggaacactgacattttattgccagccataggctaattcgtgtttgtaaatgtgctctgtaactaagatttcacctaaaactttatgtatctgaagtgaaaagttgtcatctatcctgcaatattatctcctctttataagttttctatactgttcagcattcttccctaccagcccaattatttcttaaaaattgaaaagttaaataaattagtttgtcaagacatcttccccttcttgctgaattaatttaattaacaaagggcctgtcaaaatagccaaggcctttgatgtctgcatgtatggattccagtattataaatgattctgtgtccctctgacctaatgggaatacagtgtaagggtaagaaatgagccttaattcctcagtaccaaagagagaccagcattacccaattacatctaggagacaacaaatatcaccactaggatttaagtatctagctttatggatggagcagaacacataataaattattaggaaattggttgctgattagtttgcaccatatagttggtttttttaagagactgtaaagtgttactttgtttttcatttatttttatctctcccattctctgatttataactttctcaggcttgaagagtttttacatcttaatagcttgttatatacagaaaagtgaagcactagagtggggaggaactgtgtgcagtttggacaattgtggatgatggtaccaattacatcacagaagttggaggaaagagtaatttttgttcttactcaagtctggtagtgcacaatagcctgtaacagggctggctactggtagagattatttttcattcttaatatctctgaaaaaaagaagtggctggatttagcagaggaaaatcagtgtatgctcatgtatagagattgaaagttcacaattttggcatggtctaatacttggaatttcatttttattaaataggttcttctaaagttgttcaaattcttaattataaaggaaggatggttggtaagaaaaatgggtaatgattaacttgatgtgaagttttaggggatgattttctcactttagtaataacaatgacagtacctattatagacatgacatttttcaatgttttcacaggcattatttcttttgatgctctaacaggagagttttattgtcatcaatatttcacagatgaggaaattgagctacatggactttaagtgatttagacaagatcttatacttagtctggcagtattaggaccaatctgggtattattcttatttaaaatctcatattattcatgccttccttgcttctaagctctttagttcagtaagatctaatcacaggccggcctcctgctacaattggaaggcaattcaaaacaagctttctctgaccctttccaatctcgcttccctcagattcctcattcaccttcattggccacttggaccttaatcgatgcttttgctccctctgacttgggtgttacatgtggtctgtcccttatttgggtttggtctgaaaacatatttgtcttattttgtcgaattaactactcaattatataccagaacagcaggaagtttagtttctctttcctaaggtttttcctcttctccttaattattcaagaatcctgaagtttgctaaatccaaaggaaccattctgccttctaactgccaagcagagagcaaatttcacttgagccattggctcctactattgcttccaactgtcacacagtgttgctatggtatatttatcttgcacactaccatagctaatatttattcactattgatttttttgctcttgtgggtataggtcccttattatcttacaggcatactccacattgagtgccatgattacaagtctttcaattcacatttccaggtccaatcattatttcccaaactaggatagcattgtggcaggtggctgcgtttagaagggctttctgcataagcctcaggctggaatcatctctcatcctcaaaaacatccgtgtgtctaaacccaagattccagttggtattctccctttccttaaggcattttatttcagtattttattgctctttcctccaacagggatttggaagaggtcatctttatccatcttgataggtctcccaaagtttaaattttagggagcaagaccagagtccttcttccaggaggatcagggaactcagcaaatggcatctttggttgtcttccaaattctttttctcgcttcttcaaggaagaagatcccctcatacttcatattcacatgactaagaagataccttcaaggggccaggaaaataaatgtctttatgtatggaaaggctggtacaattttaaaataaattcccattgggcattctacttaatctctttgaacatgcctacatcacacttatgtttgcataatgctctatacagtttgcacttgtatatttgactcttacaaaatgcagtgaagtagctataacactttaatctcttcaattctaggtagaaagattaaaacctatgaagttagacttgttccagatagctagtaaagggatatattagtttcctggtgctgttgtaacaaagtaccacaaactaggtggcatcaacgacagaaatgtattgtttcaccgctttggaggagtctgaaaccaaggtgttggcaggtttggttccttctgagaactgtgagggagaatctgttccatgctggtccccttgctcctggtagcctgaggagttcctttggctcgtagatggtgttctccctatactgtaacatagtcttccctctatacctgctcaggtgtccaaatgcccctttttataaggacatcagtcatattggattaggacccattctaatgacctcattttaacatgatcattggcaaagacattatttccgaataaggtcccactcgtaggtgctgatggttaggacttcagtgtcttttatgggcaacaaagttcaacccacactataagttaggttttctaaccctaactgtcacaagattttcactatatactggagtctcttgtaatctaaaattttttcaatcactgttaaagcatttgttaggaatacacttaattgttattgatttaatggctcctgattcttttacaggatttttttgttgtttttaaaatttctttttaaagaattctcaactgaatcttgacttattgttttatgataatcaattttctaagagttacttctcaaaatccttgagatacattaaaaaaaatggttaggcttttaaagaaaagccaatagagatgtaacacctgttaggaaatgcagattataattgtaatgtaaatgtaattatacgtgtaaaattttttgtgtctagtaatattacccagggataatagaatgaaaaatttattcactgttgcttggttgctcttgtgtatataaatcccctttcagctcacagggataccctatgtgtaaagaattttaaagttgtaaaatagaatgggcgcttgttactatttataagcatggcatggaataatactgagatgtttcctacatttgaaaaaaatgaatttaactgtcattatcttttctatatccatttaatattcattagtacagtagtttgaaaagtgggctttagagtaagaaaaacaaatgtggctgcatctcaactgtgctgttattgtatgagtgacctttagcaagtagtttaacttccaagttttagggttttttaatgtctaaaattgagataagaagaccattttcctcataggatttttgggaatattgtctaagaaatatatgcagcatgcctataacaattccaggtactttgtgagcagatgatatacatcaacaatattgtcaccaccagttaaattaattagttccattgaaattgtgattactattttaccctattaaattaaaaccctgagcctgaaaagcaggagttgctgggattctgtgcttacagcaatattagaaacatagttggcaataaattattattgttttatgtcagagattggaactatgagtcttatgggcctactgttttcaatacgtttttctgtaccaataataactttaattgttagaacctatccagaaactcctaagattaaaatttttttgtgtgtgtgatttggctattgatttttgcttttcttttttagcaccagatatcctttcttgtttgtcccaaggcttttcattatttgttagagtgacttcatttcatggtattatctacttttattttcaagtgccaatttattaacttaaaaatgcataaaaataaacttttgttgtgtaagtaacacatttgcatgtgggaagaaatggatgagtgcacacacacacaattcaaggcacccatagtcctacaatgcacacaaacacatgtgattcaaggcacagatagtcttacacctcacatagcatcagtgtttgcattttgagataccatatcttaatgtcatcttttgacttttacgccatgttttggtaaactgaatttcgtctggattgaaactctcttctgcatagctaacccctttggtttcaacaatgtgcagagaagagaactcagcagcaagcagagtcaataggggttctaacatctctcttccagccctgggttcctttcatgtaaaggtggcatccaataggactgctgaagtagcatgaattcacaaatggaaattgatttctatcaattctatatgagctagattatcttcataaaatccaaacagtctgattctaaaacacaattggccctaaagatgttgaatgagagttgggaacttgtattagcatagggaggtagccaaggaacagtgttataaggagaagagccccagaaaggcagttatgtctcaactgcactgtgattttatgaactctaattctgttctggactcacactgctcaataacgaggatgcaaagcacctgcagcctcctcctctttattctgtccatttctcaccatgtcttgcagaccaaggcatgtttcctgaattcctagacttaatgctttctgttccattaacgatacttaatacattgccttcttcaaataaaacagatttcctttgttataacgctacatgacggtcaggctagaatgatcctttgctggagccactttatgaatcatacctgtttgtgagattgtaacacaataaattccatgccatcgttttgtctctgaattgagaagaatcccaagaagggcaaatgtcacacttaaatgctatggaaagagaagaaaaggaaggactggagaagaaaacaaaataaaggaggagattcatttttccatagtggatagctacttgaattatttttaattattgtggttaaatctaccaggaaaaggccaggtgtggtggctcacacctgtaatcccagcactttgggaggccgaggtgggtggatcacctgaggtcaggagttcgacatcagcctggccaatatggtgaaacctcgtctctactaaaaatacaaaaaaaattagctgggtatagtggcaggcacctctaatcctagctacttgggaggctgaggcaggagaatcacttgaacctggagcacggaggttgtagtgagctgacattgcgccattgcactccaacctgggcaacaagaatggaactccgtctcaaaaaataaataaataaataaagttaacaggaaaacatttagtaattgtgtattctgtttccccctacaactactgtgagtaatctgcacttttatttctcttttggcccataagttttacattaatcctattttgctatttactgaataaagggaattgagaaaaaggcatttctcattccaagttagccctacaatgccaagtgtaaaaactcaggcctaagtgaagtttgaggtcaggataagccaggctaacagatctttctggattttactttgcatctcattcattcattcatttattcatttaactgatacttattgattactgaggatgtgccaggactgtactgggtgctgcaatagtagtggatgaaacagtaaggtccctattctcatggagtttgactagtgggaggatgaggggagagcgacaagtgtcagtatacagtaaatcagtgaacgagtatttggattatataactttaaacagtgaatggggctgtaggaaaaattgaatgggtaattgggtagagggactggaggataggtaggtaccgttttagatagaatgatcagggaaaatttctctaaggaggtaggattagagctgagaaagagacagatctaagggatgtattccaaaaacagggatagaaaatactactaccctcagataagaataagttaattctgtccaatggcagtgagggggccagtgtgtaaggtacagagaattgaaggacaggggaacttggtgaggtttgggggtttggtggggtctatgtgccacagaaagctgattttgtttttgtcacaatgggaagccattagaggctttgaagcacatgaatcaacatattcttatttataaaggccattctgggaaaaacagtgaaagaaggaaaataaattaagagactttccaagaagtgagagacattggtggtttgagttgtaacattagaaacagagagcgtcataacattagaaacagagagaagttagaggattcaaaatacaaaattgagctgctagtagttgctgttgtattgatgttgggatgaggaaagagatgaatccaggatagtttccggttttgggatctgaacaaatgggaaggttatgctgccacttactgaggaggggaagacttattagcagactagccagtttgatgtgtgtttgggggtactgtggggaagtacttaaaggtcacttctttccccttttgtgtccttagtgctttgtggtgactcaggaagttagagtgtgtacttttttcaggtgatctttcatgagctgcctactctgaacttcattggctttgatttccattgcaacctaatttttgaaataccaaataggagtatcattcttctccctgcaaaaatacttatgtgtatgaagattacacaaatggccagttctcagtaaatcatgtgttcaaagttgtggttccatatagtgatgggtttatgtggaaacagacatcctcatcttgcttcatctgctgtgtaatcattaactcatgaagataacaggactgtctggggtcatgggctgtgggacagaatgaagctccattttctacaatggagagaaaatcccaagaatcagtattttcatacacgaaattaaccagcaaaaatcttcaagaacttaatccctttccagtgaatgagtaataaattttttgttcttcttttttcgtattttgtagtcaaaagctcatgtataccgcagggttttacaacactttctgtctttaaatttaaagcagcaataagcagacatgttctgtaaccagatccaaatgttctggtccctgctttaagttgagaaaatctgatttggcaaacaaataaatgagcaacaagaacagcaaaactaacttgacaaaatgggtcatttagtttggaaaggggtttattgtagaatgcctttaaataataaacaacattaaaagacttaaactataatttcataaacaattttacagagacacatttatttcatctaacattgaccttctgtaatgtgttgaatctaaattcttaagttaaagcataaagtagcatggggatttttacttcattttcaaagaaaacacaatataatctttcatttcattttcctcaatgaataaaatatttgtcactctgtgttataatgtgagcgcttctagtaatttttcatttttacctgaggtttcttttttacccactgctaagttcatttctcaggtcagcaataatgttgggataaattcataaatagttattctttgaatggtgaaaataaaatgtgttttattcatgagtaagtatagtgtttgcttgttgctgatattgtatttgggttgaaatacatattttctttttactattatctattttaaataattctggaaatacagtatgacagattttaatcagtaaagcctagcattgtatgagggtttttttctcttttcaagatagtgtatgtgaaagcatacatcaataataataaaagttgaattcagatgaaaatgctttgaaaatggtcaacatatgcaaatgtaaggtatttttattattgttattgttattctttgtcattattaaggtatactcgataatgatgttagcttggtttataattcaagcattaggtaataaagacaaggtacagttaattctgcattggagactcatattaacaaacgtttttggtaagtctattttagtcatttcatagagggctttgctggaattgtattgcttcaaatacttgttttcagtacttttacattcttggaatacttgcatttagatttttgttaagaggcagtatatggtatggtggttaagaatgtggtctatacctatggtgtcaaactacctgcattcaaatatcacccaagccacttattatctgcaagagcttggacaagtcatatagccattttatacctgtgtttccttatctgtgaaatgacaataataatagcattcagttttgatgatcaaatgtgctagtttcccagatgtgaaacattagaagaatacctggtgtatagtaaaaaataaatgtcagcaatgattatttcttacacaagcctggtgaaaattcaagtttactggttattaaattgcattggttctgtttggggtcttcctcattatgttcagagatcagcaatgccctgaggttttttttttttttttttttggcggggggtcatatttgcctgattatatctcatcgtcaagtagaaacactaaaatacataattcaaaacaaagatttgatcttcaaaagggaaagacaaagcaccatctcaaatttgctgtaccgaagggcctggctcagtgcctgacacatggtaggtgctctgcagacctgggtccacccatggattatctctgcccaggattctgacccataaaaggaagggcattctttccacattcttggtaaatctgtgtaggattcttatcttaaatgtagtctttaaccttaggagactcagaaactttgaaactatagtattatgactgaaatattaagctttttaaaaacacatactttagttcatttagctgtctaatattttctctgttcttaaatttgcaaccttttaaaatgtatggttttaaattacatagtggattattcaggtactcatctaacatttaaaatgtaaacagtgcaaatttttcttaaaggcaagaagcaggggattatcatatgtgaaagggagtagaaatatgatctttttattcttgcttgcctagattttgcagttttaatcaaattggcatttaaaaatactgggctctatctgttaagaactgtctgttgtttatagagatttttaggtgtaaattatctagccagatgtttaagcaccaaagggaaacaagttaaatacaattaacccagtcttcatttatcaagtagttaattctcagcggtaggccacaaaatcagtcttttgatcccaataatatatataggtataactatttagataacataaaatgaaagttacaaagccttattttgaaactctttaagcttggccaaattagggaacattttattcaatataggtggcttcccaaattttggttactgattgcctttgtcattgcctttaggacaactgtagactttgtggatattggaacagatataataattgtactgtaatttcccaccaggtaaatcacataattattatgggagtatgaaaatatctgagaacagggacagggtgggggtgtgtgggatacatacacatatgcatgcagtataaaaataagattgcaaaatgttgcatcatttcagttgctcaactgcagctcaactcaactcttgcatagtcccctataacattgtgttagtgtggaatttaggtacattttaatatgtttcatatgctatgaggtcggacctccctaaaacaatagtcttaggatctataaagttcttaaaactcatctgattatggtgagtttttaaacattttgcataattttttaaattctaaaagtattatgaaatgacagaaggtttgggtttgggaaacaaagggaggaaaaaaatcagctactacttaacaaaaatcatttgtaccttgctctatatctaaatctatatctacatcccattgtactttcaggcttgtactttatttcttctatgcacctacagtgaagttttaaatattctgggctctgtgtataaaggttctgagttcttcagtattcctgagaaggagcttaaaaatactgtgatttttataagtcgcattagagacctaggaaatcattccaaaacattaattttgagccaaatttctaatagggtattaaaaacaggggtatagtggaaattgtattaaataagaatcaggagtttatgttcaagtcgcacttctgacaacatgagttctatcagttgaagtatgtttgcgatacatgaatgtatatgagaaatacacatatacagtcaagagaataagcaatgattcatacgcattccccagaaccatgctttatgcttaaacaagatttatggacttgttttcttgggcttgcatttccctgtgagagagtattttacggtgggctggaaggtgtttctgtttctcttggttaacatatatggggagcaacagaaggtaacaggaatgattgagagggagacaaagagaccttgggaagggtggatgagagcagtggggaggaagaaagaagggtaaggatccaattatttacttgacatctatttgcaactctattaagtatggagataaaaagagagatgggtattaaggggacaaaacacagtggagattttagctacccccagtgttttcctctggctcactgacttccagttatcctctttctttgcttattgttacatgtttttggatatcaaagagagtatcctaaaataactttgatacagttaatgatcttagtggaatgataggagttttaaaaaagaacaaagagcattccatttgtattatagaacaattaaataaaaatccacttacagccataagttgcaaatttttaaacatatatcatttacttatctagctcatttttacctcatctgcctatgtaaacccatcgttattctaagtctcccttaataaactaagatttccttcttactctaatatttgagatctaagtacaatccaaatgtcagaggttattgttgttgttattatttccaccatggagacctccgattttctaataaaatatttttataaattttactcaacacaaattagtttacttttcatgctgtctccaaaagtgaggaagtagagtagttaagagtcataaattcggagcctgagttttggggtttgatgtaactccacacctaactaactgtgtgaccttgagcaaattacttcaaccttctgccctttcatttcttggtctataaaatgatgacaattatagtaattttctcataatgctgttatgaggcttaaattagttaacttggggtaagtgcttaaaacagtacttagaacacatagctcttcatatttcagtggttctccacgttggtgacacattagaatcacctggggagttggtgctcacctcacccattaaatcagaatctttgggggtggggcccagtactgggagcaattgaaattgggagcaattattgaaattgctgaggtgattccagtgagcagccagcgttgggaacgatggccgtaaatggctgtaattatcctgctgactaaattataaacttcctgagggcagggagtccattacttctttttatacatccttcctagtgcagctagcacagtgccttacttgtaactaatgctcattaaatactatcaatgaaagaaaacatgttgatgatattttagatgtgtaaagaccttgcaggaccacagaggtgctaattttaagcattaattattcattccctcatttattcatttatatgtgctacacactttggagtcttgatgctaaacactgcaggcatatatgatttgaaaatgcaatccctgttccaaagagtttataatttagtatgaataaatgcatacatgactttaatagaagggaaactaaccatgtataagtgctgtgttacaatttaggttcccttggaggctgtctctaagatggagcatgcagagcgtttgtttggaagtgctcttgagaataacacctctgcgtgtgctggggaaagggaaagctatggaaccattgaaatatgaaataattggacagggaaagaagttaggttttgatgcattccaagtgaagttttcagctaaccccacaggagctctggggctggggtgactcttcagagtcttaagttgggctgcagggggccaggtttttattcctgcatattgatcagtgcttggatacagctgtcactggaagtagtgaccttggatgaggcatgtttctttagcagaagcaattcccagatacaagtgacagctcagggtgccctctggcagttcttccccggataggggaataagtccttcattcctaaaggaggattcgagtggagtgtcaccgcgtccatcacatgcaacaagagataaacgaacaaaaaaaattatcctggctaaaagaagagagatcacatttatttagatggggaggataagagttagggtgaattgggaattactttttcaaatggatgccattacaatttgatatttaaggatgggtgagatttcaagaggctgaaatgaggtgcaaggtgttcctggtataggaaacaatagaggtaatggtggggaggtatgaagtatagatttgtggagaagcccatgggtctagaagctcaggctaagcagcttaggcataatttggttgactttcaggagcagggaagaatatgtgccagtgtgtattagaaagattagcctggtagcaatatggagacataggtggggcagagcttgcaatcaggaagattaggtaacaagccaatgaaataaactacactaaggatcaatgcaagaagaaaatgcatgagaaaggcaggaaagcagagaactgcaaagagctgagtggatgcaggaggcagtgtagatgtacgtgggacaggtatgacagcagacaaaatgtttctatgtatgtaaggtggtgtgagtggtcagtcaccaggggatagcctagtgaagagaggcacagtgatagagaagagagccagaaagagcagtggctttgatccattatccgcaaaggaagagacaagtgtgaccaaggtttttatagagcattgagtgtgcatgaaggtagattactcatgttgatttgaatcctgttttcttgtattactatctgggactttcttggcaatgtcagaacattctgtcatggccatataaacagcacgtatgtggtctgagcccagtcatgttggagcactgtgctagatggtactaggcaaagctatgaaatgactaatatttgttctaaaaatgctagtcatcagtgttttcactttctagccatcccttccaggcctttagagtactcatccaccttctatcttccttcttccctgtcaaaaatggtcgcttataccacagtgatggtttctccaattatatgtcatctattcctgaagtatctgtagtcataggattcaattcaaattctctttaaatgaattttggtgaataatattattttgagcaagtgggcttctgagcccctggaaatgatgttaagtgtaaggccaccctcggtgatttaattttgagggccagtattttcaggatttgaacaaagtggaaaattaagtgatttttgcggcttcttaaccttggaaggaggtcctggaatgatataaatactgccttctaggggactcagctgtgggacattgtatgacttaatattgttttaatttcttttttctcctctctgtcacaaaaatgagatggatgaactgatcatcccataatttttcattatgaaagaacttttcctacttcatcttaatgtctagggtatttcatttaagaacagcttaaatgagccctctttcaaaataagctgtcctgtaataccattagttcccagctagtcactttgtgaagtcacagaactgtgtacaatctctcttttgattctaaaaccttgggagaaagtaattgaagtatagacacttgagagtctcaattttattgctttgcaaagaaatttcaatttagagtttatctaggttacagtccccaaatatttctcaaggaggataaatcaaatttgttggagagttcctagtcatgtatcattcagtcctattacctgaactgccttgtttgacattgtcagttggaacactctcttggctatgattagaactcaaccttggtttgggtgacaactcactcttcttgcttgtttctctctttctcgcttttaactccgagattcaacatagttctttgaaatgatttatgtttcatcctaagtcattagtgtgtgcttccaagtggccaatctttcctcctttgttggttaatgtttataggaaacctcttggagtaatgactcactgtgatacttcatcacttgcctgcctccttatatttgagactttacccttctttgcatctttaaaacatattctgctctctcagtggtgaatatgattctatgcctgctctatgggtaaacacaaaccattctctatgtattaggaaagataaatgtgtgccactctcctctgtttttctgcaagaaatgttcttttatctgcagactaagaaaccatatacaaaactcatctaggttgcttcacagatgattattcatcattagagtattagaaatcaaatgaaaggataatatgtaactacttttaagaagtagttctccttttaaaataactagctcactcaagtacttctattttttaatgctactttccttactcagtaagagtcaagacactatgagactctgcgaaatttgaattctgcttgttaccgaaaccctgagcccttatagatgatgttagagagcaccttttccaaattccttcaggcgaagcctcgcaatcatgaaagaggggagaggaatgctttggtggttatttgtgcaggtgataatttgtacagaactagacttcagagtcttggagctgaagggagtcacaaaggaaggtttcttcaatctctcttcttttgcggaaagaaggatgtcatcctgactaaagtcataaagcaactagcaacctgagtaattgaatgatttaaccaaagctcactttaatgggtctgcggtccacacctgccctccaatccctatgaatttttttttcatcaatgtatcccaagcagctaaaataatgcctggcacttagaaggccctatttgctcatttactgaatggatgaattgatgagctgagctaagggaaaaaggaattcaaaatagcagttgctttcctcttaggcagtgttttttccaccacctagctataccttatcttgtttgtgtgttttgagaggcagcatagtagaatgctcaaatacagatgttttggaaaagaactgcctatgttcaaatttctgcagtgtaatcttcaacaaattacttacctctcaattttcctgtgttagagataattatagaacaatgtctcttaggattgctgtgaggattacccgagttaacttgggaaaagtacttaaaatgatacctagtatattgttggcactcaatctgtgttagctgctatctcgggaatgggcagtcagtggcatgtggtgtaacgcacagggttcctccctggaggcaagtctggaacttgacaagctcctctgaaacaaggtggaatcatggggtttcagcgtggggtgctgaagacttgcactatgcagctctcctcacatgccacattgagtcccagatttctgcaaccacagaagtttaagagaagctttgctgaaagtttgaaaccagtgtgaatacattcatatggtaaataacagagcctctgaaaaggagacaatgagatgcccaagaaattctatgggctttagtgccacccaaatagaatgtctttattggctcagctgctcattagctgcctgtcctggcaaaactattcaaatccttagaaccttagttttcttacttgtaaatttaattaaaaaatacttcttgtataaaatatgaaataacaggtacatgtaaagtgctaagtgtatcatagagatgtaataaatgataagcccttaaaataacgatcatagccataaaaatccaagggattggaaaaagcaatgcacatactatgtaaagatatcattatttcatttgcttgcttcttcagaaagtaacaaggtggtttctaggcagtcagtgccatgcaagtattttgtctcaggagcctttgttcttgaaatttttatccatgaactctgttaaaattataccatgacttcaaagtcatctctgattccaaagcctccctctaactaggctgcttgcaggagactttggtgtctttcttcagtagaagaagaaagaaagagagaggaagaaaaggaaggaagggagggagtgagggagggaaggaaggaaggaggggggaggaaggaaggaggaaaggagggaaggaaggaagggagggagggaggaagggaagggaggggaggaaggaaggaggaaaggaaggaaggagggaggggaggaaggaaggaggaaaggagggaaggagggagggaaggaaggaaggaaagaagggagggagggaggggaagggagggaaaagaaaaaaaggagtatagagataactaggcataatggacatcaaggccaattttgtcacccatttgtattccctatttttccctttcttttggagcttattgataatgaggtgtttcatctgacttttgtgagtgaaatatggctgttatcaatccatactaccttgtaagatgactggccagcttagtctgcaataacaaacaactgcagaatctcagcgcttaaatcaacaacaaaaggttatttcttgttcgtgctatgattccactattgattagatgggagctctgtgctgcttcatgcttattcagccaatagagcctccactgtctgaaatgttgctagtggccatcatgggtgagggaagatagcaaattatgatctggcttttaacacatatctttgtctaaaagactatgtggccctgacatttgtcactttgagacaggaagtaggctggaagaggaatgtgtcaaatatttggtgaccagaaagttgagtagtcattatttgggattcccgtctattctggttctcttcttctgcatacatggtagggttgcactttgatgcccatttgaattagccattggccagtgaagtgtgcataaggatgatgtgccacttccatgttgaagcttcaaaatctagcgtgcagtttggaatattctttcctcctgtccaagtgacccatatgtttatggctctgtcagtctgggtttttgaatgaagacaaggtggagtagattgctcccaccaacctaagatggatgcgtactatgagcaagaaataatagatttgtgttctgtcattgagatttgaatgttgtttggtctggaacatatcctagcttattctaaccaattctgatagggaacatattaggataaatttccaaaagttaaaaaaaaagttttcttttgtttatctagatatatatctcctcaaatttaatgagcccagaggcaatttttcagtatcatagggagaaaaaaattacgtaggctcctttgattggttcacttgattagtggtaggggtgctggtgttagtaagaggtcatatttgggaacaaggagctgtctatattaattatagctgcaggatgtggttgggctgtcaacttcttttctgctagacagaaaacataatttagggatccatcacaaatacatttatcctaatgacaggatatcggagagcacatgattttcatacacactgtctttcctttctactttttctttaatttaaatgagtttattatatacttagatattttaaagggaagattcttaatttcttagctttgttttatagaaatcaatgaagaaaggagggtattattggcaagtgggaaaacaataggtttgtattccaagcagatggtttgtggacctcaaagatttcacattctctatcagtcctgaaaattagacagagttatgaaatcaagtacagagcgtactactgattcgctgtgtgaccttgggcaaggcacttaatcactttagatcttagtttcctcattttaaaaatgaggataataatactggcataagtcacagggatgttgtgtggataaactaattaatgattgtaaaatgctttgaaagtgcaaagcgttgtataattgttaggtgctattattaagaagtattattactgtgttgtgtgtaattcttattagggcttctctttgctttgaagtcagcctccacgtggactatggggttgggataagtttacagatgtgctgctcaagtgccttttttgcctggagaaaatactcagtagctagggtaatcatcattatgaagaggatctcttcaagataaaaaagataggaaatgatctcctttttaaaaaatggaaattgctctaactttaaaagtatcaatcaattctttaaaacctcatacagccctatgtttcaggaaagtctaacatcatgcaaaatttgaaacttcaggaattttctgctcagcataacatgggaaatgttgttgctaagataactttaaatcagctgaaccagctctttctaattttcccacagtgtttgcttcaaggatgaaaacaagtgaggtatcctctagaggagagaaattctgagctgtggctgtgttttgcatgtacaaaaagttaaaaccccaatccaaattaatttttatttgttttgtagattctccgttgggaagtgtgtttctaggtacataaaaacgagctatttttctgaaggtcaagtatacaccatgtttatacgtgactacctggtgcagctgagcaatattgactttgatgcaaaaagaccacagtcaggccttgggaggatttctcattagctgtgtgagttttaacaaaataatttaacatttgcctcagtttccatatataggaatgtgtgtaaaataattcctgcttacctaataggctctggaagagctcaaagaaggtaaaatctttggaaaatattttacaaatacaatgaaataattaaattgtattacattattttatttaacattttaatcatttttaatgtattcctgagttaacaagcctctacatatatttccattggataataaagatattagaaactcaaataattttcttgcaatgatctacatacatgcctttagttttatatcccatgacatgaagagaaagaagtccatatgcactttctgagaagttgtccgttaagtaggtcaaggggtatctgagatgtgagcgggtagctttggtcatttgcttttctatgattgcacacctttttaaaaaaaaatgctgtgtgcagtcatatatgtgtacagcattaccttttaaaatcaccaggaactaggaacataggatagatttgtttgctatgcaaatgaataaaacttgtaccaaagaaatctaatgtttaactccaagacacaaaagagttgttagagtttgagcttattgtactatcataggggataaaaacttccagaaacttctgagaggccagaagttttcagagtctagctttctaggatctgaggacgaaagtacttaggtctacccttgaggcaccattattttctaccaaacatttcacttcttgtgatcgcctaagtctttgcaagaagaacaaatctcacaatccatttatttactctcctaaaaatgttgaccacgtgaaatgacaatcagtataccacagttgtttatcccctcagtggtgccagagaagaggtaatggcagagtttgtaaggtttgctttctaatttttgtcttactggcatattttctatggtagatgctctggtgggtacccagatccccctttcagaaccgaggcactatttccccacctactggaagtgttgtctgctgatgactcacggctaagtccctctactggacttgactgctggtgcaggaagctgccctctccaaggtaatgcctgcctcccaggggctagctcacatccagtgactcaacaacatagatagtacaaagccacagccccttgttttgatgaggaaactcccaaagactatcttaatgccaaagttctctgtaagtttggctgagacctgtgttacaactgaattacagttttttttgttttttttttctcaaccaaccttgaagccatcaggctgatatctagggtcaattcccaacataacatggacaagaatatactgggtctgctatggaaggaagctcaaagagccatgtgttctccaggaattgggagcatatatgttggactggatccagagggtgctggttcaaagtggttggaacagaaagttgaataagggagagtttatgaacgtgggatcacttgctaatgatagagaatttaacaccctggcaagggctttgggagatggtgttaacatattgctaaaatgattcttgaaagcttggtaaaaatgatgaccaatactataataaatagaaatgccagaattttgctgtagcagacagtggatgaactaatcaaaaggctcagagaagttgtgttggtacacagagggctgaaaaactaacagatggtcgtgttctggaggacctggagccaaacagataataaaaatattagtgagaggagcatcatcatccctgaaaagccagtggtagccatcctctgttgtccaaggttcactgaaaagatgctgttacagaattggactctctgatagcaaagaaaatggtgatgagcataagtctggcccctacaaaaaacatataaattctagtgaatgacagagggctatcacaaactcaaccaggcttcaagtacatggttggcagccattgatctggcaaatccatttcttctcatcttatcagggaggaggaacagaagcacttcacattcacttgaattagataacagtaaaaacttacagtcttgccccagggctatgttgtctgtcttggactcttaaggaacctggactgtctggacatctgctgaatctcacatggatctgttatttgatggcataatgtttatcagacttatctgcagtaagtggcaagtcttggtaaggcatgtgtgatctagaaggcaggaggtagaccttatggggatacaggggtcttctccatcagctttaggtgtctgaggcatgccgggacagcctctccaaagtaaaggagaaactattgcaattaagcagtgagacacgttaagaaggaaacacaacatctgacaagcctctttgggttctggaggtagcatacatatttcacacttagtaatactgttccagtcttttactaagggacattttaatgctgtcaactttgattgggttttagaatagaaaagagctggatagcaagttcatgccacagtgaaatcagccctgccactagagtcatataatctggcatctcttgtgcaaaccccagtaggaaaatgacaaaacagaaccatagggttaggagcaaagacatgccctctgcagctaataattatgcacctttggaaaaataactttagtgtgtgctactgggtgttggtagtatgaagcactgaaatgaaactactacatctgggattgaacacagcaaaggccagaaggcagaagaaaactgcatgagcaggtggcccctttccacatgtgagggaccacagtggaaactgcacttcttcctctgctcacaccaatagctgcatccaaggtgggggatgttatcctagttgataaagaaggaaaaagtatgagcttggttcatgaatttatcagcttattagatgaatgccagccagaaatgtactgctgcagcactactacctcattcaaaggtgcctctgaattatagcaatgagaggaaatcctcccaaaggtcagaggtttgcacattgcaccttttgtatggtccaagttaagaatatacacaaattcatggttaatggtgaatggcttggccggctggtgagggacctaggagagattgaaagattaggctgggtgtggtggctcatgtctgtaatcccagcactttgggaggctgaggtgggtggatcccctgaggtcaggagtttgagaccagcctgaccaacatgaaaccccgtctctactaaaaagacaataattagctaggcatggtggcaggcgcctgtaatcccagctactcgagaggctcaggcaggagaatcacttgaacccaggaggtagaggttgcagtgagtcgagatcgtgccatttaactctagcctgggtgacaagagcgaaactcagtctcaaaaaaaagaagaaaaaaaagaaagattaggaatgagggggtataggaagtggtatatagatggacctattgaatggtcatgaagtgtgaagatctttgtagtatgtatctgttaatgcctgtcagagggcaatcaccaccgaaaaagctctaaaaataaaatagagaaaatgaccgtagtcattggccactccaatgctgacacaatgattgcatgaatggagtagacatggtgaaaaagacagagtccatgaatgggccatatggcatgtattcccactcaacaatattgacctggccactgctgttgccaaatgcctaatctgacagcagcagagaccaacactgagcctccaatatggcaccatctctttgtgagaggagccagctagttgtcaatgaatatcatcagcccccaggtatgactttgcctttcctaacttctgaagctcagctggcatcactgtttgagggctttagagtttctgggttttttttgttgttgttgtttttcagatggagtctcactctatcgcccaggctggagtgcaatggtgcaatctcagctcattgcaacctccaactcttgggttcaagcggttctcctgcctcaacctgctgagtagctgggattacaggcatgcaccatgatgcccggctaatttttttggtatttttagtagacacagggtttcaccttgttgattaggctggtctcaaacttgtgacctcgtgatctgcccgcctcagcctcccaaagtgctgggattacaggcgtgagccactgtacctgaccaagtttctgttctatcaacattgtgtatatattacattgctttagatcaaggggcacactttacagcaagggtagttgtgggggtgggcacattacattggatgctatcacatatcatacttcctagaagctgtcagcctgagaaacccatggcacggccttttgaaggtgaggtagtagtttggcatggcatctgcaaggaaccagcttggagatgatacctgtggggttggggtgccatctttcagatatagtatatagcctaaaataatgactattttacagtgctgtattcccagtactacaatcaataggtccaggaaccaacagaaaaggaacaggagtgtccctgcttaccacctctcctagtcaccctttagggacattttttgctttccacttttagatatttgggctatgtttacctagaattcctggttctaacacagggaatgctgccacaagaaggcgtggtaagatttccatcaaacttgaagttgcagctgctccctgcttacttcaggttcctcatacccagagaccagcaggcaaggaaaacaataatccatactggcaagggtaacgtatcctcaggaggaagtatggccattgtcgcacaatgggagaaaggaaaaaaatatttttggcacccagctgatccacttaggtctcacttagtaccccctattcaaacggacaagtgtgggcagctgtgacctaagacaggtgtggtgattagggactcagtccccttctagacgagggtctgtgttatataccagcaaacaacctggactggaagagatgctagccaaagataagaagaattggcaagggatagtagaggatggagacaatgaatatcagctgtgaccttgagaccacctgtgttgggagctatagtttgtcccactaactttcctcttgtaaatttctacaggagaagagatagactagaatcctcgaggacctgctcccagagagtgagaatttactaacttactatatgaactaggtggatctgagtggcctgaggagtgaactaaaatgcgtgctgtatgtaccacctcgatatcccctacagaaatgagacatccaatccttcagttgctagtagtgttgcctgatgatgattcaaaactaattctctcaatgggaattggcctcttctcaaagtagctgtctcaccaaggccatggttcctccctggcagtaacctgcatctaatgactgggcgatgtaggagcacagaagcccagccctactgccttgatgagcccattgtgaagggtcatctcaggttcagaggtcccattaggatcaactgaggtctctgttgtaagtgccttgtagttcaccttctccttcagttcaatcccgtttctctcactactttacaggcattgttcctgggaatactcctcaataaacttcctgcataacaaatctctgcctcagagcctgtttggaggggaggaaaacttagaactttgtccccaacatcaaaatacaatttaatttaaaaacatttcagtgaagttaatatgttttctgaattagtgcacccaaaaacatttccaagcaccccctttgtgtgttttgattcttacaatctatgtcctttattcattctatttattgaacaattaaagagtgcttctcatatatgaggcagtgtgccaggcattctggattcaatgacaaaaaatgcactcagaaaattcattctggattcaatgacaaaaaatcctgaccttaaggacctgatggacaaaagggaaaagcagataaattaatagacagttaaaatacactataattaatagaacataatgtgggaatgcagacatgggataactaatttagcttgttgagcagagcaacacagagaaaaatttgtaaggtttcccaaaagcactatctgatctgaacctttaagataagtaggaaataggtaggtaaggaatggaatatgttcagagtgggaagcagtgtgaggtaaaaagagaacaggtttggagaaaagaaaacacttctttaggatcagaccaaggagtgtggcagatattagtgtgaggtgcagagagctgttggcatctgtggagtaacttcaggcaggggagtgatatagtcagcttttcattttggatttattactgtagtctagtggatgtagagagaatggattagagaggagaccagttaggagttccttgcatcaatctagctgagaaacgatggctggaaatcatgtagtagcagaggacatgaaaaaaataaaataatggaatcctgagatttgaaggaatttgaactaataaatgtgggtgatggactggatgtggaaatgtagagtggttgaagataccctgtttggattaggaggtagaaatgctattctctgaaatatgtggtgagggtgaaggtaatggtggtaagtgtgtttgtatgtagggagagtattgcaggaaggctgagatatgatgacttttaattttctatttctatttcagacatttggagatgtcctaagacaattggctatgtggatagggagatctggtttagggaccatatcatacagacagtagaagccatggatgatctcattccaggagcacatatacagtgggaagagaatgaagctgaagacaattccagctccaaagatagtgacaagagctgttcatcttcatcatcctctctgtaggcatcttgaattagaagatactatttagtgtggtctcttacccaagataaataatctaagtttccgtaatctttcctcattgttctaattgtgaatttctttggaactttggtgatgttttctatgttcccatttagttctgagtaccagaattagacacattatatttattattatctttgacaaaaatagtgctaaaaaagccttcctaatatgccatatgcatcacggccgtaggaaaataggcgtaccacttgtcacttccctaaaacaggtgctcccaaaggcaattcctgcatgtcctagaggacttttgtgtgtgtgtgtgtgtggtctgtgtgtgtgtatttttaactgccgtttttgaaccaatgtaacatgatagaacatgtattaggatgtaattggttccaggttagttaagtaagaaatgcatttaattctttctcaccccttgaagaatatttctacttctccattaaataaatcagattttaaacaaaaatggaataatccctcaaatgtaattcaaaatacaacacacagtctcttgatttgtgagaattagctattgtacttcttcttttgaaaataaccctttaaacattaaaatcaacagatgacagctttagtaatctgagacaatttcatgaattgcaatatttacttatttgggaggatgttaaatgcttttaaaaattctttgtacctgatgtgaatatataataaatgtgtagagtatttcagttgcatgtaatgattgtgaagctgtaggaaaggtggctttcccaagtcttgagtgactgattccatcttttcttccctgactccttctctccaagtcttctaaaggtataacatctgcacagatgcagggaaggactgcactacaaagatgtgctgtcaatgagctttgcagactggttcttttccctctagccaagccttttttctttttatcctaaagaaccctggtctctttttatttcctggtcaatcttaatttttctaattttcaactcaaaaacactgagatttatctccatttctctgtcttaaagagaaatatacacaaagcagtcagagcattagctaactcagatcctattatgtgctaaggtctatctatctatctatctatctatctatctatctatctatctatccatccccttttaagattcacgacaaccccatgaattggtactattattatcttctcttaaacagaggcaaaggaaagctaagtaacttgtctgagatttcctggctgtaaagtggcaggaccaggcttacagtctccacagtttggcttttgagccaaccctcttaaccatcctgttaccctgcctttcaacagtgtaaaacaacaggagcaattttggtgtgctgcggaatgtaattgggggatctgggtcagaatggagaaaaagcaagagaaatttttcataggcagccaagaataaaagagcctaagagcatctacaccgatttctataacttaggctgtaagagaagtaggaaaagcattttgtttttctgcttaaacttgttgcacagtagaggaagataattttaactaaacttgtttgaggctttaagaagtaggcctcagagactcaaaaatcaaagtgaagtgaagtaaaattagcaattgttttctaaaaattcatgtaactcttagcaatgatttaggctttccaaacaacgtaaattatatatgcagattacttctaattataatgcctttccttctagattattgaacacttacacaataggattttaattgattctcaccagcctgcatctctagtgtttgattaaaaatatgcccattgtcaagaaaataaattcatttaggcatttataagcatttgtagaagataggtgaacaaaatttaaattaaaaaaatatagttatctacatttgaaagagttccttattatttaatcccttttgaaatatgcttagaatatcctttcaaggagatgatctacagatctttatttgaatctaacacttttaaacattttccctgatgtacagattcttgagttttgtttttgtttttgttttacattttgccactcaacaagaacataattcacttacagaattatttttgtgtgtctgtaacagctgtgattttccaccttactaagcagtttggaatttatcagtacatttctatttgtcttattttttaaatttttaatattttttaaaagaatatatggaatcgttaaatgaaatttacaagagttcattgctttggactgagttccagcactaggcccaacagaccagacaaaaccagaatggaatcgctgtgccacataatcaaactgaactttgaaacaagccagtttttcaaaagaggagatttacagcaaccaatcagaaggggcccagtttacctgagctggcatgataaggaagtcgtctctgttttaattccataaggaaagtaactttgaaacaaccacttctcttttgttcacggtttctgctttttcttagcccttttctgcctataaagccatactcctgatcagttcattagaacactcattctgttttctggaatgagatgttgcccgactttagaattcaataaaagcctattggatctttaaatttaagaaaaaccgggccgggcacggtggcttacgcctgtaatcccagcactttgggaggccgaggtgggcagatcacaaggtcaggagattgagaccatcctggctaacaccgtgaaaccccgtctctactaaaaatgaaaataaaaaaattagccaggcatggtggcgggcgcctgtagtcccagctactcaggaggctgaggcaggagaatggcgtgaacccaggagcggaggttgcagtgagccgagattgcgccactacactccagcctgggcgacagagcgagactccatctcaaaaaagaaaaagaaaaagaaaaaccaattatatctttaaatttgttgtaattttgtcttttgacaggatctttatgaagttacatgccattgacaatctttgctgtgttgttgtaacttcaggtatgctactgcaatgagcatgccagttggactcttagacaatggccatctgagtaagaaaaaatttcagttgttttaaaaaataagtgtggtattcattttgtaatttattaaaataacatttgaattttcaaactagctattccctgagattcagaagtctttttgcctgctttttttttttaagatgaagtaatctggctataaggaatattgattatattagtctaaggacacttacagagaaagtaagcttactgtagtgtgaatgatgcttctctttctattaagggtggtcattctaaatatgactgcataaggaataattctggcaaaaatcagtccttcattttctcttaagatatttagaatttaatttaaatattatatgtcaaggttaaaagttagaaacatgtaaggaaatatttaagaacttacaatatgaaaacctgttttctttatggaactctttggttatatgattggataggtaaaaacaaatttgtaaaatatggtagatatgggaaattgtcaatatatttgtaattcatgcagcaaacataatatttaggaagtatgttattctgttttcttaagtacataatgataagggttcttttctccaccaagccccttttctacatttgtggttttcatttttgctgtttttatgttattattgatagtatctcaataccaacctgctattgttaatttgtgacattccttatttagtctggaaagtggaaggtagtagatagttaaaagtttttggtgtctgatacagagatgtttatttaaaagtatagtaaacaaaattaaataaattgagatgtttttgaaacatggcttctctaactccgaagaactttgtgacaaaaaatgatctcttatgataatattttaatgtaaaatacaagaaattctttgaattaaaaaacattgtcttgattatcaccatttaggcatatattgaaagttctcatttaagtggtagaaattatttgaaatagtgttagtttcctgtggctgctgtaacaaaccaccacaaacctggtgatgtgaaacaactgaaattttttctctcactgttctggaggtcagaagtctgaaatcagtgtcgcggtgtggaagtccagatgtgggggagctctgctgcgttcccgcagaggccctggagaggaacctttctctttcctcttcctgccagtagtggccactcgccttctttggcctgtggttgcatcactccagtctctgcctctgtggtcacgttgccttccccttatttgtctgggttgaatttccccatgtgtcttttttataaagacatttgtgattcattttaagcccatctggataatctagaataatttccccatctcagaattcttaatctcatttgctaagaccctttttccacagacggtaacatttacaggttgcaggggtatctttgggggccatcattcagcctactctggtaatctttattcatatttaatcttcttcaaaggaaattgaagccaatgagaaaagcagtttcactcaactactctgagttggtgataaataaaaaatccctatttctccaactggtgttgcatgtaaagttacctgctatatattgccacctggatgggctgccttcgcatgaactaaattcaaataaacttaaaaaaaccaaattcatcatcttttttcctgaggtagcaactcctcttggctccgaattctccttttagagtcaccatcatcccagttatcgaggcttcccttggcagtcatctctgactctcgcttccttctctcccacatcctgtccttaaacgacctccctcttgagttttcacatacttaaaacatcaccagacacataagtccattgaaaccacctcaggcctttttaatttaaagactggggtatcatcatagcctcctaactggccacctcatgttagtattcccctatggcattctctcttatagccactgggttaatattcctgaaacactaccatggccatctaattttcctgcatagacatattgtttggctccttatttcatctgaagttaaatataaactcagcctggccttgatttattttgtagcgttatttctgatgctctcctcacctgacactttgggtccaggagcattgctctcttcacagccccctgggcgtgccatttcccacaacccgccacacccccacttctgacatgccttttcccaccttgcctttcaaaagtctactcacctttcaagatccatctgagatgtggcctgaagtaggacatttccctctctcatttctaagtaatgtctgccacattaccagcttgagttacacttttccataagcttgtcatccctttggaggatggacactgaatgagcaaagatgatgccttgtccattgttaaatttcttcagtgttttgcacagagtaagcatttaataagcatttctcaaatgaattttgtaaaggccaccactggaagtaatttgctgttttcacatcgatttgtatattcctcctttccatgtgcttctttgatcacatattattcataaaccttgtgactgtttttcatgcctaacatttggtcacaattttggctttttccttcttatccctccccccgcccaactggagtttaatttattttcctatatggtcctgtcagcagaactgttcagagaatttgggcaaatcaggacttcctgagagagttttacttgaattgcctgtaagtctgtaaatgttgtggggcatagaatgataggaaagacctctggttttcaatgctgaaggctttttattgttaagatatccaaaataggcatagcatgtttaaaagtaaaaaccctggacctgctctctctctttcatctgaaattatgtgtttgccagagtataatagctctagacaggaagttatgccctcagggcataattcttgcaagggagagaataaaaagtttagactcatgtcacatcctgaatctcaatcccttcatgtctgggcaatctgcagggagaacttttgttctagtcttctttgccagagagaactctggggttagcattttagtccacagtcccctgatgaatatttattgagtgcagagtgcaatgaggatatggaggtgaaggtggtgtggcctgtgtcttcaaggagcggtgtccctatagttgtcagaaagaaactccaggaaaatcctaaagagggagtttaaaattgcagatatcacagttatacaatcagtgttgaattatttccgttttcctcatgatcagaggcccctggagaggcactctggcattgtcctagtattactatcctgtggctatttcaattattgcttgacttcttcccaatgctttcactcatcttgtcatggtttgggctagaggttccttcactacacccactagcaaaggtgacaaagccagatttgtacctagaaaagtcactaaaatgctccattttccaactttccaaaaagcagcaatactgatcatactcataagtaaataaagctcattgatattgaattatctctacccaaaaagaatgtccatcacaatagtgttcataaatgagaggcccttctttgcaatacaaaggtaaaaaatgcaacataaaattgtatattgtgctggcaattaatttttacttattaatacattataacagttactttctgcctgatgtatttgtcatttacaaagacacaagaccttatttccatatttcagtcagtgctttattttgatcaatactgtattcatgtatgtaactctcatatcatactcttgagttatgttgaagttttaaacaactattagacaaataatgaatgttacatgttgggtacaagcatcctttgaaaaatcaagaagataaaagcaaagccaagagtatatgattcattttaatgtaatactgggataaaaatgtgaggatgtgatgtcaaatggtaataaatgctgagttttcccaatgatatgagacaaatttgacagaatacaaaattttaggaacatgtttataaactaaattagtctaatgttcaatgggaaaagtggaatttgatttatttatgttttgctttactgcatttattaatttttaaataccacacaatttattttcaaggtttatttatcttcatgtttacttgatgtaattctattgctcattatattgcacagagcttgtcacctataagaataagagttctatgaaaatggatcattttaatgtgataatgaatggaataggagtttagcttcatttcatttttcatgatagaatttgtttcggaagttcctatcctccatatcaatgtcacgcccaaatatttctggcttaataggaacttctgaaacaaattctatcgagaaaaatgaaatgaagttaaattcctattccactctctgacccccgtctctcctctgtcttcctcctggcctcttgcctccccgcccttctccctccttccctctcttctttctttcaccggagggcactacagcatttaagcttacacccctgattgaggaccgtccctttcttagggactccagaagaaacacctgcaatgttgagacacgaaaggcaagagtgatcctggaaagccaaatgggtgcctgtagaagaggaaatgatgcacagggattttgctttgattcatcaccaggttgactaggtgaccaggcttcttaccattcatgtgatctgcacctgtgatcaaaagccttctttatattctgtgagaataaaagaggatggccacaaaatattctataatcttctcagtgtattgtacttcatatctacaacaatattttgagcacctactaatataagggactgtgccttgtatccaagatagaaaaaataaaatagctcctgctctatttggggaagaaggtcaaaatcagggtaagggaatccagaggaagcaaaaactgatactgacggagtctgtttaagtaaaggcactgaattgtggaaaggtaaaacacatatgaagactggaattcaaataagaaggtctcccaaaagctgaaatgcagaataatgatggtagataaaaataatctctgacctgagatggtttttcatactctacaaacaagatgggatttgttaatagaatacacctactgaaaaatgagactggagggagctggtgggaggaaggaatggcctgagagaacaggtgggggaagaatagagattcagaaagattccatcaaacacttttgcagctgccgttctatactggtttgaagtcctagtttgccttgatttacatgtgtctaacagttgactctactggtatatgtgtctccagctttaagaagaagaaaaaatccactctaatgacggatattagttgccacttaaagatgctcttcagatactagtgttccagttaaccattaaagatatataacccctgtacaagttggcaaccataccaggtcattgatttattatcattaaactgcctaactagtagttatgttgagatgaatgctgggtaaaatattacaatgaatgctaaatgaaaaatacatctcaggcttgtaagctcccaccttgtgtagtatttctgtgttccctgacaccctgaagcctaatcgtgccttctgtatagttttacatgtgtagactctcttcttcgttacgatttgccaatcccctgttgctcacattgtactacagcaataatctttgtcatttttgaattggtgtccaggtggttgctgtcacattacatccatttttaaatgttgctcaaacccactgaggtgacatgcagttttccaacagtgtgaattttttttttccaaattttttctcttcgatggaagaaaaatttgctgtcttctttgacagctggacaagtagagattgcaatctcctttccctctcagtattctctggcaacatcatgaataagcaacattttagatggttgacttccaaaaaatgtttcttgtcaagctcctgtcaggattttggaagtcagggaacaacttttttccagttgtgattttctataatttcatttctgaagtctgaattatgatttttttttctttctgggtttttttttctgtagtaaaaggcaggatgggaagaaaaagtagctcagttcctttttgtgttgatgtagagggtggtacatcattggaaatctataatgggattttctaaactggtagtttaattattgttatattttaagttgaattatctctatcatgagccaatgtctaaataaccttacagtaatcatttttatggtatcagatgattttttaaaatattattacatttcatacttacaaaagatactgggaaatacattagacatttcagaatttctctcagttatgactatgagaatgaaaagaaagtcttttaaacagtcctgggattttttttttctgctgctatctagtctacttcaagttgtaattttcagtggttcttgttggtaaccccaatttaggccactctagagataggcctcgacaggattatatatagagagagagctcagcttagtcgttgagagcatggactcagaagatgggccagccctaaacctgattctgccaggattcatgtgaccttgaataaatttcttaccctctcatttgctcagtttcctcatctgtataatgaggataataaaaatcatatttactccatgaggttgttgtaagaattaactgagtgaggctgggtgtggtggctcacacctgtaatcccaacactttgtgaggccatggcgggaggatcacgagatcaggagatcgagaccatcctggctaacatggtgaaatcccatctttactaaaaatacaaaaagttagccaggggtggtggcatgtgcctgtagtcctagctactcgggaggctgaggcaggagaatcacttgaacccaagaggtggaggttgcagtgagccaagatcgtgccacagcaccccagcctgggcgacagagcaagactatgtctcaaaaaaaaaaaaaaaagaaagaattaaatgagtgaatatgtgttaatctcttaggttagtagcacatagtaggcattgtgatggtaaaataatacatacatacctaatttatatccagcctcacattttggtactgggaaactggatatcttgttcaacagtggtattcatagtttaatctcggcagcaacaaagtgccctggggttcctgactgaggtagaagaatttataagtgtaagctgtttccattttagtgtagtctaaggtaaccctctcctttctttttttcctgttatgagtaagcttaattttttttaatatatagagtttacctttaaagaagttaacacatcattaagatctaggtaccttcttcaactctccccattcactcattccatttcaatttcatgtactccaatcaactttggtatgttttgaaatgttattattatttatccaactttagaaggttctggtagagttagttcctgaggctagggaaattcttttaattaataatctttctgttaatcaccccataatctccatcagctctccaatccaccctgtctgtggccagacaggactgtggtttagttcaattgccgtcaggatacacatacgcaattcagtgagaattttgccaccatttttcctctttcagaagttgattacagaatagccatcattcaatgaaagtctacaggcttctctaattctcttgcagttcacagtcctttagccaacagcaactctacaccatcaaaagtaggatttactgaggtatcacttaaattcccccttgatttaagttcttaagtttcaggaccacttaagtattatgaatgacaaatcaacactcacatagtattgcagaagtatagcttgagtaagtctaatggggaacactttttttacaagctcagggtaggggatattttttgtcactccctcaagcaagcgaactacaccagtagaattataaatcgttctcaactctccctccctttctttttgttccacctccagaccatagtaggggtttaaaatttttggtgttgttgtttacttttttggtacttcggggttacctgtggacccctttccagaatattttacaggcatacgataaagtgcaaaaacttacttaggaaatcagttttatggaaatatactgatcacgattttgaaaaatgtgaagactaatttatgtgcttttattttaacacattaaataacaacagctaacaacaggtcaaaaaatcactgcaattcccaagtactgatgggtataagtgaaatattgagatttctatagcaactggaatctaataggaaaataactgtgatttctgctgttgacatagtcacaagttttcctgaaactactttgcttttttccctcattcacaagtgaaggaaatgggaagattcactcagagattagtgaaaaggatatttttttttctaagttcatgaaccctaagtccctgaggatgcagacatatatacatctagttttctatccctgaggagctttatagtctactgggagagacaggtggcaaggtcaaagagtgctgagaagtggggccactatcaccccataatcttcatcagcccttcaatctaccccaaattatctaatacaggcacacttcagagatagtgtgggtttggttccagaccactgaaataaagtaaacagcaataaagtaagttatgcaatttttttggtttcccagcgcatatggaatttatgtttatattctactatagtctattaggtgtataatagcattatgtctagaaatacaatgtaaataccttaatttaaaaatattacttaaaaaatgctagcaatcatctgagccttcaacaagttgtaatctttgcaggtggaggctcttgcctcagtgttgatggctgctgaatgatcagggtggtggttgctgaatgctgggatggatgtggcaatttcttaaaataagaaaacaagtttgacacatggattgactcttccttttatgaaagatttatctgtagcatgcaatgttgtttcatagcattttactcacagtagaacttctttcaaaatttgtatcagtcctctcaaaccctgccactgctttgtcaactaagtttatgtaatattctaaatccttttttgtcatttcaacattgttcatagcatcttcaccaggtatagtttccatctcaagaaactattttctttactcatccataagaagcaactcttcattggctcaagttttatcacaagattgcagtgattcagtcacgtatttaggctccacatcttcaggctccagttatcttgctgtttccaccacatctgcagacttcctccactgaagtgtttgaagctgtcaaagtcatctgtaagggctgaaatcaacttattccaaacttatgttcctgttgatgtttgaattttcttccatgaatcacaaatgttcctaatgatatttagaatggtaaatcctttccagaaggttttcagtgtcctttgcccagatccattggagtaatcactatctatgtcagctatgggcttacaaaatgtattttttaaataataagacttgaaagtcaaaattgctccttgattgatgggctacagaatggatgttatgttagcatgcaagaaaacaacattaacgtctttgtacatcttcatcagagctcttgggtgactgaatgcattgtaaatgagcagtaatgttttgaaaaaaatctttttttctgagcagtaggtctcaacaatgggcttaaaatattcattaaaccatgctgtaagcagatatgctgtcatccagactttgttgctccatttataaagcacagttagagtagatttaacatagttcttaaggaaccaaggatttttggaatgctcagtgggcactggcttcaatttaaaatcatcagctgcattagcccataacaagagagtcagcctgttctctgaagccttgaagccaggcattgacttcttccctctacctatgaaagtcctagatggtatcttcttccaatagaaggctgttttgtctagattgaaaatctgttagttagcgtagacacttttattaattgttttagctagatcttctggataacttgctgcatcagcactcgctgcttcactttttacttttgtgttatggagacagcttctttccttaatcctcatgaaccaacctctgctagcttccaacttttctcttccagcttcctcaccattctcagacttcatagaatagaagagagttagggtcttgctctggattaggctttggcttaaatgaatgttgtggcaggtttgatcttctatccagaccactcacactttctccgtatcagcagtaaagggctgtttcagtttcttatcattcgtgtgttcactggagtagcacttataatttccttcaggaacttttccttcgcattcacatcatgggtaactatttggtgcaagaggcctagcttttggcctctctcagcttttgatgtgcctttctcactaggcttaattatttctaacttttcatgtaaagtgagagatatgcaactcctcctttcacttgaacaactagaggccattatatagttattaagtggcctaatttcaatattgttgtgtctcagccaatcgaaaagcccaaggagaggaagagagatgggcaattgctggttggtggagcagtgagaacacacaatatttatcaattatgttctcctttttttatgggctttattggtggtgcccaaaacaattgcaatagtaacatcaaagatcactgatcagagatcactataacagatacaataataatgataaagttagaaatattgcaaaaattaccaaaattgtgacacagagacacaaagtaagcatatactgttggaaaaagtggtgctgatagtcttgctcaacacatggttgccacaaaccttcagtttgtaaaaaaaatgcagtatccgtggagcacagtaaagtaagctatgcctgtatttaaaaaaataaaataaaaaatagaataaaatcttaggttgaatattaataaaataatgtttagaaaacattagtatttttactgttgcataacaaaatatccaaataaaacttacatgttttatatgtgaatgccactttacataattcccttagctctgctttcaaagtactgttgctgcccaatgtcatatccccctccatccatttttctatatggaaattctggagcccccactgggttttaaaacaaaaaataggttaaaagttaattgcagtctcttaacattattattatgtcagtgcaatgctgagaacttgttggttgagtgatggtggcagctgttacacagtggtcatatggcagattgtaaccctgaggcctatccacaattcaaagctcatgtcattgccagctagtgtgataactcatacctggcatttttgtttactagtgcaaatggcactgacattttgtgaaaacattgtaaaaagtttgattcatttggtctatttgaaattaagacaggcttgatgagctctaggagcattcacaaatttaaatttataaatagagatgttaaagtattttatattactttgtgtcataccattcataatgtactcttccttaaaagaaagaggaaaagaaaggagatattaagttaagtgtgttaataggttataccagtgtttgcatgttagatagtcatgtggtttagcttgttacttggcatatgtggccccgattgtcacatgacaaggcacctgtggtgactgtcctttgttcacagctgcagcctcagctcatgccacagtacctgaaacctggtattttataaagatttgttgaatgaatgtatgggtaggtaaatgaatggatagttggatgcctgggtgtgtggatggatagaattttttttaaaaaacccaaaacttccttaagctgtagttagtcatctataacatggaaataataatacgtaactgataagattattatgtgaattaaaaacaataatgtatataaagtacttagcttgcatataagtgggaaataaattgtagcattaataaaaatatataattctggttctattaaataactaaatattttttgccaataattaaaactgactgcttttgtgagtctaagaaacagcagtgaacttggattacagttttatattctttgcgtctagaaagtgatgtttcatcacaaggcaagggctttcttctcatgacaaagagcctgatgtagctgcttaataactgttagtaacactgaaaggatctacagtaaatctgttagaaagctgtgatcaaaaatgtgagtgccaatcttcaaaagcccatttcaaagcttgtttgctataatactatgtagtggtttatttgcctttctttgtaactcattaaattaaaaatttggatccatcctcatggggttttcagaaatggttttataatttagcattccaatgacacttcttatttgcagattattatatactagtttttttgtcccactgtctcaccccagtgtagattattaagtccatatcattgcaatttgccaaaactctctggataaatgtctatgagagccaaggctccattttacttgtttatcgaatatggaattaatgaactatcttgaaacaatgtttataactaatgtttatatgacagaaaattggtgctgatcgtagtgtacatatgcaaactaatgctattttgttccccttgcctgaactctggctacacaggcagaattatattgctgttgtgttcaaacttcaaatacaatagtaactccagatgccatttttgtgttcttgtgaacttggagtgggtaaccaaaagcaaacaacaaaaacaaacaaaattgggacaggtgagaggcagtggcatggaagggagtgtaggcaggaaacaaataatatgatgactacaggatactacattctgatgaagactttacacttatggattgaacaactgttagaaaaagatcaaacatattatttgcacaggggtaatgattattttagaattacttcctgtcagtgataaatagctttatttaagcaaaatccaacctcttgaaattgttctccccttcagtgttatttttgtcattattttttcttcacttaaattacatataactgtaaagctctttgaaaaagtatattatctaaatgcatctatttaaattgaatgggtattaaatttattaaacatatttacaaaatataagtaagacatgaatttaatatgagtctgttgaatttttcattgtagttgaatgaatgaataatatattctagtcagccttttcattttctggtgcttctttttagcacccatagactttcatatattgtaaacattttcttctctatatctagttttagaaaataaaatgttgggaacacagaattgacttctggagactgggaagtatataactaaagtaatatgtgtttgctttttctaatttaattttgattgtggtgtgcttaatttataatcttttaaaatgttttaattttactcaaatagatctgtacatactttttatactcaattaacataattatttagctatcatacttccgtgtgtaagatttctagagcatcgccataatgtagcactttggtttgcaggagagaaattttcatggtacattatttacttgcattcaagtgaaaatattgttaatattggttgcatttgaaggattctttcaaaagtacgtggtgctcaagatggatttaaatggaacatgcaagagacagtaataacagagagatcacattctctctgtaatttattttaatgccattacacagggaattcaaggcagataaaaaactccatttacagaaaccaaatgtgcagaaatggattgtcataattccagatgaaatcaataatacatactccctggcatattttttattagaaataacttggaaaaatttatattttctactaagtaaatatataagttataagaaataacttatatattaaataaataagttataagaaataccatatattaaataaataagttataagaaataacttggaaaaatttatattttatactaagtaaatatacaatcatagccttaagatcttttgcagcattactttccccttgatgaattacaatgcaattttctagcctactcattttattaaggaagctaatgactggagcaaaagtctaatcagctgccaatcaggattccttgaagtgcagagtgtcaaatattgaagcaatttttacaactcataaaagcacttatgttccatggtatgtcataaaacttgtgatgaaaatctagcattgatgaagctaccttatttctcaagtgtttttccccaaacaaacagctttcaaatttcaccaaatctttcattaatattcaagtctattaatatagcactattatgttatctgttatagtattatattatccaactatagcaagataattagttatatataaacgtcagtcagagaacttagtggattcatcataaaagctgtaatggtggaatttttttttccatagtaaaaaaattggtctttcttctgataatgttagagtgggtttttgtttttatgttacagaaacaatgaggctgcacactttgctttcaccctttgcatcattatgtttgcattgtttatttttaacataatggtacattgtttcatgaaaagtaaccatatttcaaatcattaattcacttgtcatttatcattttaataccagaaagtagttaccttcctgtgtttgaaggtactgtataattgtatttctttaccatgtcgacttcctgtctcttaaaacgcagcaattacgtgtgtgtttgtgtgtttcttcatctgcttcatgcatataaatatgtgcgggtgtctggggttttgttgttagctgagaggtgggaagtgtttccacacatctgaatatttgctgccgaccttcttgatgatccgtctgttaatgtttttatcaagctggcacacctcatgtgggatcttaataaagtaatcagcattttccctctaaaacaagtttgagaaaatcctagttaaactattctcttcaacacttgaaggccttggttgtacagcaagcagctactaattcaggaggatttatttggcttttcctgagttctctgaaaaatctatttgtgtaaaaagaacatactgcatgatccccagggctcctggaactgaaaactcaaggatttagacgaagctacccagtttgtttaatcatttgaagttttgtttcagcagctcatgctttcctcttacattttggcagaggcagaaatctcagatgattgtttttgggtacacatgtaaaaattttctcattaaccttgggggtggtgtaatgataaaagagataacattttgtttcaaaaaaataatactaactgagcacatatttcaatgcattgcaaatctgaaggaattgtcatggctaacaccatctcagtctcagtatttgtgccccagttttttttcaggtcaagaatgtagggaaacactgtactaagttctcattggatcccttgatgcctcataagacacccagacccctagctctcaatttcatttctaaatgtaccccagctactagaatctctctcacaatgatgacaaacatcctctttaataggacagataaatattcctgtcactcttgactgagagacaatactccaggtctaggggacatgatctgcaaggaacttcccatgattcaggcaccactattcctgttcattttttttccattgtcccgggatttacagctttcaggagtaccttcatgttactcttctcataagagggcaacaccatatttttctcactgaatcagaagacccaacaccacctctttccccagagcactgccatttgcatcctatccagctaggtagggcaaaagtgtctttcattagactaaggacctccacaggcagtgcttaattttcatttacctttgcctccatagtgccttatatgtagtgcctaaatacggatggtgggtgactgcttagagtaataatagctaatatttttgtgacattagaaatggacacagtggtaatacaggtcaggattataactcaaaatcttggcaatgtgatgtttattggaacaaaggaacctaaagatcagaatgctttctctatgtaagatgactaggcctgtaaagtagagtgggtcactattctacagaaacacagatatcaatatttacattacaaataagatatattaggccattcatacaatttacaaaatggttcattataggactcactaactgaaagtacccaggtgacattgaacgtccagtttattttcaatataatcttcctgaaatctctgtattaatttggaaaaagtcaacaaagtaaaccattcttaatgtaacaactggatttaaactagggaggatcaaaatgtttaggtaacagaaactagcagtccaatgtggatctttctactttctctctttttgcctttgcctttgtctacgtctactttctctcctttgcctcttctttgtttatttaaacatatatatatatatatctatctatctcacatactcagaggtttattgcttagttttgttttttataaaaatggagtcatactatacacactactctgcaacttatttaagagtatactatgaatattcagttgggtcttattaaagatctaacatcctttttaattgctgcttaatattttgtactttataccattatgtatttaaccaagaatgtctttattaaataatataatcttcacctatgccagttaatctgttattcttagtgatttaagctcctttctctcatctggaaaatacagcaataaataggtaaaatccacagtttctccttcaagtgctacgtgcaataggcccatgaggtaacccctgaaattcatgttttcttggaagtaatcagcagacctggagtcctgtgtatgtttgtgaactccagaggtccacactccttcacttcacactcagtgtcctccatacttagggcttctacccccctgcccagttttgttaaagaaattactccttgggacatggacaaaataaaagaaatagccatttgtgtttctgtatccaacacttctttgtcctgtcatgggttcagttagttctaccatgaagtatggactgtctggtaagaggaaagagttttagagattaatgagggtagcactagtgaaactagtctcaaagatggcatagtcaatttcctcagatatagaccaatactgatatctaaaaagtttattcttatgggtagggatgtctggatgatagcaatttaagtcttcaagggagagcatctccgttgcttataggaacaatcatctggactaagtcatgaccacagttctaacagggaaagtaagcaagatccagctcccgaagaggagtttgcattggctgcaaaggggatccaagaccttagctcagtgagccaagcttcagggaaggactgcagttcccttagggacatagaatgctaacaaagaactggttttggagcttggtcatggggctggccatacatgttgggggctggcatgtttatatgacaaggtatttaggctttccacacctaaatattcagctatatctctgtaagtgcatagatccctaaagagtttgccctgggtacattgtgctggttgtcagataagaataccgaggctaataccagggccctccctttgttagaactctacatctaataaacacccaggcttggttctcattgagtcacaggctgggtggggctgagcctacaggttgaatattctcagttcttgactctggatccaggtggagtatgcatagactgataacaacttgtttttgcagtaagtctgaagattaaagcccttagttgagccaataccttccttctcagataagtcaaatccacatattcagaatgggagcaggaggcagaagggaaaattttgtaacctcttaacagttctagacttaacacatcctactatcaatctgagtggatttgttccagatgcttgcatggctgagatatgcaaaaaactgtctccccatgctgattggtagcatctttacatgggcaagtcttcctacttgtaaagaatgagttaggtgtgtctgggacttactaaggagtctcaggtgttgacagcttaaacaccttgccatgtaaatatgtctgatctctcttccagttcttacacagttggctgtggttactgacttcttattttgttcaggtctaaatgaaattgatcttgatctattactttaccctaggctggagaaacaactttagtaattatctcctcacccctacttcccttttgagctttgtaaaaatgattaaggagatcagaatatatggcataaattatcaatggttcttctccattggaggttagagttccactgtcaaaaattagtaattatcattcttcttacaagtttaagactcaaatggaactgactttttcagcctatttgttgtctatggtaaactaacagcaaacagctggatgttcttctgtggttacataaccttaatggagattagttccttttatccttctatactgcttccctaccaaatgattagattttttgaggggcagatataaaccccttccattgtttaaaaaacattgttaataacccttcgcactacacaccaaagtgcagcctttaatatagttgccagaagcagttctgagtgaaacactgaaatgaaaagtaaactcatgtcatttggtctatgataagcattcacagtttgaaaaaccccaaacagggatagttaagttgcaagcactatttccagaatgagagttgaaaattatatacataatgtggaaacaatagatcaatgaaagggagtatagaacaaaagagagaagaatttccatagccactccatagaatattaggtctatagaatgtcaagaggggttatgtccaaaacagggttctaggatcagataagtttggaaggtacagaattaaatgtcattaaatagatttacttcttgcagtattactcattatgcactgtgaatttccaagacagggacagcgtatgctgcatttcccaaacttgtatggtctgatgaatccaccgaagacagtgcttttatagggggacgtcatgatgccaaagagaaaagagcttaagaaaggagttcaacaggtcaagaagattagtgcataggaacttacagaggggaaattggtgcctccacagcattagttagaactagaccctgatataataggggaccagaagaaaggagggcatgaggaagagaggactgggctgcacatcctggctttgactggaacatatttcccaaatccttggtgatcaaagccaaagtaaatacaaccaaggttatataggagtaataagtgatggaggtagggagtcagctggatgaggcagagactggaaatccttgttttgacctcaagcctcaatcctgaaccatattgctatattgaaatatagtcaagaaatgaatgtatcatgcatagtggcatgtcaggaagttcaagtgtgagaaagccactttgttataggcccaattcctggaggaggatatatgcctctccagatccatttggcttcacttgtctccacagctgtggcaatcagttctgcatggactccaactatcttcctgtggggactgccgaccagtgtctcatcaaatcccattcccactgcggatttctgtgttggtgctacctggggaactcaggctgaggcagtgtctcacctaggtagcagcctctgtttcttgtttatttagagagtaattatgaattcataaactttcatattattacaaatcttactggagtatctagtaggggcttagttatatgctaaacagttgtagtttgaaaagccataataactctggttatttgacagatatcaaggcagggcaaagagatacccaactagggtaggtcatcccatcaatattttggaaacatatgattgcctcacattgtatatccttatcattgttttcttttaattattttacatataagtttagacagttgactgttgggaattcctattcagagatttatcttttaaccccaaatgattaacctgtaagctgtgactttcagtgttctggtattaacaataattttacacatttcaaaattatagtggaaagtaattttaccataatattttatctcatataacaagagcatggtatttcttttgtcgaactgcagcttttgtagataccatacacattattaatttcaaacatatcatttattccactagaattccattttttcttacctaatttatttccctttttaatactgagaaaaacagtatgagattgactattgaatttaataagatagtaacttaacacaataactaaaaacattggaagtttaaaaacaacagttttttcctaaacctgactcgaaaaccattgacattttagcaaacagatgggttttatgtaccacataatgaggtcctgggctcactcaagaccaccaggttgaaggaattctaaagctggagatcttttaaagatggcaaaatgactatgagattatctaaatatataattaaggaaaatagatcttttctgtttgtccttggtaaagtcctcaaggttgcatatgaccttccattaattttcttcagtcccaataggtgtttattttgccactgggaaagaattaggatttaggtaatgtctttgcctcacacttaggcttcctaacatgttataatgcactctatgttcatttcttgcctgtgttgcagtatagcaatatggtgaggactaaggtttagagtcaagcaattcaggatttccagtctctgccccatcatttattagccgtgtatacccttggttaagctgattaccctctctgagccttagctcatgaaatgagggccatataactcatatcactctgttgcccaggctggagtgcaatggcgtgatcatggctcactgcagcctcgacctcctggactcaagccatcctcccacctcagcctcccaagtagctgggactataggcattcaccaacatgtacagcaattttttttttttttttttttgagacggagtttcgctctgttgcccaggctggagtgcagtggcacaatcttggctcactgcaagctccgcctcccgggttcacgccattctcctgcgtcagcgtcctgagtagctgggactacaggcgcccgccaccaagcccggctaattttttgtatttttagtagagacggagtttcaccatgttagccaggatggtctcgatttcctgacctcgtgatcttcccgcctcggcctcccaaagtgctgggactgcaggcgtgagccaccaagcccggctgcaattttttttttttttttaagagatgagttctccttatgttgcccaggctggtttcacactccttgcctcaagtgattctcctgccttggcctcccaaagtgctgggattacaggcatgagccactgcaccttgcctactataaaccttaaatgatataacgtgttacagcagactgtgttaagagacctcatttgtacacctcaggtgttctttactgagaacacttcctattccttgcctttattctggctgcaggagcatggttggctcattccaaggcaaactggaagtctacaaaagtaatgcctcaaaaagcagtcccctatttagaatacctctgaggcatgttttacacgttttccagagttccccagcagaactgatgtccagtcgcccatagaagttgcttgcttgacagtacctctttccctttctttcctgaccgcatttctttgtccccttctagtaggtttcctgggatctcttttcaaataaattacttgtaccccaatttttgtctcacagtctacttctaagggaaaaataaggtgtgaaaagcacttagtattgtgtctggcacataatatattataataattattaatttcagaaacatatttaattcgttcttttttagaaaaagaaaccaaaagtgctatatttttgtaaaccactctcatggtagccacatcagttacagttatttttcattttctcttattgtttttaagaaatcattctttggctagtctcggtggctcacacctgtaatcccagcactttgggaggctgaggcggatggatcacctgaggtcaggagttcaagagcagcctggccaacatggtgaaacccagtctctgctaaagtacaaaaattagccgggtatggtggtgggtgcctgtaatcccagctacttgggaggctgaggcaggagaatctcttgaacctgggaggtggaggttgcagtgagccaaaatcgtgcctttgcactccaccctgggagatggagtgagactccatctcaaaaaaaaaaaaaaaatcattctttgaaaacttgttttctatttgaacagcaaaaccaggttcaacaagtgaatttgggcaatgactttacatgcactaatttttctgccttttaaaatacaattttctgacacctattttggtctggcagttcatctgaaaaataaaagcagaattttaaatgtgtaggtaagaaagattctattagtttccgacagcactgtagaaaaacaagagctctctatttcactaaaagcgctcagttccccctttttagcaaacactgaacattgatagtgtgttatgataaattaactacaatacctttggaggtcaagtgtctcagaaaaaagcaacagtaacatcttaggcaaaatggaaagcattagattcacacctgtaactcattaattttaaccaagagttagatttcacagaaagcaattactaggatggattgagttctttcatacacagggttgttttttttttaattgtaagactgttaaatattttctctgactatagttgccctcagcaatatccagaactagtggctatggattacttcattgtttctttctttggtaactgagaaaggtttaactatttattacaacgtttaaaaagttagattagaagaaaggatgcttccatctatttcatctttgtattctaaaagagtgtagctctactgtcagtggaataacagtgtgataaatgcactaattacatctgccatacaaagcttatatataaatccaaagtggacactgtgtgtgtgtgtgtgtgtgtgtgtgtgtgtgtgtgtgttttgagggtgtgcttgtgtgtgttcctgtctgagttttgcttctgtggttgttcatttgttaacagttatctgtttacaagctctttaaagatgaataacttagttattcaaacatgataaaatcgtgtttggtcgggtcttggtgttaaaatttacctgacctgactcttctcaaatgtctctctttacaaattccagtaactttattgctaagctataagaggaattttttagcttatttttgctttgagtctgtttttaactttctacaaataatttaatatcccttctctttgccttttcttaatgaagcagcatttctatgtgtctcctttcagggatgtatgtaaatgtagctatattgttgatagattaacataataatcaaatagaaattaacttcctgtgattcatcagtaaaactctatggacctacttttactcaaaattgttgctgtcaagcatttcaggtatgagttaattggctttctagaaaatgatagaggctatcctaaatctcaaagctcaatgatatctttttattttctgagatgccatttgtcaccatagcttattatacatgggctgattctcactccctggaaatagaaatgaagaaaggagctgtagggtcccctgccgccttctataaatgagcaaatcaaggaccagaatatctgtgggactcctccagaagctcttacagttacttacatagctaagtaagagcaaaggctggaagtagaacccacttttcccatagccaatccatttctcttttctaccaggtgtcttgtggcatttccccaggggactacatcttatctgctgtagtagaatcatgaaggtcatgaaatactggagctacaagagatttcggaggtctgctcccccccacccattttatacttcagaggaagaaactgagtacagagagttgggttgactaagaaattcatatagccaattggcgatctccttatagccattctaactttaaaaaggtggggattaaacctgctttcaaagcacaacctgaactgttccctcatccaagcttaagagagaatccatgacaccatataaaacagctctttatttccactggcaacaatggatgtatcctagttcatttgaacattttcctctctctatgatataggttagctggtttatttctatatccttgccaaaactggcagtgcatataggctgaaccatgcttgtggagaaaacactattcatatttcattatattaccttcagcagccctttactggcattatgactaaaacgcgtgtctccgagttgttgctggagaaatggccggccagtgaatttcgcgtcagaccagtgactattccagttgatatgaaagatgtcattactctgggggttatattgtggtcatcaggatattttctagtactcctggttcagaattttggagtattcatcttgaaaattgatgtctgtcctctattttggggggagattttctgtgtgctgtcttggctttctttgtttcctaggctataggtaagagttaagacgtacatgagtgtcttctagttaataaacctcactgccttctcacatggctgctgtacatacctgtcataacatgtatgtgatatactctctcccacacatacctatgcacacacagactcacacactctcacaagaagggaaatacataccattcttgccataatgttatttcatacatttgtgctttatttaacatttttcaatgcattagtattatgaactcttaaattaatgtaccaaagggcatttacataactttgaatatgttgattcaaaatcattacaaaatataatctaataagttacagagcctcattcaatgattccagttagcatccgcttctaagcgtgctattacttattcattagtagaagccctttaattttatattctgctcctggcagttgtggcttatttggtacttgttacagccactttagacaagtaaataaaaatcagatgaaaaatcctcagcaacagctggaaataaaccagtagtttctgtttgggtttggcagagtgaagcactgcagggctatgcatggaaaaataccagccagaactgttacacactgtgagaaaagattacatatctctagggttttggccttctaattactagggggtttctttgtccatgaagagtgccacctgcgtggttgggcaacaatataaaataattaaatcattatcacaagggtaatagtatacgtctttctggtttagctgtgataagaaaaccttaaacctgaaatacattaaacagtgtagaacatatgaaaagcctctttgagaggcttattcttgttgttatttaaaattttccttcactaatgtttagttcaaatacatgataattctagggaattacccgtctttatcagaccacccaaggaaggaagatgctctgccaataagtaaagccattggcctgtaagaacttgcttctgacttctaagtcacactcattttgataagcagatgtcttctaaaatgactgtgtggcttagcatactgagctgtttttctttccttttccaagacagtatggacatagttaaaaaaaaaaaaaaaagacgaaagattgttaagtacctgataatttcaataacatatttgtagtaactgcattgcagttaagccttatttaaagtaaattatctattttgcatccttttttttcaataaacagtttcacttctaagatgatgagggaaaaaagatgattaaggtttagcaatcttgttgcaagcttatttaaaattagttgtttaattatctacttcagatattattttgccaactggttatgttcatgccctgattaattattcttttcttccaagttatactcattttggaaaaatcaggtttagccatagcatgtgaagcccttaaaattgtctggagacagatatcttgatctcagaaacttaaattatcttaatactttctggagtaagaccaggaatggaagaagaagagagaaatatttctttatttttcctaattttatttcttctttcagcagaggaactgtactcttaaaattagagggtcagagcccttgctctgctgctgaatttatctcttacttgaggaattaggcacaatctaaacccagtactatttatttctccctttagaaattgaggaagttacctatggctaatatttttcaaatttatgtattttgtttgtttgtttgtttttttgggagatggagtctcactctgtcacccaggctggagtgcagtggcacaatctcggcccactgcaacctccgcctaccaggttcaagcaattctcctggctcagcctcctcagtagctgggaatacaggcacatgctgccatgcccggcaagttttttgtattttagtagagatggtctttcaccgtgttgccccggctggtctcaaactcctgagctcaggcaaaccacatgcctcggcctcccagagtgtgggattacaggcatgagccacattgcctggcctcaaatctacattttaaaaatattttaaaatagcgattttcaaacattaatatgatcagaatcacctgcagggcttgccaaactctagactgttggattccacctctagagtttctgattcggtaggtctgggatggatctcccaaatttgctttctaaaaagttcccaagagatgcggttgttgctagttcctgagatcacactgtgggaaccaaagccttacaataactagcctttttcatgagagaatggtaaggaaatataccacatatcaagagaagttatctcttgggttatcggaatgttagtaattttgtacttacccttttttcctctattctccatatgtcctacaagttatgtataatacatatatgattagaaaaaataatgaatgtttttggaagaacacttgttgaactagaaattcattaatctctattcattcttcccttctgatgtcttgtagcaatataataatgtcagttctcctcacctgctggggacagacactcctttcgatgtcttttgagggagctttcactcagcaaccaccagacagttgcttggttccttttagagtgctgtctttattgtgccagaatttagtacaagaggtgctggctctccaagatgagcaaatcccttaattgtatttcaaaaattctccccagttttttttctctctaccctcctcaggttacaatgctaaaagttctgtgtgggcctaaacactagtgggaaaaagcgcctggtgaacaaatgctgggtggcatgcccactcagacataaagaagttctgctcacccttttgggagtgtactcatttttgagaaatttgcctcacttagagctccttaaaataaatcaaacaaaattatatataaaatatatgctttcacaatttcagccatttcttttggtgtttctcttctaataaccttctaaacgttgttgctttatgtttttatctcagatttttgaaaacaaactaaatatagcaccctaaaaaacctttcaaatattttggattcttttatttatgactcttacaagcatgtgagggggcttgtttagagagaataaaggttataacctggtctgtctgttgagacagtgattttaatcacatttaattcccattcactctgtatgttacttgatccactcattggtttaaaagcatattgataaatacagccatggcttagcctcttgcccttcatcccgtctagagttgcatccaggcttaagtgagtttgccacatttagatgtcatactttgttactgatgagatccttgctagatagtggagcctatgtttttctagagaaaagtccatattccattataaagataaataaataatttgtttcagaaggctttcaagatgttggcttatagtcaaactataagtaacagcttgaaaaacctcagtgcttctcacatacatgttaatggctgttctccttcataaatactttgaagtgtttcagtaaatattttcctaaagaactttaacttatttgctaacttattgagtatcaaaatgtatgttgtatatgacactatgctaggcatatatatacaatattatccataatttttctaaatttttttgcaaatcagataaatttttattttaagattcagggggtacataagtaattgttacatgagtgtattgtgtgatgctgaggtttgggcttctaatgatcccatcacccaagtagcgaacatagaacctgataggtaatttttcaacccttgtcaccagccctcgatttctccctcctctttttggaatccccagtgtttattgtccccatctttctgtctatgcatacccagtgtttagctcccacttataagtgagaacgtgcgatttttggttttctcttcctgcattaattgacgtagtgtaatggcctccagttgcatccatgttgctgcaaaggacatgattttgttcttttttttaatggctgtgtagtattccatggtacatatgtaccacatttcctttatctaatctaccattgatgggcactgggttgattctgtctttgctattgtgaatagtgctggggtaaaaatacaagtgcaggtatgcttttgggagaacaattcattttcctgtgggtatatactcagtaatgggattgctgagtcaactggtaattctgtttctagttctttgagagatctccaaatggctttctacaggggctgaactaatttgcactccagccaccagtgtgtaagtgttctgttttctctgcaatcttgtcaacatccatgattttctgactttttattactagccattctgactggtgtgagatcctatctcgttgtggttttgatttgcatctctcgacatttagtgattttgagcgttttttcatatgtttgtttgccacttatatgtctccttttcagaactgtctgttcatgtccttggcccactttgtaatggggttatttgtttttttcttattgagttgtttaagttccttatggattctggatattagacctttatcacatgcatactttgcaaatattttctcccattctataggttgtctgtttactgtgttgatagtttcttttgctctgcagaagctctgtagtttaattaggtctcaattgtcaattttcggttttgttgcatttgcttttgaagatttatcataaatcccttgctgaggccaaggtctagaagggtttttcctaggttttcttctaggtagagcaaaactttaaatacacatttaaaaaatatattttcttcagaaaccaggatgcaaaagaaatttccaatattcctatattttattaataaatgtatgaatttgagcaatgaaagaaaacatctcaattcttttcaaaaaacacattttccttctttttggtgttgtaataatatgctcccaagtgacatggaagtgactacttctactggtcatcagtggtaggatgggagggtaccaaatctggcagcaaagaagtttacaaatcatattgtaaaaaataagcaattgtgagaaacggttattgcaataagttccagaaatcattatggacttccataaatcattaaactccatagcaaacttaagtacattttagttggattggattctggttcagaaagctaaaaaggacattgctgggacaattggcaaagttctaaaaagaactaaaaaaagatgatagaactgtaccaacatccgtggaacagaatagagaacccagtaataaggccacacacctacaacaatctgatcttcaacaaacctgacaataacacacagtagggaaagaatttatttaataaatggtgctgcgataactggctagccatatgcagaagattgaaattggaccccttcctttcaccatatacaaaaattaactcaaaatggattagagacttcaatgtaaaacccaaaactgtaaaaaccctggaggaaaacctaggcaataccattttggacatagaaacaggaaaatattttatgacgaagacatcaaaagcaattgcaacaaaagcaacacttgacaaatgtgagctaattaaactaaaggccttctgtacagcaaaggaaactgtcaacagaatgaacagacaacctacagaatgggagaaaatgtttgcaaactatgcatctgacaaaggtctaataatcagcatctataaggaacttaaacaaatttacaagggaaaaacaaccccattacaaattaggcaaaggacatgaacagacacttttcagaagaagacatacatctgaacaacaatcatatgaataaaagctcaacaatactgatcattagagacatacaaatgaaaaccacaatgagataccatctcacaccagtcagaatggatattattaaaaagtcaaaatacaacagatgctggcaagattgtggagaaatacactgttgatgagagtgtagatagtgtagattattttaaccattgtggaagatggtgtggtgattcctcaaagacctaaaaacagaaataccatttgacccagcaatcccattactgggcatatactcaaaggaatataaatcattcttttatgaagacacatgcacacatatgttcattacactactattcataatagcaaacacatggaatcaacctaaatgcccatcagtggtagactcgataaagaaaatgtggtatatatataccatggaatactatgcagccataaaaagaatgggaccatgttctttgtaggacagggatggaggtggaagccattatccttagcaaactaacacaggaacagaaaaccaaatgccacaggttctgacttctaagtgggagctaaatgataagaacacatggatacatgggggaacaacacacacaggggcttattggagggtggagggtgggaggagggaaaggatcaggaaaaataatgaatggatactaggcttaatatctggatgatgaaataatctgtacaacaaacccctctgacataggtttacctatataacaaacctgcacatgtacccctgaacttaaatgttaaatgaaaacataataaaaataaaacagggatgtatacacacacacacacacacacacacacacacacacacatgcacacatatatatatataaaatgatgtgcatatataatggtcatatatatatgaggtaaaatattaacaattgagaaatctggatgaaggagatatggagatataggagttctttatactggctttgcaaattttttaaaagtttgaaagtattttaaaaataaattatgtaaagggatcataccatatgtagttacgcattaattgtcacaatgtttctctgattatttacatcatggcatttagctttacagttaaactatttgtacaaactcttggtcatataacattctgagaagacaattaattttggctttgaataaataaaacactagaagaattgttttctccttaccactttgtgtcttatggccattaacaaaaaatactgatagattgactttactttttatgactcttttagttttctagttctagaacgtatattacaattttaagatctaattaaagcactttatcgcatacagtattgtctctttttttcactgttgaacaacatatttttaattttgaaattcttcttttccattactaatggtaagaattagatgattgttggttttacaaaaatcacaatagatggaaaagaaaacactgtattttctcacatgtgcatcaaataccagggttttggctcataaatcagaagagcacaaaaagatacaactggagtccttcctagttccactgttacagccaaaatgctgacattcaggcatatttccaagacccacgtttcggtaagcccttatgtgcttcgagtgggctgaaaagaatgtgaaataatttcacatggcaccttttacagaaggctgtgtgaggaacacaacattctctttgaaagagaaagtcatctttgtaataataaccattggttgctttcttttttttaggcatgtaataacattagaagatttactttggaacttgtttggaccattatcaacacgttagttttggtgacaaaatttgcatttactactgtagagctgtaatacctgaaagatgcaccatcctgacttgggactaagagcagctctcaacctcttttattcccctcaaaaccaacaccagtgcacaagtacctctgatattagataaaataatgaagctcacagtaattataatgcctattattttatcagcatctaccacgttctaagtgccttacattcttgatccaaactaatcttcaaaaccatccttaaagaaaaaaacttttcatgttacaaataaggaaactgaggcccaaaagagctaagcagcttgcctagcatcaaaatagtattgatggacaagaaattcacctgttctatgtcactctggaacctgtgcttttttcacaaaacctgtctgaagttagaggggtaacaaatggttactagcatggctaagagaagttacatgtggacagcactcggatttcaactagttggcagattatgcttgcttcagtggggtgggaaaactgacaaatcctctgacattagggcaaagaactttgttagatgtcatcattattacaggtgactctgatgccattttattaaaggctgtatcttctttctgtttctatctacaatgcttagtggtacacaacgcatgacaggtgcctaggaagtctttgttaaataaaagagtgaatgaaatatgtaatagagtaacttattgaatggcagcttaatggccttagtgaccagaattaactggtcaagagttaggggggtattgccagttaagatttcaagaacagttttttttttttaactgcagtatgggtgaagaagggtgaagtagaaaagtttacaaagaattaagaactgattttgaaaaatgataagccctgacctaatgaattacattttaaagcattctttagttatggaataggaatatataaaagcagtgattatcttcttttttcttcactgtttccaattggttgtattttttttttctctcctcagctggaaatgcctaggttccacagttacaatgtctgctgattttatattacttaagtcttgtagttttttcctttaattgtgaagccattcttacctaagttcaatcatattggaataattttcatactcctaaattagtatattagaattttttttcctcaacctatctttactagcataattaacttacatatatccatcctttagatttcgttttcttccacagtcactggaaggtggttcaaattctccagggcacttttatcttcccattcaaaacatgtccatttacattctccctggattgtgaagcattatgcactccatatgaatgtggaggcaccattttcttctgcctcctagtaataaactgctgtttttcatcagttttaatatttactttcaacagaaactgtcaagattgccattatactatttgctaataggaggcctgccctttttaaatatgctttttaaaaaaacccagattccttttctacagggccgaaattaaagcaggttatgaccatggcccgtgaggcatggttttatgactctgctgaaatctcagcctcctgctcctccccttgagggataagaagcaaatatgctttggtaagattgatgaagcaatgatatccccaagtatattcctattaagttccggtttcacagaacttacaacagggtaaaacccccaaataataactttctccagatatttatgatacatagtttataaattattacctagcaaaaatactcttgtatacaaataatcagtattttcttcaaagagagcatatttctggattaatttctgaaaacattcttagcagggaagtttccagaaagttggggactttctgtatcccttgacttttgatttctgtgcgacagagctcagtagtaaattgtccttaccatccctcatttaccttctaaggtactgagtcattgtagaatatttttaacatcttgtgtttccagacattgcttcatttgcaaacttaagaacatttaaatatttaagagtatttattttttaaaacagagatttcatacaagtgacacagctaagtccaaacactgtattatttatgtccccagcgcttgactttttgagtttcttttcttaatatttcagttctagagatttcatgtgatatactagataccaattactaaagtgttgttcagagagcagagggttaaaatgttttcttagtgaattctttaaaaactgtagctgtggaagcaggattgctcttgtttcatcctgacaggaatggtagatttaataggttccccagagctttttatcgcattataactctttctgtgatggtcagttttgggtccacattatgtgacctgactttcaacttgtttgaactgctgtcaggctgcagaggaactgaaggctactagatagtcctgtagttttccagttgggaaaacaacaatcctgcctgaaaacttctgacaagatccaatactgttcttcttatagcaaaactgagtcagcctgatacctggaaaaatctttacctgctcaaagtaaagcagtgtggccagaatgccttatcgtaatgtaaatctgtgttgctttgctctataataacagcttgtctatctcttgtgatcattcattccctgaggttgaaactattatcatgtcagcagagctcccttctcagttagcttgcattgctagccagcactcctgtataaatcttgatgtctcctaaatgttctccctagatccagtgtgtggtatttaaattaaggaagctcagacatgtcttgaaaggaactgaagtattgcatttagtcttgccaatccactgattaaaattcttgccaagtgttacattatgcacagcttccttattttggctgtaaatttcattgcatatttttctaggatgagaaagtttgtactttttatttcataagcccacataataaacacagctttcttcaaaaccgtttgaggtgttggatgcgtgtgctgtgttaaatatagggctcctttgtggaggaaagcacatgtggctcattttaacttcacacacaagcattttagacggggcaaaatggttctgctgggtaaaaagaaaatagacatttcgatgagctgcaggattatccaagccatagctttatcctctctgaaatctcttctatgcacttgaagaatgaacaaaactttctttatggacacagaagaacccactctcttctctcctatagccactgccactcattctgcccctgtattttaaatttttagtgggtgagtatgtgaatcgaaagctctcagagctggggggtggtggctcacacctatgatcctagcactttggaaggccaaggcaggcagatctcttgagttcaagaccagcctgggcaacatggcaagaccctgtatctacaaaaaatacaaatatttgctgggcatcatggtgccctcctatagtcctagctacttgctactcggggactgaggcaggaggatgacttgacctcaggagtttgaggctgcagtgagctatgattgcaccactacactttagcctgggcaacagagtgagaccctgtctcttaaaaaaaaaaaaggctctcacttttcactaaataaatgcttctctagcataaaactttgtgtagcgtcctttcagctaccattctgaagagaaaaccccaatgtcttagagagggaacaaatagatttagagggagattagcagaagccataaaatgcatactttggacccaatgactgggcctgcatttggaataaggggtagaaaactggataattcgctccatttacttctgtaaatgtatttttctttggtagcagccttgcaggagaagggcatctttgaaggtctggaggtggggctccactgacattcaaataacgcaggcctagggtacagggactgaaagctcactgcacttttgattcggattgggatcctcccataggttccattggcaaatgactactttcttaacaaaaagaaatagttctataattaatttttcttaaggaaaatcatatctcaacctattaatttagaaatattttaaatgagtacatggggatacaaatttagttatacaaatcacatgtgacactgttcatgctgttcgtatttcagtatagattaaaattttttaatgctaaaaagagcttttcttgctcttagagttttttttcatgcacatttccatgaaaatttagaagttatgagggcaaaatcttcatctatacacaaacacttttttttaaacaaaaaggagtaaaatttcatcaacattatgaactatgagccctattgaataattttttcctgtaaaaaacagaatcaagttatgaaatgaagaaaataattaggtctttgctaaaacttagtctttattaagcccaactttttcttaatcagaaaaagatgtcaaaaggaataattgtattgcttgacaaagtgatcaagatgttttctgctcctaagttatttcttcatgtgacaatcattccttaaagctcctcttaataaataatggaaagaaagaaagttgatgtttggattggggcaataaatgtcatctttatgtgtgtagtttggagaaacgggcttcttgtttgccatctcctctccagagttacagatacagtgtcattggtccttttaaaagtatggaaagcagagtgaatggcaaaaggtttgccaaaacagattatcttttgtatgcgtcaagattttatatttttgcaaatatacatacacagacaggcttttcaaaaccattttccttcagacatccaagtaaaagttcagagtgatttcttttttgctccttaatatttttaatcctttatcatcttacctaaagccatttagtatttcctggagcagatggggtataagccataaaatgacatatttacttctttgtaggaagaaaattaggagaagagattctataacacgattgaagtttaaaagctaaattccttgaggaaagattatctttctccatagatctcattctctgataaaacaaatgaggttgtctcagaggcacctgttaatattgacctacatcatccctagttctgaccttgtgtccccagccactgggaagtttttggtagaaaaggaactattaagttggttcgtttcttatttcttggaaagagaaaggtctccctccccttgcacttctgcttgatctggtctctgaaggagacttccacagaaacaagggcacaatctgtgccttgcaactacgcctatcatttcctctttacttaaggtcaaaatttccattactgcttagactctattaataatgggtttgaagattattttggggaattattccttcaaggaatatagtgttaggacctgcgccttgagaagggtctctgcctggatggaggaacgaggatgctcttgagaaagaactgaattgtgaattttttcttttcaagtaaatttcccagttgttttaaaaaaaggtatgttgccgagcttttgaggaactcttcagaataccagagatgtcttcaatttaataacatcttacagcaccgttttcaccagctagtatatcctttgcctgaaaatccctgtcatctacgatgatgaatttactcctcattcagactgtctctctgaaataccagaaaaatatgatcttcattctcctctctggaccctttagtagtacctaacatgagtaaattcagcctcattgttgatggaaatatcccttcctggtgaaaactgacagaatctaagcaatcttaaggtcccatggctaccagtctggcacattctaggtttttccagctgccatttcttctttagtggtgtggtcagttctcctctggccccttcagtgaactgtttggggttttacccactctggcattgtctttacaatgtttcgtcagatcagaatttcccagtaatttaacacttctgtaatgaccaaagagaaatttcttatccagaatgtcaaggaatatgtctcagataaatgagatgtatgcctacaacatttcaaaatggcatcaggcttcaagttacagaaacaccatccacatcctaggtagtgacttacacaaaacacaaagtcattttttaaagaaaacaactgttttctctcattgaatgagaagtagttcagggctaatgtgactccttcacagatgatgtcagagattgagacacctcccaactgttctttctaccacaccatagtgtagtcagcacgcccatgttgactagatggctgctgaagtcttacccccatgtggttagtcttaggcaggaaggtggatgagtaggaaatcaataataataaataataaataaataacaaagatctgctatggaagtaagccctctgtaataagcttgcctggaagccccacctaatggcatccacctccatctaaattggtcactcatctctttttcatctttgaaagagatgctgataaatgtacattctaaattgggcatatagcctgcccactaatatagggattctgttaccagggaaaatgagaattgatagtgggtaggcaaccaccaatctatgtcataatgacattttctttgatttagaatttctttttaaattgggatcatgcgtatgtggaagaaaatgcatgaactaggtcttaaaatattttgtttactatgaatttagcatctgaaaaatacatctttaacatactctgggcaggattttaatgagcttgacttttttgctctcagacctaatgatgagatataggtcattgtttcatatttttccaagagattttaagggtctactgtaaacatttatgagaaacattttttttctcatttgctatttcaagttcagaaagaggaatgaaagtcactgtttcttgggtatctgcatattatttagatcttagagtctaggagagagaagcatctcttggtttttaaagatcagtccctacgtttttggatttgagatgaagaatgctagtgtgtgatctgtaactaaaaactgctccagtttcctgatgtgtaaatatttattctattatacttatcatcttctcctaggatcacggcccaaatctcatcttcaaattgaccaacaagatgaggaggttcataacaagttattttttaagtcagcccaaggcaggctcaaataaattaaccaaattcctcacatctgtgaagcttcaagatgtggatctccttgtcattgcattgtattttcttagagatgtttcttctgctccctaaaggaaacactgatgctattcagtacctgacacatgaatctttcatgcaggctataggtgacctctaatggaatccactttttacctgattacttcagctatattgtttttcctccccaaggggttaggacagctatttaaccttattgttttgtgtcttcctttgagagtggcttcttgctttgtatcccttctgatgaggatgatgatgatgatgaatatctgtgtaacaaaccacttccaaagtttagtgacttaaaacaacagctatttaattattgattctatgggttcactgtaaagctggacagttctttttctgttatctggcctcactcatatgtctggtcagttgccaggaaagctgaatgctggctagtctaagttggcctccgctgagatggcttaatcctgttccatataatctctcatccttcagctagctgatctggactagttcacatgggagctaagcagagttctaagagagtgagcagaaatgtgaaaggcctcttgagacttaggacgagtactggcacagagtcacttttgcctcattctattgaccaaagcaagtcatgagattagcctagattcaagtggtagggaaacagattgtatctcttgatggcaggagctgcagagtcatatggccaagggcatggatacaaagaaagaagtaattgctgcaacctttatgaaaggtctaccacattaagattcttcgagcacttattcaggcactgtatgagctaagcactgtacatgttatctcattcaattctcataagaactctacaaggttgatactaatattatacccattacatagatgcaaaaattctaagcgacagagactggcattttgattttaaagcccttttaattaccagatctgtggactccaaatgttcttgattgtatagttctctcagtacaaatattttgaacatgtacttatatgtatgtgtatgtttgcttataaattacatacaagtactactgtcatctatatattaaatattaataaacttgaacttcattcttatctttttagataaaaattataaatatcaactaaagtttcagtgcattttttcatcctttatatgaatgtcttgtagcctcactttggagaccatgcatcaagcggctccttatgcccaagatatttcatgattcccatgtatagcgttaagtgaaacactgtttaattgaaatcctacttgtcattgagttcagttccagttccagttaatattgcttgctttcaatgcagacttttaagggtggggactcttcctttttggatatttgattaggacttgcggaggagcgtgagagcaaggctttaattaaatttagagaggctcttttgatttatgagagtcaggactcatggtttcatgtgtccagtgaatactcagatcacttaacacagggcccaattgctcatcactttctggagctgtgtcaataaaacaagataacgtggaggaatgcttctcaaagttctcagttggcagtgtgtgtctctgttatctgcagagattacgaaatgcagactctgggtttccatggctggagagactgattttacagatttgaggctgggtatgggaatctgcatttttactaggctcgcttggtgacattgaccacaattatagggccataaaatctgaattcatatctgccacttaggtggatgaccttagataagtaatctattcttgaacttgttgaatttcttcaactataaaatggaaaaggtggctgggcacagtggctcacacctgtaatcccagcactttgggaggctgaagcaggtggatcacttgaggtgaggagttcgacactagcctgaccaacatggtaaaaccccatctttactaaaaaaacaaaaaattagctgggtgtggtggtgggcgcctgtaatctcagctactcgggaggctgaggcaggagaattgcttgaacctgggaggtggaggttgcagtgagccaagatcgtgccactgcactccagcctgggcaacaagagtgaaactccatctcaaaaaaaaaaaaaaaaaaaggaaaaggtaataaagctcaagaccaccttgcaaaatattttgcaaattaaatttgtgataattttgtcaaagtgctttataaaatgtaatacattaatatgtgacccattccctaaaatgttgtcaatctattaaaagatgtattctccatactaaggtattcggtatattgtaaattacttttaatttcaatgaaaacgtgattctgagcttctctgccctattcatttgggtcccaaggaaagagactatggtttatatttcctttcttctctgcatgaatggaggtagaagacagtagggatttataacagactttaagttcaggcaaacatgggctctgaccccagcttctacattatcttgcagtgattacttaacttccacctgtttatttattaagtagtgatcctaatgaattcttcctttcaaaatttttatcatgattttatcatgattaaatgagatatagccaaaatttattgcatacttgctgcgtgccagacattattcaaagtgcttgtcagtttactcacgaaaatcctataattttgagtggaggtcctatgagggatcccattttaaagatgagaaaatcaagaaaaagagatttaaatggtggcactaggattcaaatctctgctgtctgacaccttaaccatcctctttctacttcgtaacactacctctaaaaagtgaaagctttcaagtcacttagcacaccagtgggcacacagcacatcttcaaaatatgtgacattattattgttgttgttaatattattatttgatttccccacagcttcatgcagaatgctttgtgcaaggtagttgtttaacaaatttatggtaattcgatttttaaagaaccctgttgtatcctcttgggcttctgagagatacatattcaatgagcgaagcctcttactttttaggctaatatgatttatgcagctgcttttagattaagttaccatcttttatttacaaaaaaagattaaataaatatgtgaaaatccaagaactccaaaatctccctgtgaaaatccaagaattccaaaatttcccttgctaaaaactgtttagaaaatcatctttgtaagacaagaaggagacaaagaccaaacctacttttgattggtgtacctgaaagtgatggggagaatagaaccaagttggaaagcactcttcaggatattatccaggagaacttccccaaactagaaagacaggccaacattcaaattcaggaaatacagggaacaccacaaagatactccttgagaagagcaaccacaagacacataatcgtcagattcgccaaggttgaaatgaaggaaaaaatattaaatgcagccagagagaaaggtcaggttacccacaaagggaagcccatcagactaacagcagatctctctgaagaaaccctacaagccagaagagagtgggggccgatattcaacattcttatagaaaagaattttcaacccagagtttcatatccagccaaactaagcttcataagtgaaggagaaataaaatcctttacagacaagcggaggctgagagattttgtcaccaccaggcctgcgttacaagagctcctgaaggaagcactaaatatggaaaggaaaaatcggtaccagccactgcaaaaacataccaaattgtaaagaccatcaacactatgaagaaactgcatcaacaaatgggcaaaataaccagctagcatcataatgacaggatcaaattcacacataacaatattaaccttaaatataaacaggctaaatgccccaattaaaagacacaggcaaattggatagagtcaagaccctttggtgtgctgtgttcaggagacccatctcatgtgcaaagacacacataggctcaaaataaagggatggaggaagatttaccaaacaaatggaaagccaaaaaaaagcaagggttgcaatcctagtctctgataaagcagactttaaaccaacaaagattaaaaaaaagacaaaggcattacataatggtaaagggatcaatgcaacaagaagagctaactatcctaaatatatatgcacccaatacaggtgtgccaaggttcataaagcaagttcttagagacctacaaagagacttagactcccacacaacaatagtgggagactttaacaccccactgtcaatattagacagatcaatgagacagaaaattaacaaggatattcaggacttgaactcagctgtggaccaaacggacctaatagacatctacagaactctccactccaaatcaacagaatatacattcttttcagcaccacatcatgcttattctaacatacatccacaacacacttattccacataatttagaagtaaaatactcctcagcaaatgcaaaagaacggaaatcataacaaactgtctctcagaccacagtgcaatcaaattagaactcaggattaagaaactcactcaaaaccgcacaactacatggaaactgaacaagctgttcctgaatgactactgggtaaataacgaaattaaggcagaaataaataaattctttgaaaccaatgagaacaaagacacaacataccagaatctctgagacacagctaaagcagtgtttagagggaaatttatagcactaaatgcccacaggagaaagtgtgaaagatctaaaatcgacaccctaacatcacaaataaaagtactagagaagtaagagcaaacaaattcaaaagctagcagaagacaagaattaactaacatcagagcagaactgaaggagatagagtcatgaaaaactcttcaaaaaatcaatgaattcaggagctggatttttgaagagattaacaaaatagatagaccactagccagactaataaagaagaaaagagagaagaatcaaatagatacaataaaaaacgataaaggggatatcaccactgatcccatagaaataaaaactaccacagggccaatttctaaaataactggatttcactaaatggtgcatttagtgtttttcaaaatctgtatttagaactttgtcttggttctcttttatttttattttctgatagctctacattcattactgtacagtacctgatacgtttctgctcaatgctttgcagcttgttttttctcttttcaggatcaacttgttcatttgcttataaaatgatgagctttacctgaggaatgccagagaggcagattggactctctggggcaaaataatcttaagttaaaaaaaaattgaggtgttttcatgtcctatttcttttgcctttatttaagctatctaaacagtggaataagactattctataataacatcttcaaactctaagctccaaggtaatatgaacaaaagtgacaacaattcccctcaagcataactgaaacttatctttctatcccgctctcagacagtggaattctttaggctatagtctaaggaaagctaaccaagatagcctaattaataggctgaagtcctctgaatttagcctttgctagataattggagaaaatatgtcagggagtcaaaatccttgccttagttaaccatctgcctgcaagcattttggccttcttatcagggtggtaaatgacaggtatgtcagtacagcagaaagcctagcctttagaaggagctgcagctagactcccctcagtcctgacgaagagcagccctgtgagtgacctcagtgttcaccccaatactagctgaccttaccacaggcagtctttaataagtctctgttttaatcttctgttagtctggtttcagtcactaagtaggaggaacagctatttcaatgagtaggagagcttggctttgggtactcaccgagtcttcagactccagcatgattaaggactctgagacatacctagggcaatgagcttggccaatacattcattctagtaataaaagctgatttttttgcacaagtttaaaaaaaacagtgatccagtggaacaaaaattgccatcatgatatttacaacagaaatgaatgtatttgttaaggcaaactggtgttgcaaacatccccaaattgtagtggttctacataataaaggtttatcacctgattcacagtctagtatgggaagtgggagtggagctgtgttccacacagtcatttagggactcagacactttttgtctggttgctgcaccatctcctgggtcattggtgtcctgcctgagcccctgcattcagcctgcagacaatggaaggtcatatggaggaccttgtgcaggatttttatggactggatgtagaaatagttatatcacttttactcatactctttaaacaggactcagtctcacaaccccctaaaattacaagagtgtttgggaagtactgtcttgctcatgtagcccaggaataaaaccaaatgggctttggtgaacaaacagcagactagccacagtggtcttgaaaaattctatatattgtggttctatttactgatggagcttagttgtcttttttcctataatatatatatttttggtatgataagaagcatagacagtcctattgctctctagaagattgtattccacttttttccctcttttagatttctgatcttgggttctattcttttcttctttagtggtgattaggtttagatgatctctgtcagcccgagtacaaactatgggtctcctccccatctgcctccccagggtagatgtgagaagtgctactgtgttgtattccacatcttgccactattcagcctgctgtctttttattctgaccctttgtgaagtcaaaaggcaaggttttctgcagattgaactagacctgagtggagaagggggtgaactttcagattcaatgaattataacacttctaatatagaacctcatcaccagatttgtgatgacaacactagctgtgtatttgactttactttttactttctaattccttggatttgagtaacctaaccatttcctcagtattatcagaaaaaaaaaaacaacacattacttttcctcccacatttaattgaatcaaaatcaactgtattaagcagttacagagtcatttattaagataggtggggatatacaaaagaataagccacctcctgcttcttcaagaaactgagagtaaggtgggaaacagacttttagcatataagcattctgctgtgtttatgtaatagctataaaacagtttataaatatgacaataagggtgcaaaccagaatatgatgggaacataaagagacatttattttgtccagttgtaaatggtttcttaaaagagaaaacatttgaaatagaaattgaaaaatgggaaagacctcgctaggcagaaaaggagagggaatagaaagcctgggtagagggtaccgtgcaaaggacgtcatggtgcctttagagaacagcaaggtcatgggtgtggccaaatcagaggatgtgaagggagaaagtgtaggaggatatgagagttgggaggataagttggaacaacatttatgaagggtctaaacaccttaatttggaattagtgttttacaatgtaagatatgaagaacaacaaacatgactttaatagagaagcagtaagatcagactcacattttataaaaataagtctagcaacagaattgacaatagattagagaattttaaactcttatattgagtttgtacatataggggtattacctttttgtctttcaaagacttgcttttgagcatagaattgatacaattgatattaccattgcccttttctcccacacgctttttttcaagtgccacaaatatagctctgaaataataggagatcatattttaattgaaagtgtggtatgtagttccattgttctataatgaaagactaacatgtatcagatgaccttcataccaatagtaactaggaattcttgacaaaatataagcaacaacagaaattgtttattggcactagcaagtaacttaaaataggctgaaataagagagattctatttgtgacataaggaaccacactgagtgagagccacatttaagagatcatgtgacttggaccctgagggtcctacttaactcatatggtaagtggctgagagggctgaaatagaaagcaatagttattcacatgggaaaccacaggactgaattcaggattgtcagaataggaattaaggaggagatgccagaaaggagagagtcacagatgaaggagcccaaaatctacaaataaatccctcttgaatccttggttgagtctatgcatatgcagagaaagactctaagaagcctaggaagaaaatgaaagctagaaggtgtaaataactgagaaaataattcagcagcttcttaactgtatgtctatagaatttggaattttagttctccccaagttagagggggcttggctaacatcttgggttttccgctgaaactccagaagggctatgcggtaggagtaaagactacatcctggcattaagggatttatcatagaacttaagaaaaaattgaaatagacccaccttaacgaaacgtccatattacttggcagtattttacctgcctgctagaacaaacttctaagataatagaatcttctaagataatagaagataatagaatctaaagcctctaccatatattatacacaagtttcaatatgccatcagtaatttactagacatgcaaagaaataagaaaatgtattccagagtcaaatgaaaaatgagtcaatacagacagacccatagctgacctagataatggaattggcacatagggacattaaaataactatgtcacatctgttaaggaatttacatgactagataaaatagaatggatgaggagatgggaaatttcaggagtcataggaaaacagtaagaagaagaaccaaatggaaatttcaagaatgaaaaaaatgaaatatttgaaactttaaaaagtgaaatggaattaataacagatttatcacaactcagtaataaaaagacaacaaaaattagcaaaagacatgagcagatacttccaaaaataagatatatgaatggccagtatacatttggcaagacatctagcattattaattatcagggaaatgtgcattgaatactcctttatagtcattagaattaccaacattaaaaaggctgacgacaacaagggactgccaaaatttgaactctcttacattgctggggttatgtgtaacatggtaatcactggggaaaactgttatgttagttctttataaaataaatatgtacttacctagtaatttcactcaatgatatttgtccaatggaaatgaaaacgtatagctacaagatggtttatacaagtatgcagattgattcataatagctaaaaactagaaacagtctaatgtctattcacagatgaatggataaagaaattacagcatattcaacaatggagtattacaaataaaaaggaagaagtctaaatatatacaacacaggtgaatctcagaaatatttaatatgtggagtaaaagaaggcagtctctctatctttatataaagtttgaagttatatagcaggtaaaacagttctggtgatcaaagtcagaacaggaactccctctgggtgaggggaggggaaattgaatggaaagggcacaaggtagctttttgggttcagggaaaggttttgtatctttattagcatcatggttacataaatgcacacagttgttaaaagttgtcaaaactgcacacttaaaatctgtacatttgattgtgtgtacattataagtcataaatagaatggatgggaatttaaaagtaatgtaatagagtgcttcgatatgccacatgcaggaattgagaagacagtgattaataatggttaagagcatggttgcaatatcagataaatctggggttttgaatcacgtcgtgagtactttgtgaatgtaagcaagttactaacctaagatcctaggaaatggagatgataaaattaatatttaccttataaggttgtccttagtgcagtgcccagcacattgatgcatttggtacatttaagctgtagttattattattaaatagctcttcagctagactttcactgcccgagtgcagtcaggaatactgggataaccatgaaaattttgagaattagatatctgcaaactgcattaaggagcaatctaaataatgcaggtaatatttgacagcatatgattaagtatactaggaaatcctattttcattatctatttgaaagcaactaattacctctttgccaagaaaacgtttactttaaaatacttttcttaaagctcttgtaaaaaattttcatatatagagaaattaggacttaatttttcccttatacagtaatctcaccctctgtttcccatctcataataatatcaccaactgctgcatatattttcagtacatatatatatgtgtgtgtgctgaatatatatatacacattacatatatatattacattacatatatatatccatatatatgtatattcagtacatatatatatgtacgtgtgtgtatataatgttgtaaacaaaatggtaaccatactatatgtacttttctaaacctggcattttcactgagaaatcttttcatttgaaggactctgtttacctatagctggtctattcattttaagtggtgtattacagtctatggcattgatgggcttttatttatttaaccagctcctgttgatggacatctgagtagatccaagttttcactattgtaaacaactgtgacatccttgtatacgtattttttgcacttgtgttaataatttcatgtaataaatttaaaaagtaaaaatgctaattgaaagaattttaacaaaatatattaatgtttctttgtaagagaaaaaactttatttttatttatttattttttttgagacggagtttcactcttgttgcccaggctggagtgcaatggcacgatcttggctcactgcaacctccgcctcctaggttcaagcaattctcctgcctcagcctcctgagtagccaggattacaggcatgcaccaccacacccggctaattttgtatttttagtagagacggggtttctccatgttggtcaggctggtctcgaacatctgacctcaggtgatccgcccgcctcagcctcctaaagtgctgggattacaggcatgagccactgtgcccggcctttatttcttctttttaaataaagaagaattatttcaaaatttacacaaaatttgatttagagtacttaagataactaccaccaaagggacacataacactgtactagacactatgctgaatgccttccatgcacaaaattattcaaattttatgcacaactttgtaactgtgtgagatactaccattattgacaaggacttgtaagaaaaccagtgcttggagcatgccatatctggtaaatgtttaagtctggatttcaacctagattttgcaaaacatgcagtgtagcgtagtctggagtgaatttatttttttgtgagtgtctttgaggttgaggatcattgtcaaactttggtgatatgcaagtggtgaagtaataaagcccagataatgttgtttccctggaacacttgtgaggccaaaagtgatgcctccctgccatgcagtggcagcagaagtcaacctggacattagacaagttatacttcccttagtgccaatagcctgtcccatatccagcttcgtcttaaataataataatgataatgataataaagatcaaggatcaattacatggtgttatggactgtggagaggagaagtcttcagacctctaatattctatctattttcacattccagttactactactctctcttttcctttattttataatcttgctttttttttctatccaaggggcccattcaataataactaaagccccaaatcctcaatttcctaatttatgtgtctgtgatcttttagtcttctacccttctacctgtgcactcacacacagagaactttaatttccagcgacatcaaatttgtgctctcaaaaggtaatttgtgatgcctggatgtcaaaggcgcccagatgtaaagctagagagctgatgagacctgaggctggtcacgggcacaaagcctgcccttctggcagagtcggagcagcactgaagttctgcttcaggccgtgccaagtgagagtaaggggtggtcttatgggtgttaagcaagacctaatctacccttgcgcagcacccagtcagacaccctgcagaaacacaatcatgtgtgtgtcattctgttgtggggagaagttgctcaaaggtttggttttgattttggtagctttaattctactccttcagttttgaggtgagcacaaatgtttcagagtacctttctaggtttcttactgacttttttcttctctaacctgtggtgtgttagaggcaacatgtaccagctcgggaaagagagacaattgtgagcatttcttctcaaccctgtgttcagtgacatcaagttaatagcttaaaattggatatggggaaaggaattataccactgaaatggaaaaatgctacatatcaaggattctcccaccccagagaacctgttgtttaactagcacacaacttctataacccttctacttctgttcaccacataacctcaccccccccccccggcccccgccaacacacacacaaacaagctagtgtttgaaacattggacaccctgggttttcttccacgggctatggttatttacaggaagaacaaattgagttctcttcctcttcccatcttgagctttatatttatttccaaatgccaaatataagctaactttcttctttctcccttagtggatggctgtattcatagagcagccggcccctgtttgctagctgaatgtcgtaacctgaatggctgtgatactggacatgcaaaaatcacatgtggctatgaccttcctgcaaaatgtgagtacaactgaatactgtttcaaaaccagatgagacatcttaacttgttttactccagtgtataactggaaaaggaaatggcagtggtggtatttaattaaatgtgcttgagttcagattttgtacatggtaataaaaacgtgctttccaagtatgtctccaaatatatacatatatataaaatatacatatactgtgtatattatatatatatatgtatatacacacatatgatgtttaactattcaggtctttgacagagtgtctctgaaagggaaataaaaacatgagcaaaatatacattatagcatttaagtgccacagagtgacagctcctggaaatgatgccaatttcttattccttgttcaggtttcttgattgtggatgtgtttagagcaaaggagatcaaagtgatgtattgtttttccagctgccatgtaaaggctgattggcaattacagccaaggcatctgtcacactttgctttcaggaaaagccaacgaaatctggttgtcagtgtgagaatgtgtttgctctttgaatgcggaatggtcaaaatttccgttatattttaatagagagaagtattgcatttgattgaccttattgcttagtgattcaaccaactgggtggcatggtatgggataaaatacttagagagaagctggtcagtgtcatagcttttttatcctgtaatcttcagggcctgaggttggaggtagagggtttcattgcatcattaaggtgtgtattgacctggaaattgagacaccaatttgttgattatcacattcgtccacttcttatgatactgctgagatctgtggaatacattttatgtaaaagtgaagctggttttgatttttgttttagcagtggagaaaatatgaatgaaaatttataatacaacctataggatactatgggttatatatagacaggttgtcataacagtgaatttcttgtggatgtgtgtgaatggagaatagcgtgttatattttaaagattactgtaaaggtatgtttaaatttgaggacttgtagcaaatagtaatatattaaaacagtatttttctttatcaatataatattgcatcctatattgttcataatggtttcagtgaaagtactttcatgtactgcatagcgatgctttggtcaatgatggaacacatatatggcggtggtcctataagattataatacagattgagtattccttacccaaaatgcttgagaccagacatgatttggatttcagatctttttttcagattttgaaatatttgcatatacaaaatgaagtaatttggagatggggcccaagtctaagcacaaaattcatttatgttttatatgcaccttatacacataacatgagtgtgatattatacaatattttaaataattttgtgcatgaaacaaagttttgattgtgttttgactggcctgtcacatgagataaagtgtggaattttccacttgtggcatcatgttggcacacaaagttttagattttggagcattttgaatttcaaaacttggattagggattcaacctgtactatatttttactgtacgttttctatgtttagctatgtttacatacttaccattgtgttacaattatttgcagtattcagtacagtaacatgctgtacaggtttgtagcctgggagcaataggctatagcctatagtctaggtgtgtagtaggctataccatctcggtttgtgtaagtataccctatgattacataacgatgaaatcacctaaggagtcacttctcagaccatattcctgatggtaagtgaagcatgattgtatatcaactatatatgctgtttaatttttcctttaatgatttttcatttatttttctttgttagtatctttacctagtgtgaaatagtcaaatcatgtgccaaatggctcttcactactacttggaatatgtacttgtgtcaaacaaaccctttgtgtagaatggtgtttagagcagttctctttgtaactcagaggtcatgatctgggtattaacggtgatttctctctccagaatcatatagtgctatttttacaaatattggttcttttgctttctaataccattctaccttcataatttacctaacttacactgccctgagaacaagcaaggttgttgactgctacaataatagcaagattattgactgttttcagacttgtatctgtccttaaaccaagtaatattcccagtcccctattgattcactgttttcttttttatgtattaaaatacaaatcaaatttctccaaatctgaactttctaaagaacagtatactcagaatcattaaatacgcccaaataaaatggtggctgtagtgtatgggttcacactgtgataattttttaaatgtgcttgtatctgtttgacatccctttgaataagttattcagtttcctttgaatacaattcatcttattttagggttattgaagacttgcacaataccaggcactgaggaacaaagatcagtgagtcaataccagtgcttgaagaattccaatgcttgagtcataacttcgaactgaagtgtggctttcatgggcatcctggggcaaatggatcttttgggacaatgaagctagaaatgaccagtcaatcaatgggactagctacagaatccatgagagctgagatcctgagagccgacagatactcaagtcactgcatgcagcccacagggcatgtttagtaaaaactcatccaatagaatagaaattaccagacaggcattgcagtgccacctcataaaagtcataaacatggaatatttgtgactaggtcttgcttcttcctatatatttaaaaggttaatgatttatattaaaagcataaaggaaagcaaggaaagcaatatgaaaatggtaataatagcttacatttttatgccactttataatatttcacagtactttcacaagcccttatatttaaaattatgtttgataaacattgtgtgtgttcattttccctttccctatccctgagagatgtttttctttctcatcaatttggttcatccatttcagagtcattaacaatccacagatgtgcttttgtagtgagaatgaaaagggagctcgttacatactgtttgggtcatttttcctctccatatttaataattccatgacagtttgacagcagagactagttgctatctgtcctctgagacagcgggtttatcattataggggtactaaagccagtcatccagccacaagtgataatatcttcatgcatcagcaatttgtttggaaaatgctattgtctgggttacagacaaacttcatagttttgaactggtttttgcctcttttatgcttgctaaattaatctattcataaatggttgtatttgaattaattatacttgtattctgtgttctgtgactcatcataattagtagaatgataagccccagatatttagtttacttttcactgcttggatgttttgaatgatttctttttgacattaagaatatccaatcattcttttcaaaagaaatcttaagggtagaaagaatattggtcaatatttcattgaaggctattgctaaggaaatgacttagaaagtagatggaggattgtttatgtaattggatcttttgggaatcttctctacaatattagatatttttgaattcataatgcaatttaaatttttatagatttttagaagcttgttgacatatgggacatttctattcatgctatcatcattccgccaagtagtcagcttcacataggcaagatttgtctatctcagtcagttccaatgtcagtatcaatcatagtgtctcctaaatatgtgctgaattaatgtgaataaatgaaggatcagacgagtgaattatttcaagacttcttcacctgaaaaatagtttttaaaaacacttttgcctctacttctaatacttttccttccgcaattattctgcacatttctagtaaattaacattcttaaatccagagtccttaaaattgtctacaatgctctacatgatgtgacctttacttctctacatcatctccttctgtgcttcccccactcacacaggctgctttgtgtgaacctggtcctcaaagcctttgcactggcattccttctgctggatttctattcttctagatacctacatggcttgttccttacctacctcaaactcttgttcaaatgtaacatcaggtgtcaccctaaccaacctatttataattgcttcagtttttaaatttgtaattgcttacttgtaaagttaatcttcaaatagcattatatcatttacttatttcttttgtttcttatctgtttctatctaccagaatatgggcacagattcttctttcttcatttttctaatgtattgctatattcatatagcttaaaaaatgtgtgatatataataggggttcaaaagatatttgatgaatgaatgaataaaacgtaactctaatcctctcaaaatccgatagtggatttttccttaaacacagactcattagcctgattacctttggccttccactgaactacttacaaccttttgtatgatatgaattgctcacaatggtgtgtctatgcatggggtctgtatctgagctatctagaaagctctttctttgctcctttcacttgtcttccagactcagttcaaatatcacttctgccatgaaacaagtcttctcgcctcacctcagctaaaaatgccttcttttttcttcacactccagaatacttcatgttaacatactgagggcacttgtcacgtgctaccttttattgttggatatgcaaacttcccacttttataacagagtaccttgtatatcacaggtactagagaaatatctaacaaatgaattagttattgaaagtgtcaaacctggttgataattggtagtaggtggaatataaaggaaaaattatgctaatattcataagaaattatgaaatcagtgtcaattatccattgtgtttttaaaaaacatattttaacatatatatactacaaagtctcctgtctccaaaatttactcttaatggagtttctcctaaggagaaaaaaaaataaaaataaagaaaccatatcacccttatttgatggttttcagcatagctcacatgtctattttatttctttagaatgcttctctcttaggcttcagggctgaatagtcatcaaggataaatggaaaaatattaaacttgtgtaaatgaaatggtggaatctgtttcttttatttcttctatttaatctttggaaggcatcaaggggtaatattgactaactcaaggttttcattaatcatttgaagggaaactctaaggtgagagaccatagcataatatgtttgaatgagtggtatgaatcagaatacacattctattcccaggtgcaataataatcagatgatagtagcttaaaatgtactgttgataataattagtacttcttttctgccctttatcaagaaatcatagtactttgaaacagtagctcatcagtccttttgaaattcctatgaggaggtgacgtgacaagtaaagttttcttacaacacaaagagaaatacaggtacagggaaaataaatctgttgctcccattaacaaactaaatccatattagaggcatcgtggtggccaaggatccctgagctgggaaaggagtctctgttaggtgttagccaggcctgctgcctgtttttatagataaagctttattagaacacagttgtggccatttgtttacatattgtctatggctgctttcatgtggcagagttgagttgtagctacagggattttacggccacagaacctgaagtgttcactatccagcctctgtggaaaaagtttgccagcccctggtctgtggcaatctgcacttttatttttatttttttctccctgagtcagacggattccagctctgtcgcccaggctggagtgcaatggcgcgatcttggctcactgcaacctccgcctcctgggctcaagcgattctcctgcctcatcctcccgagtagctgggattacaggcatgcgccacaacacccagctaatttttgtatgtttactagagctggggtttcgccatgttggccaggctggtctcaaactcctgacctcaggtgatccactggcctcagcctcccaaagtgtgggattacaggtgtgaaccacagcacctggccaatcttccctttttataaagtaagaaaggtgagattcagagagactaaatattgaattttattaaatgaattactacttattcagatcaaagttgataaagttgagactaaaatacctaccctctattccttgggacatccttgcttctgttgcctcaagagaacattaccttgggaagatgatctgaaacctttcaaatctttcaaataataaggccaccttgaaaagaatgcctagaaaaatatggtgatttttcccaatagggccagatctgggaagtgagtaagtcgagtctctcaagggagagtcagtttaaaccaccagagtattaggaagcaaatctttgttccttgtttcctccagtggtgttagctgcaaaggagcctgcagtccacaggaaatgcagtttctagagcaggtaattcataagatggttctgagttagtcctttgcaaagggtgacctgatttcagccatcgtggactctcccagcaggtgtctgattgtgaaagcagtggagtggacatgctgctaggagtatgactctgccagcctttgatgaagacctgagggccctcatgagccccttccataatcaaatgacttatattacacaaagagaaaagccgcttttgaagatcataaaatcatcttcctttctgaagaggaagatgggattgttcctcctaaaatcaactcggattggctcattttctttaagtgcttaaggaattcaggttttatttgaatctatttctccataattgtcacccttttcatttacattaagcagtttcatacatttaatctccttagtgatcctcatgatgaatgtggaaataagaagggcagaaatattctaaaaaccagagcagtggttctcaaaacgtggttcctggagcagcagcatcacctgggaatttgtttgatacaaattctcaggccccaccccacacctactgattcagaaaccctgtggtttaacaagttctccaagtaactctattgcgtgctcaagtgtgagggccattgccctagagagtggtggaatccagtagcacccttgccttgagatttcttttggctttacaacacaggtatccatttgggtcacagattagggctttttttgaagagaactctgacacgttcttcttttcctttatagcattttccactagtgatgacatctgtgtttgtttatttgtttattacctgtctttttagacaaaataacattttaagaagggaaggtgtcctatgggtctcatttacccctgatatccttagcatctgacatagtacccagaacagagttggctcttgatacatatttactggaggacttaatgaaagcattgtttttatctcctcttgtctttgtcataatcatagctgccctgcaggaaaccgagcaagaagacactcaagagagaacaacatgattccaggaatctgcagagctagtactcctgctgcttttagcatctctgttatcccatcaccaaacatactgcctgctcaaaggctagcagtataagaaagcacaggggccaaactttgcttaatgtatccacatgccacatgtctgttctatgcttagcttctttcattttctcttattttgacccattgtgataacatagagtccacccccaaatggctttgtgatgaaataacttaatgattctaatactaaatgttgtcttttaaaaaatatctaccttttggaagcaactggtgtttacactgttgtattactggctgagtgtagaattaaacagctgtgttttgcattatttgccatcatagcaagcctttagaggacgctgtctatacctcctatttcctatgtgatcaataggaaataacagtgtaaatcaattctaggtaataatgtaaatgggctcttgaaggcaattcctgctgtgaaataagtagttagcagtgacactggcattaaccacagtgggggtaatcagcctttggatgtgtttaatcagagttatcagctaagattaaaaagagagccactgttgtacagggataatcattttcaggatttaaaagatgaatatttggaggtgttctcataaattaaagccatcagaatggctttgagtaatttaggatgccctgaggtcaggcacaagcaaacaggaaaggttaatctcagagctacggtagctgatgtgcagagatggcagaatacatttattgaaataagtagcaaatgctgagtaaaagtgtagattttttttctccctgtgttaagatgttccttgagctattacttacatatatgatttgattaaaaagtagtccacagtgaacacttcgtgaatgtattaactctccctgtaattaatcactaatcccaaagattaaatattaggccatgttatgacttgattagaggtgtttctacttgaaaatattgatgtaaccaagctctgtattatagaatgtaagattgattctgtgtcaagaacactaaatgtcatggtagaagatctgagatgcataaatgcagagtgttgtaattggtaaagtccttaacttctgagcctgaggttccttatacgtgattgtctaggagtgtgaagatctcactctggagagtctgttaagccatatacgcagaaccgcttcttaatactgtcagataagagagataaatggctctattattatttgtaaaatacatggcacacttgatttgcttgttcagcccatgttttattgagtacttactcacagctagagtgctcttctagagtgtagacgactatagtgaggaagacagcaggccccttgtcctctaagagcttaggtcctagcagagagaggatgctaatgaacaagtcacataaaagcaaagaacctcagataatggtaagggctatgagagaaaaaagatccccttaccagatgtatacagtaaggatagttcatacatttttgaaatgttctcccttgctacaaatattctatttcagttcttacatatttgtaactttagtctaatttttggagataacaaagggaatgctgcttctgatagagctgacaggaattttaattattacctatttgatctcagaattttacagataaagtaaccgaggcctaggaaaattacttaatttttcccaggtcatgtggtaagagacagtgctaagactatagcctgacttttagtatagtgatctttctgctgaaggtactgcctctcttagtctctttgatcataccaaccctcttatagaagtatggtgagaatttaataactgttaagtgagatgatgaacatgaatgtatttttaaaataaaagtttcttatctcatatggtaccttattatttagtagtaatttgtagtaatattgcaagtaattttagatgagttacatataaattaattatggtcccatgagctttgccaataaactttatgacaataatccatcagtatatgtgcaacagtgactggtgtttgagaaaatatggaagtcccagatagggattaataaatattcaatactagcctcaagactcagacatttgctcatgtctctttccagtatcttgacctcagagaaaaggggtactttaaaagttattttgagaaacttcagatgacagctttattggttttaaagatatgtccacagattctttgatatttctcttctggagagctagagcttaattcccctctacttaaacatggcctggacctaatgactcccttctagcaaacggagtatgtcagaataatgggaacatctgaaactagtttaaagaaaagactgtggtttccctctctctctctctctctttcaattcactctgtattagcttcctagggctgctgtaacaaattaccacaacttgatggccaaaaaaagcagaaatttattctctctcagttctggaggccagagagccaaaatcaaggtgtcagcaggaccatgccccattctgaaggttccaggagcagatccatccttgcctcttccagcttccattggcctcaggtgtttcttggcttgtggcaacataactgcaatctctgcttctgtttatacctgacatcctccctgtttctctctgtctttaccccttctcttctcttataaggacacttgtcactggatttagcactcactcgaatccgggatcatctcaaggtctcaagatccttaacttaattgcatttacgtagatccttttccaaacaagttcacattcataagttccaggtatcaggacacaggcataactatctggagtcaccatttaattcactacatactctctctgagcatggccagtttctatgtcatgaggcagtctagaggaggggaaaaccagctaccatgttgtgagggaactcagacaccttctggagaggcttgtatgctgaagaactaaggcctgcctgcagcaatgtgagtgcgcttgcaagcagatcttctgaagccagcccacagccacatcagtgagcttgggagcacattctcctgcccaatcaagctttccgatgtctgcagccctggctgacagcttgactccaacatcatgaaagaccctgagccagaggcatccagccaagccactccaaaattcctggcctgcagaaactgtgagataatacatatatgtttttttaagtgcagggtaatttgttacgtagcaataggtagctaatgcagcaactatgatcctgaagtttataaagcaggggaaagggctcactatcagagtgggggatatcaatcacattttctcagtgcagaacctgcctgtgtcagagacaggcctaaattggaaaatgaaagccaaatcacatggtgggtaatgttacattatacaaccaaagccctttgccataccattatcataggcagcatattacattggaaaaactattatgaacgaaaacttcttagatagatagatagatcgatagatagatagatagtcaaagagaacccaaagtccagcttagtaaagaagcattgagagaaaaacaacacaaaccaaaacacacaactggatattaatatctacctactcctgttactccttgaccatgctctagtctttacctttgccactcacatgcttttttttactgataagaattactgtttctattttggggggaaaattaattcagtttctgtcctctgttaatgctgtgagctaagtgaagcagaggtaacttctcatccgcatatgttgtgatgcccttctaaatgtgtttgctgtataagctggtgtgtttcccattagctgttttatttttcagaactaccgagagtttgcttcatttttaatcacgtgctatttgtgaaatccctgtaatttcctaaggccttctggagcttgcctcttcctacctgtgacattttcaggaaagatttattctctctgtgtgtttattctgcttagtgaagatcatgagacacagccttaactggagttttgcaagttctttttaaaattgtgtctgtattgtgtttggagtctagttacccatttggaggtctgtggagggcaaagggctctcttgggaatccctttcttttactgatgctcagtgtctgctttctgatattatggcatgtgatgacaaactattgtccttccgtactgggctggttgagtttgttcttgcttttatgttactcctatacttagtacagtatattaaatacatatacatgtcatctctcatgaccttcattctcatgtagaacatatatttccttctgagttataatatgttttgtgaatatggaattcagggattgtgttcagtttgtggagctgtttgggaaagcagtctgagagagtgggtttgggagtggcttgacggaactgggatgaagggcactggggattccccaggaaatccgttggctggcagagaagagctaactgctgtgctggctaagctcatggaactgggctttcctccatatgtccgggatatgtcctacctattgttttaaaattaacaaaagttattttgattttcttcctcctaataatacctattgcctgagaagaacgatgccagattgagaaaccccacatcaaaatatatccaacaaaatggtcagagctttgtacatagaatattccatagttagaatgatccatacagctatgcacaaagagggagccgaaacagggaactgcacatcaagagttaatacagtacttttagcctttccttaaattctctgtgttgtgcaatggcaggatttctccatataccaaattaactgattgccgtgggcactaaacctgttaccttaaacacattcatatcacactacaagtaatatcttatcctttatacttattttgagattaactgtctatcacacagccctctttcctcccatattctcattttttttcttatcactccattcagaaataagggatcgatattttaaaggctgaatgtgagatgtttctatttattgttcatcatggtaattagcaactttttaattatcactgttcttgaggatgtatgtttgggaacagtggagctttcggtagagtcacaatgacagcagtttaaagctggaaagaaatctggaaattgcttttctggcaactgacaccagtttctaggcagtgcctaagaactaggcaaggatttttaccctgttgtttaagactgtacactttgcatctcacaatctatctgctacatagtaagcaaatggttcattcaggcagcaatcactgatttgctccctaatatgtgccaggtgctttgcttatttttttggaaaataatactgtgcaaaaacagacagggacctcaccctcatggaactgtgctgtgctgagctgaaatgaatcaagtgacctgcccaaggtcttcttgcacagatacttaagtgatggaatggggattttacttgggggcccttccttacaatgaaaagacctgatggttttggtcttcccgtctgggatgttctttccattaatagccacactgtctaaatggttaataacatggactttgaagcccaacattctaggctcaaactcaggctctggacgtgggcaagttgtttaacctctttgtgcctccgttttgctatcgggaaataggtatgacaatcaccctaccctcacagggaggctctcatgagttaatgtctgtgtggcactcagagcactgcttaactccaagtgaacactgaacatggttagctgtttttcagtaagatcaccccaactattttatctaaaatgtcacctcttcactctctatcttcttgccctgctttggttgacatcacagcccttataatcatctgaggttatttaatgtctttatttttttttttgctgaatgtttttcttttccactagaatataatcttatgaaagtgaggactgcattcactgttacatctccatattctaggaacatattcaaaaccacctgtgaatgagcaaatatgtgcacatagaaaactttattaatttaattaaataattaaatgtaattatttaattaaataattacatttaattattttaataaatttagtataatttaattatttataattattaacaaagttatcagaagaactagcctaagagtactttcagtttcatgctctgttcatttgattcctctagtaacttggctaatagatacaaataagccaggaaaatagcatcaacatatggtaaggtcaagctcatatttcatatttaatatacctaccaagcaagttttaggtgtgctgcacatctttttcatatttttaaaagtctataatttaagtaatagtgtccggatgaaataaagcaagaaggaagaggtttaaagaacttcagggacctgagagccatgttctgacctgcctaatgaaaagctcatgaattgatagtgaggtcctttcccccgatacagagtcagcgttcaaagtctatttctaagctcaatttattgttaaatctcattaaaataaagtgataattttatgggtttgaaatgtgttataactgacttttctgattgagactgctagcccaagtgcttacaacttgcttaaatgttgtaaatgtgttaaaagggggaatgttgatgtgtatttcctctgtgttcaaactgttcagattttatgggaaataataaagctttacaacttgttctttacaaatagaatgctagggactttgcagcaacatgagaaatctatttattattttgtgtcagagcaagctgggcatcttcctctttgtagactgccagagttcattgttatttgggacagagaaggaaatagcatgatagtcagggagataatattaattttacagaaatagaatcttattttattacaaggaaggccgtcagtctcacaacttgcactctatttgtgaagaaatattcttaagcatatattccagtaatatgtagtttaatacctatgtgaaaactaatttcttttcctcaagcatcaacttttatcacagaactttaaatctagaagtttaaagtttaaactttttaaatctagaagtttaaagtttaaactttttaaatctagaagtttaaagtttaaactttttaaatctagaagtttaaagtttaaactttttaaatccagaagtttaaagtttaaactttttaaatctagaagtttaaagtttaaactttttaaatctagaagtttaaagtttaaactttttaaatctagaagtttaaagtttaaagtttaaatctagaagtttaaagtttaaatctagaagtttaaagtttaaagtttaaatctagaagtttaaagtttaaatctagaaatttaaagtttaaatctagaagtttaaagtttaaattttaaatctagaagtttaaagtttaacttctccttatattaaaggagcagtatgaatattctttgagagatgaactttaaccatattttgtgtgtgtgtctctgtgtgtaatatatacctatagaccatagtctggggaaaactcatttttcacttcttcttttcatgcaagatcttaggtgctgtattttgcaacgtgccgtgtagcattacatttcatgatattataagctgagttttatagaactgtttcaaaaattttcattatggaccttttatatcataattgagtatctagcaaaaggtaaaaaaaagttccacttatgaagctgaatatcaatcactcaactattcagttatgcttaggcatagatgagtaagcttgttctttgacagttaagacatatggtggtgtgtgtgtgtgtgtgtgtgtgtgtgtgtgtgtgtaatagatgtgccagataactaaaatctttgcttagtactttgagggaaaaagagattcgtgatgagtgcatttattttattccattctatccacattttgtataaaatccatttaaacaggggaactaaattgcttacagtagtaaaatgcatttccctctgtgaatgttggtgcctttatgatgcatgctgatttggactctgacacagtcataatctacataccaaacataggcattttgctttcaaaacagaaactggcactgctagagctgtaggagtgagctggctcaccagagtaatctctccttcttggagagatttggcttattgttgatggcctgaagtccactgtcttggacctcagagtgggctttccagtttgtagtaatgggttctgtagcatgccaagactatagagacccccgaattcatctcttttatttcccttctatgagggaattcctgtggtcataaggcctgcagcttaacagatgagcagaaaatgtgctgaaacattggtgcttaaaaatatacaaaatataagtgggaatcagtgtctttagctttatctttgcaatgggcaaaacagaaatgactcaaaagtgatttctttagttatggagcactcaggtttctcttctgccttttgtatttccatatgtcactgctatctatattctgtagatactctacctgtgacattctgggattataaatatgtgagttgcatgcttattcactttctcccaccttttcattctatcctgagtagtctaaactgaaagcttttgaaagccttgcatgttttccacatcaacccttgaacatttatacttctaaaaaaggatgctggactctcttgataactctgtccttcaagtttgcctcatcggtgatgccacttgactgaaagtcctcttggtaatccagtaattaaatccttctagctgaggcccaagagagatccctctgctgaattgcactgcacagtaaatgacattataatgaggttttaacttattagttaaatgaatgaatggaaactttgctgctgcaattcattagatttttacgttataaaccaggacttgctgctgcagatgagagtccgtgcaattttcccttcgtataattaattatcatatcagtgtattaaagatagtttcactaaaaggagaaatacccttgtatagaaagtctaagacagtctaacaaaacatggtgatcacttctgtatgtccctgagcttggtgtgataggcactgttcagatacttctgcaatattatcaaattttaatcctcaaaacaaccctctgtgatagttactgttattattcctattatatatgaggaaaatcaggcacagagaggttaaacaactttcctaagatctcatagctagtaagggtagagcaaggattcaaactcaggcagtctctctctatagctctgcacttataaataagatttcctctcatccctagacatgaacatgaagatttgcttatatataaattcatcttattgatatgtttcttttgaatttcttcccctttttctaatgaaaactgatgatgctatttagaaagctttatttttttttacctaaaatgtttaatctcagaaaagtactgagaaaaataacagtactcatgcattacccaccaagaattttaaacatattaacattttgcctctttatttctactttttgtttttaaaataaaataaccagttatttctgacaaattcttcttttcagtctcattctttccttcccctctttccattccttgtccagagcaacccactcttaagagcagaatgtaaatccttccagactgtgttcttatatttctaccagaagcacggaaatagccataatccatatacatggtattgtgtttttaactgtacacaaatggcctcatggtgtatgggctgtactgtttcttggctttttcactaaacattacatatgtgtgtgtgtgtatatatatatacacatatatgtgtatatatatgtatatatatgtgtgtatatatatgtgtatatatatatacatatatatatgtatatatatatacacatatatatgtgtatatatatatacacatatatgtgtatatatatgtatatatatgtgtgtatatatatgtgtatatatatatatttttttttgagacggagtttttctcttgtcattcagggtggagtgcaatgtcatcatctcggctcactgcaacctctgcctcctgggttcaagcaattctcctgcctcagcctccctagtagctaggattataggtgcctgccaccacaccctgctaatttttgtatttttagtagagacgggatttcaccatgttggccaagctggtcttgagctcctgaccttacgtgatctgcccgccttggtctcccaaagtgctgagattacaggtgtgagccaccacagccaacctaaacattatatttttaaaacctctccatagtgatctatctagctataattcattctcagctgctatatttctttcttgcagatacaccatattttatttgtttattttcctctaaatgggtgattagttgtttccaatattttcctgttataaacaatactgagatgaacattttttgggtacataatgtctcacatactttgcctcctggatcgggattgctggttgggagggactgtgtggtaaaatctagcaatgaacatagaagagcaacagctgggaaggaggggtatgtcaggattacatttgagaattagagaacaaagtcacgcaggaatatttactataattatgagataataataaattacactgctaacagatagcccaagtccatacttcatgaagtctctataaacaaatgttaggtatatgtgaggtttaataaagagaactctaggctgagagccaagagacttggattttctctccagctgtgctctaacctagctttgtgccatagcataatacattaatagagttgggcacagaggctcacacctgtaatcctagcgactagggaggcttgaggccaggagttcaagaccagcctgggcaacaaagtgagatcatgccactgctctccagccttgattacagagcgagaccctgacttattttatttattttgttttaatttaattacttttttttttcagacgaagtctggctctgtcgcccaggctggagtgcaatggcatgatctcggctcactgcaacctctgcttcccaggttcaagagattctcctgcctcagcctcccaagtagctgggactactggcgcacactaccacacctggctaattttttgtatttttagtagagacggggttttaccatattccccaaactggtctcggactcctgacctcaagtgatctgcccgcctcagcctcccaaagtgctgagattacaggtgtgagccaccgcatctggcctgagaccctgacttcttttaaaaaagcaaaacaatacattaatggtctctgaatctcttttctcttatctgaaaatgaagaatttttggtagtattttcttatgatttcttccagcattaatctacccaagttaaggctggaataagtttcctttatgatattaatacctctcctcagcattgaactaaatgatccacaggcccaaatcttcatcgtcccccaaactgctgccctgttgtccctgaatatagcgtccatttgtaattccaggcagtgggctgtaatgggcccttgatttattgcgcccttttcctaccgtgtaaatagcccagctcactgcttcttgggtgggataattatgaaccttgtggccctcagatttctcagtgggatcgggctccagttacccacagtggtaactggcttgataacagcattgtttattgtttctttcctactcctgtctcacttctctacttctggccattgtattctgaggtcacctgagattcttgtctcaagatcttcttgctggggaaactcaaaggaagatatccacctattcaaatcctgcctgttttcctccctctagcttcattctatagccttggaaggttcgtcctggcctgttcaagcctgttttcctctctctagcttgattccacagccttcgaagtttcttcctggcctgttcaaacacaagctcatggagctgcaccagactcttaccacatttgtcattggaaccaagtaatgcaacatcacatatgattatatgcgtgttctttttttaaattttatttctcacagccttggaagctgggaaatgcaaaatcaaggcctggcaggggctggcttttgagacagctaggtgttagctgttacttcctatggaggaaggggcaaggaacctctcttgtgtctctcttttttttttcaatacatttaatagtatatatagttaaggcctataatatgagacacattcagatagtaaaatgattactatagtgaagcaaattaacagattcatcatcttacagtttcccattttgtgtatgtgtgacaagagcaattatatctacttacatagcaaaaaaaaatcccacatgccacaccactttcttaactatcctcctcatgttgtacattagatctctaggcgtgtttattctacccgtctgttactttgtatcctttgagctacatctctccgttcgtctcacctacattcatgttcgtactttttatgtcccttcccctcccaagcataatataaaccgccaagagccaggaactctttttttaatttcatttttattaaaaaaaaataatgcccctctatgcctagcatggaactaatgcagaatgtacccatgtagtgtattgtcactgaatgaataatttagtctgagtaagtctatatccccaggactgattttgtggatgccagccatctcttcttggatttctttgccttttaattaacttcccattagacttgtggttcttagtgacctcctgagggcctgaaaatcagaaggttgcagactgggccatctattttatgggagtaatataaagacatactctctttggtcacgttttcagaaccttttgactaaatgggcagaagtaattgggaataaaaatgtgttgggaagtagaagttataatttcttatttttttctaataaggactttaattctaaattcattcatagctttgttttaaagttattgtcagtattttatgaagttaaagacaaattcaaacattaatgattctagatgttttgcttcaagtatctttgccactgtttcctcctgtgagatggagtctagattttctttccttctcttcctctctctctttttcttctcttcctctctctctttttcttctcttgtacagaataagcctgattttttttaattttgtgatattttaaaaattctcttttattttgattgatattgcatatgcttaaaaattggtagaagaggctgggtgcagtagcacatgcctgtaatcccagcgctttgagaggccaaggcgggtggatcatgaggtcaagagatcgataccatcctggccaacatgatgaaaccccgtctctactaaaaatacaaaaattagctgggtgtggtggcacacacctgtagtcccagctactgtggaggctgaggcaggagaatcacctgaacgcaggaggtggaggttgcagtgagcagagatgatgccactgcactccagcctggtgacagagcaagattctatattaaaaaaaaaaaaaaaattggtagaagaattcaagtgagtgaaactgagagtttatggttttctccagcaaatcagtgagtgttttccctgaacatggatgctttggctctggtcttcacactctgtgagatgaggaccagcccttgtggcctctgacttccaagacttcagtacctgagggtattattacatattttatgagtttaaaaattgaggaaacttttttcccctccaacagtgaaacattctatttatcatttgttgaacctgtctagtgagtactgattttgtagaatacttccccaaaagctgattttccagattcagttcttttcaaactgcaaccagcccggctgggcagacagccctctccttttgctccgctttattcttcctgaattgactttatcactgtccctccagccatttccaggattcatcacagattatctctgcttgttggcagaaagcaagcaccgccgagactgaagggcacaattgccgaaaggttcttctttcagttcagtcctcattctaatttttaacttatttggtgctgctgtggaaaagctgtttgcctgaaatatggtaaataaataaataatatcctacatatggagtccataaaataggatgcagaaagctaggagctcaaatttagatccaaggcagtaattctccttgcttctttttccgcttcccttcttagcctcccttttctccttaaatgatcaggctgaatggggttgtcaggattgaaagaacaggatcccagattttataaaattgtttactcctctctgtttgaaatgtgtaactttgcagaattgagtgtaattccagtcatctcctaaaaggctgggatgatggccagggcgaatgggcttcctgaccttttctgtgtggagaggcttcacggaggagcactgagggcagaagacacagagccagtcttccatggaggcgacccatagcagcgggatccagcaatgtgtgaagtcatgctggttttacatatgaaccaatttgaatagaatccttcattttttttacataaatattacatcttaaccttttcatagaagagcctcggttttctttccaaaggtataaaggcgaggtctgtgtttccataagcagagaacatttatcctctgtcctgcctccctctagaacaaaatccattgctgtcttaatttccagttttgattgtagctctcagtgtgagacctcccagtgctgtagagtgtgtttcctctatgaggctcactcaccacaggcataaagatcggggtgaatttcccagccgcctacatccgggaatctctcattcggactcagcaagatcatttttatttttgaccagaaccttataaataaatcacaaatatataaatgtgatagggaaggcgcccatcacaactatttgttcaaacaaatcctgggcccaaagaaggagtgaaaaattaacttcctatcactttattttagtagttcatactgacagcaaatatttaattatccattattttgaattccacattaaaataatactcataaggtttggattaatagaaaatactcatatttataatagttagagctttccagatacatagaggcaatatagtctagtgcttggtaattccctagagttggaaaccttggtttaaacctggcctttacatcaaacaagctatgtgtgcataggaaactctgagctctttgtttcagttctctcatctgtaaaagagacacaacaatagtgactaactcacaggattgttctaaggataatatgagatgatgtgtaacacatacaatacctaaaacttggtaagcactgttaacattaactagtaatagcatttcagtctcttttctgttcattacgacatttaatcttcctgataacctcttattataatatacactgtggtagactaactttgctttaaagggccagatagtaaatatgttcagctttgccagctgtatggtttcacttataaacactcaactctgccagtatagttcgaaagaagccaaaggcaatgtaaatgtaagggtgtgtctgtgttccaataaaactttgtttacaaaactaggtgtcaaatgagatttgacctggggactgtagtttgctgattcttgacaactctctacttgctgttacaaataagaacatgaaagcagcttggttaggagattgactgtgagaacattgctacttagtggtatatttcaaagtaatatccatttttttaaaacttatttcagggcttttctgcacaactttttgtttgtttgttgcttttattttgagactgagtctagctctgtcacccaggctggagtgcagtggcacgatctctgctcaatgcaacctccccctcccacgttcaagcgattctcctgcctcagcctcccgagtagctgggattacaggtgcccgccaccatgcccagctaatttttttgtatttttagtagagacggtgtttcactttgttggccaggctggtctcgaactcctgacctcgtgatccacccacctcggcctcccaaagtgctggaattacaggtgtgagccaccgtgcctgacctgaacacctgtttttgatggcaatttcttatctagtgatcatctgcaatgtctgagatatagacttatgtacatcattggttagagtgtgggttgatgtgagcagtcttctttgactttgttttatagccaagagttcagctttaaatactgagcaaacttcctgccagcatggattttggttagaaaaagaaatgggcaaaagtagatgcctgtttcaatcctgactgaggaacaaatgtagcacctcaaagcatttctttatacttatacatttctttaggttttttatataacactaaaatacttacttttttttttcagtcaaaaatatattcctgagttctaaatctttaatttgggggacatggatcaaaattttgaaattttggttgtaaaagacacctagaggggcacgaagtctgtggcttgtgcaaaatcttttacacatgcttcaaggatgcacacacatatacaaacacacactctcacacactcacataaggtaaggagggtgtttgggtgtataaaagcaaacagtagaagctgcctcaaaccactgtatccagtatatatcctgatccaacatatatgtatttagattcaaatttaataggtctggcgtcaaatttctgaacccatcacaaagtagaagcaataaatacaaaaaaggcatattgttcataaagcgtgactggctgtagcaagagatgacagctgacctttggatactaaactagccataaaactgaaaaatcatgccatgataccttgttgaatcacttcttaagtaaaggttaacttacatacattacattctgattgtttaaacagaaacaagtgtagtatcttttaggattaggtcattttaaatttattctgacaattagaagttttgattcttcaatttgttaaattgagttttctggaaaatgtacctctttctgaagttgaagttggataaatgtagcaattccacatgttcatcaatgtgttacagcctaaaattcatcttttaaatgagaatattaatttcatgtttataaacatattttctaattgatcaactgtatttatttttatttatatatttctccatgcaaaatagaaatagctctttactcagatgagtgatactgaatctaatataaaagcaaatttgtatagaagaaatccagggacagcagcggtcagaagataattcacaacttgatgaggtaaactaccttgaatacccctgagaatgagagagtaagcaaggagacctcgagtggccaaagcagagatttcagttatatttactggacaaaatggacaccataatcaacagggaaacacaggatgtactttgggtgagtggtaaagttctgcccatatgaaggcatactcccatttatttgctcagtcttggcctggtgacaggcaacaaatattgaataagaccctttaaatgaattttcaaaaaatgaagtttagtgatttaaatagcatttaaaaaaatcaaattcatagtaagggtgcagtaaatatttggtttacagtttcatcttgcatactgtggaaagacgatgagcatggaacttgttatcaccacgtagaattcctaaaataattgtttcaataaatacggaatagtagctcaggtttcagatttttacatgttattgactgagcctccctttggggaaaatttaaaagttaaaagatctcttttaagatgattcagaaatgcaaggtttatttaacatcttcctcattgccatattgtgttctgttgttttcctcatatcatgtaacttattatcattttttattacttagtttcatttttacttcctttacctactcactcattaattcttactgccagtattttaaaacctttctgcaaaaaaacacatgcaactgcactgggtcagtgtttctcctgattgataatccactttccacctccacatctaagtatacaatcattgataaaaatgaagcccccatggactcttctcctgagagatctcattcttcctgcttatcagcttctgccctctgtctgagggattccatattggcatctccgaaatggagatattttcctatcaggtgtattggagttaaaattgagagagaacatgcaatcatttttatcttttcctgaatcatatgcaagtttagcaccaggtcgaaaattcaagcttagacttgtttgtgctctaaagattgagaaagttgctcagattgctctggagtgggtcatgagttttcttcctggatttttgttcaacacagatagccatctttgatttattggaacctcttgctagagcatagttataactcccagagaatccttttgaagtcaatttcagctttttcatattcaaggaaaagaggaataaatcatgtatccatttttgatctgtagtttttcaggaatcattctcaatgttgttgaagaagttagaaaagcccaagctaatcactgtatcatataggttttccgaaggcaaggtgtagaaatttttagtgttgtttaagcaacccatttattttgaagtattgaaatgttattaatcctaaagaccaggtgatagtttatatattcttgaaggctttaaaaatataattagcctctctgttacaaattgagtccacattcatcttggggctaatttatttcctttacaaaactaacgagtgtttgtctacaggatcagtgaactaaatctaaatgggggccaaaccttcaacttcaccctctggcaactctttttcccattttcagaactcttccaaatcccccgccccagccccagtatttccaattgacttatagaaacagttgcattgttcttttgcccaaatcccaagcattccccagagagctgttttcactttctttagagcacttacagtttatctctgtaagagaatagttttgagtttggcacttagtctgtttctttttcattctaataggaatcgccttagagctagctaagtccctgttagtcagcttcttaagtgctgaccagacttcttccatctgtatagaacactcactttttcacatcagaggtttaatgaaactagaaaagaaaactctttaaaataacaataataatgaaaatctctaatagattcaggcaactttacatatatcttttcaagattgggtcaattttgcaaaaattttgagggttttattttttaatatggcctcaggttagagtcacacaaatcagttaaaaaatatatttctttgagttggaaatacacacttatttcatccctgtacttctatataggggagttatttttaatgagaaaaatttatagctgactgccaatgacacataaaaattagtatgcattattaaaaataaattaaggcagaaagcagccaaagtggactttgttctagagtcttggtaaacagccaacagcagtgctcacttgtcttcatgtgacattaaatagtgcccgtctaaaaagtgattaatagataccgcgggttggaacaggctggcattcgtctgtttcttacagctcctgatacacgttgaatgccctgcatacctatagttcttaagggaatagtcactgttgagacatttagagaagctgatatcagatgagggcaatcttgttttggctattttaccacatctcaagtatacaaagtctacatataaacattacgtaatgccttcagacattgcactgattcaaatagattttaatgagaaaggccaacttttcctgtttcttggtcattcagagacttttagggagcttgaattgtcagtatctcctaatctctcaactatttttttcttttgatttttaatctcactcagttagactgttgggaagagaatacaataggaggattaatggctcagagcagaaatgtttgcttgttggacaataggaagggaatttggtagaagttcttacccttcctgtttacattcagtaatgttgctggtatattgaaaagactgtcaatagtgggtatatatttttttcaacagtaatttccaacatcttgttgttaggtgttcatcaaaataagaaagacggagaaagaagaaaacagagacaaaaagaaaaaagataatggatttgagaagtcaagtcaattcagtcacaatatgggagtaaaggacagattaaaagaagtttcttgtgtgagtgtgtgtgtgtgaatgagtgtgaaaatgcgtgcatgggtacatgtgccttagagtagaggtaattggaagacttgaggagaaattactcacttttcttttaataccaatgaccagacagcttgccaggtgctcactcagatttgtatcatatctttacatactgtcttctggataggtacaactatccccatttttcagatgaggacacagaatcttagagaaatgaagaactagatcaagatctgtttgaacgtaagtggttgagtcaggatttgaatacaggctttttgtttttatcactccagagtctcttttttcttccttggtaaatccagacttatcactggagattctggttcaaaattactctggcagttttaccacctaatatatgttactccaagaattttccaagtctgattaaatagattaggtggagtcctccgaaaccctttcctgatttcctgggccaaggtaaagcatatctcagagcaaattttaaacagtactttgtcattgaagacctaactatatatgaagcattgtgtaggtgctgagaaaggcacagaaaaatatacaatagggcacttgccaccagtgccttattaattagataaagagataaaacatacacctgtgaaaagctaaaaaaattactattatcaattgacaatttggcatagcaaaacaaggcatgattaattgccagataacacaaaatgcatgtggtagaatttgagagatctgtaattggacttcagtggcctgataattcttaatggaagcggtttaagctggagggaaaggatgggcaggatttagacagggagaacagaggtgggagatgaattcaggccttaacaaaagtgtaaagaagagcaggacagcaggaggctgggttgaaggacataaacaacaggaaggtaagtaaactactttggacaaagtggggctctgcatagataggaagtggaaaagcaacctcaaaaataggttgggctcaggttttcaatcctgagtgccagcatagactgagcctgttgccatgggtacgtggaaaatgacagagtcagtattgcactttgagaagattattcaggaggcagggtgcaggatagaggacgagtgtctacaaataaagagtgaggcaacacatatgtccatcctgcattgggccacaccaagaacctaccatgtgcacctctcaccacccactggcgctcagactgctgcacacagtagcccccaactcatctacccagatccacttttgtccccatccactctgttctccacagtttcagccagagtgatctttacaaaacataaattattgtcacctcctgcaaaagatttcaacgtgacccataaatatattcttattttttcctccatgtcctatccctcaacatgacctacaagacctggcctctgccttctcttcggtctcatccttcaccctgctcactcttgttttctaggcatggtggtctttttaaaaactgtgtctcattctttgtgttcaacatgccccctctcatgatagggactttgctgtttcctcttcctggcattctcttctttcccctcattgtcttgtcaactcctacttatccttcacatcaacacactctaatttcaagacctccttgactaggtcagatccccttatagaagggtctcacagctccaagtaactatctctcctttgcagcttttattacatgtgcggtttcaccacttatctaatagttaattcatgtttcttttccgcagtgtccacagtgtttttgttctttatttaattcaagaatctagctcttagtggactctcaataaatataatatagtggaaacaaaataatatgtggttaaaatgtaaggtgttgtattagtccattctcatgctgctaataaagacatacctgagactgggtaatttataaaggaaagaggtttcattgtctcacagttcagcatggctggggaggcctcaggaaacttacaatcatggcagaagggaaagcaaacacattatgcttctcatggtggcggcaagaagaatgagagctgagcgaagggggaagcctcttataaaaccatcagatctcatgaggacttactatcacaataatagcatgcagaaaactgtctccatgattcaattacctcccactgggtccctctcaccataggtggggattatgggaactacagttcaagatgagatttgggtggggacacagccaaaccatatcagatgttataaaaatttctatatttgaaggcctcagctattggcaacattacttaattttaaatacatttggcactgattttaaaaaagtgttacatagtattggaattattttcagagggctgaagaatccttcataccttggagagtgagtgagcactctttagcaggcctcttgtgcttccaacctaaatgcaggcaaacgtcctgttggtatgtaaagctgccacccaaatgcagagaacctctagagtgcatgctgttctcattcaaactgtcccatctgttcagacatggtcaagctctctgagccctgggagaacgaaaacaggccaggattaccagtttttacagattttaacgtgaggcttagggtctgtgggctaaaaggttgattgtagtttttaagttaaacatcaacaggggctgaaaagaccctaaaattacatttgggagtcatacaaagacaatacagctccaactgcattactcgggacctttttgctgctgaaacagaaaaaatgataattaaccaatcaggatgaaatgtcaatttgagaggaaggtaatgtgaaattttcctaaatcatctaaacaccaaaaaatctgttacatctgatttccaacctgctctgttgctatgaaaacttactctccactcagctctctgaacgctacatattcatgcaattataattctttctgaaagatggactctgtaatgatatgaaggcgttttccttcagtctgcctagagtttttccagagccacttaataagagccatgctcttttggaattattttgctttatccacatttttcttcatgatccaaataaaagatagttttttaaatgtgaggtggcagttgtcttgggatatatctctatggcatttgctaaattaaagctcatcttttcaagcccagtctttattttgttttcctatagtttgctggcaaaatcaaagcccttgcttccttactcttgcactgtggagcagactggtaggatgatcacaggggagtgagcaggcttcagtggttcttaaaaagacaatttccatttccttggcagagggaccccatactgcgctccagccaattcttaattctttctgccattggttccgaggggcaggcttttgtggggagggattatttgtttctttaaaatccaccgtggttcttttccctcccaccttttcccctttcttttgtggcctggaacaatacaatgttagcgattcagtttctgacttgcagagaatccatctatgcttggaaaaatgcagttcaattatatactgcagcttgaggtgagatagaagtgaagatggcttaacacgtgaagtgggtaaaaaaaatgtgtaattgaaacagtatgatgttgatgaggcagtgtgtgaggctgtcaggaggcattataataagctgatgaacgagactagcttcctagttctgctgtatgcaaatgttccattatttttggtggaggaaaggaacctggcatattaattggctttgtttttagagatgcaggtgaagccttttcattttgctttctgaaaagaaacttgcaatatgtccttaaattatgtttaattttgagtgtcgacttacaaagaaataaaaactcttcatttttaaaaaatttaaaacaaaaaaaaatttgggggtattgaaccttagaaccaatcactaaaaattctgattttgtgtcgactaaaaattctgattttgtgtcaactaaactgcatatgagatcttcgagtttttaacactgaaacataatagttaattttttaaagtactataaaacagaatatagaaaataaattacactatactatattttctatatttggaagtttacagttgtttgcataattgacaagttcgtttcctggtgcagtcatcagcaggttatacaggatgtatctatctgtctctttcttcagaggacactgtgtgtgtgttgagaatgaaaccgaatgtgggtggtaagaggaaatattaatgaacttttaaatatctctttccttgaaaagactgaaatatgaggtcttaagtaaaataaatcatttaaagtataaaatgcttaaagatccttactttttattaccaagttattagcagactgccatactgaataccttttatgtagttttttttttttttggctaacatttccaaacaactttaaaatatagttattcattaaccgacttgtgactaatctttttcagagagagaggattaactttattcctctccagttttaacgtgaccaataaggtgatatgcaagtgaggatttggggaggtggggaagaattggagagaggtaatagaactgatccttgagtcagtgggatgttggaagtggttttccattactttccttggttctcagaaaaccagggagatagggaggatgttatcaggccctttgaccttctggaagtgactgtggacttagcaaaagctagttggagctaggggaggaaggaggcagatagataaagtaggaagaaataattgttctccctaagcacagaatccaaggtggtgctattaaaacaaacaaaccaaaaatacacacacacacacaaatgcacacacacacgtctgtgaatgtatacagagatggtgcggtggctcgcgcctgtaatcccagcactttgtgagcccaaggtgggcagatcatgaggtcaggagttcgagatcagcctgaccaacatggtgaaaccccgtctctacaaaaaatacaaaaatttgccaggcgtggtggcacgtgcctgtaatcccagctactcaggaggctgaggcaggagaattgcttgaatccaggaggcggaggttgtggtgagctgagatcacaccactgcactccagcctgggcgacagagagagactctgtctcaaaaaaaaaaaaaaaaaaaaaaaaaagaagagatatatatgtgtatatatattaatatgttgacaccacagagtacagtattagaggaaacagtgtgggtgcatgtgattcaaacatcagttgtgaggccgaaagagaagctagtcaacaggtgggggtcttttaactccttctctccctccactgatacagaacccccaacactcatatacagtgtgtttccagaaatccaacctggctatccctttgaggctgataaaggagccaagtatccaacctgagatcctgtggttcatggagtctgagttcctattgaacacagatcatggttgcctggatgggaaacctggtttaaacatttaaatgatcagaatcagagcagcctgaaacagtcatccttgatgctcaagttcctgagaaataattactagaaacaaaatttcattgtttggaaacttttccagaaaatgataaaataatactcgtgagaacatagatcacagaaaaagaaagttcagttctaatgtagtatgtttcttttacctagatttattcattgttcctgtgtttattttctttaacaaatataaacaaagaagaaaaggcagcctcctgtatagaatgcttacacattttataagttaaaaatacatatagtcagccgggtgtggtggctcacgtctgtaatcctaacactttgggaggctgaggcgggcagatcacgagatcaagagatcaagaccatcctggccaacatggtgaaaccccatctctactaaaaatacaaagattagatgggcatggtggtgtgcacctgtagtcccagctacttgggagtctgaggcaggagaatcacttgaactcgggaggcagaggttgcagtgagcgagatcgcgccactgcactccagcctggcgacagagtgagactccatcttaaaaaaaaaaaaatacaaatagtcattttatagtttagtctaagcatttattacacatttcaaaagacaaataaactctctcctacttttgtccacctgtaagactcatttcagtacctattttattttctcctagtttttcccatggtcttagtttaagaattcccaaattctcacttattgaattcactcacagaattctacttcccactacagttctatcaggaataggcaagatagaaagaaaaaaaaaaaaaagaaagaaagaaagaaaaagaaaataaagaaagaaaaagggatgggaattttgcaaacatgggggcctgattactaaaagccttatgagatgctcatactcattctttaaagaatattggaaataaatcagtcatgcatttaattaaaccatcctaaaatgtgcccctcttaaaaaaaaatgagtgccataatacttcccaaattcccggaaatgttgtatgtctaagaaagcaagatctgaactgtaggtgtatttcagttggaaattgtagtttacattacttctaattcgaggcctatgtttggtcattaaaagctcccagctaaaaacagtgaccctgctctccatgtgtgcgcaatcttcagccaagtcccaccagagcattggcccttcagtggagggagaaaggatgatagaaaaagaaattctgtggatgtgagaggttagggatagaagggtatttgggcagctctggctatctcatatctggaatttcaccttttatcttcctggaggatgactccttatatggtctgctttgtagaccactttcttgaaaagcaattgcatataatataaaacagaggatgctgtgctaaaaagaaaaacaaccctccttttattgatacttttttctcaaatatagtgatcactacacgatagtaataatggtttgatatttgtaaatcttaggtcttaggaaaaaccacatatggtctgttaacctaaatgatctttagaataaagtacagcgttctaatcaattcaattcatatttcacatgtagttattctttgactaaacaagtactttttgttaaaggaagcaggtaaactaaaatttatgtatttcctcttctgaagtccctgacgtagttggtttggaaaaggtctccaaccaaccagggtgctgaacattcatcctgagtaatgtgctgttttggttgataacagttgtcatagtcatttcctcctttagttagcattttggcctaaaggtagtagatttatggtttttagcctgtttcatttcccagctgccccacaacttttttttttttttttttttttttttttttttttgtgaggcagagtctcgctctgttgccaggttggtgtgctgtggcgccatctcggctcactgcaacctctgactccctggttcaagtgattctcctgcctcagcttcctctgtagctaagattacaggcttgcgccaccacctccagctaatttttgtatttttagtagagacggggtttcaccatgttggccaggatggtctcaatctcatgacctcgtgatctgccctcctcagccccgcaatgtgctgggattacaggcagaagccactgctcccgcccacaaaacttcttttaaccacatttacaaattgctgggtgcttctgcatacacacataatgaattataaatattagataaaaagtatgttgaagtaaattgaacattaaaactcaaggagttggccgggcatggtggctcaagcctgtaatcccagcacttagggaggccgaggcgggtgggttgcttgagctcgggagttagcgaccagcctgggcaacacgatgaaaccccgtctctactaaaatacaaaaagttagctaggcatggcgttgggcgcctgtagtcccagctactcgggaggctgaggcaggagaattgcttgaacccaggaggtggaggttgcagtgagccgagatcgtgccacttcactccagcctgggcaacaaagcaagaccccatctcaaaaaaaaaaaaaaaagaaaagaaaaagaaaagaatctctcaaatgtgaaagtctggatacacaactatgtttgcacaacgctcaatttggcataattataaattgcactccagcctgggtgacagagcgagatactgtctcaaaaacaaatgaaccagaaaacccccacaaaactcaaggagttaatttacatttagaccaatctagatgtgtttaaaataaaagtaaaaatttcagttctgtaagaagtgtctactggggcaagtacaattagtcctggcttacacatgagaaataattgcctattgtctattattttattgcctaggttactgccaaagcttgtgggtgattcctctgaccctttgtactaaaggggctttctgaattgcctttcttcataggtttcttctgtattgaaaaggctttcatggcttttcatgtccttagaatgaagttgaatttcctaagcctgacattcaagactctcctaaatttagatgaaagttaccttcccaacctcatgaatcattatgctaccttaagacaatttcaaccaagataggcttttccttgttacctccatgacttccttcattcagctgctctaaccatgcagtgacctctctaatcctccccttctcttaaggaaccgtgtggtagaaattatatagacttaggcccatgacagactagaattctatgttggaaaagccactgcttccctctggggctcagttcctgactcagtaaagaggtatcagttactggcacagtaatgccccataacaaacaaccacaaaatttcagtggcatagacacttatttatccttcatttgtgggtggctgggctcagttcaagacttcttcataagactctcattttttgatgatcagtgagagataaggattgtttttctcatgggcttggcagaaaatctgaatgtacatgtgcaattcaaggctttgctggcgcagtgtccactttggcctcagaaagtcacatcatcagagtggggaaatatagtccactcctagtgggaggaactacaatgtcattgggaaaaaaggcatagatatggggatgaggtaaagaattgagaacaatgatggagcctccagtagtattattaagaggttaactcagataatctaggttaggtttctgacagggcatgtggcacaaagaccctgaacacgtttttctttccccctgtactttcctcacacccacttgttcaaactctccttcttcctttagtcttgcagctgttattctatcactggcacttcctgtgcttttcacatagtaagcagtaagtaaatggtttttaaacataattctataatcattatttgcttttttattgaaatacatatggaacagcctatatgtagcccttgtatcttctcatcaatcctaagttttaagttcaagtagaatttagttgccaatttagacacctatattggttcccaaatgtaatgaaacaaagctaataaaattctttaaacaaaaaacaaaaacaaaaaggtattgtctctgcttcttagtagcactttctctatagccatctctttgagtgatgtctgactttatcttctgccaaagatagataatgtttatatcagacaaaaaaataattataataacataagatcgtaagaaatgacttgtcagcttatattaatctgactttggtctctgatcatggccaccagatatatttggtggaaccactcccttgtcagaccaccttgcaggttaaatctgtaacccaaacacctccccacttctcttttaattctcagctttttaaactttaagtggcttaaatttgatctttacattccactgtcattccagcacatacacaaaaatatgtattttgtgctatctccttggtgtagtgactgtgtggtaagatggaaagactattattgagcttggaatcaagtccctgctttggcacgcgttagctgggctgcagttttctcatcaggagcatgattcagattgtttattcttatatatcctttttgattattaccttttgcagctctattcactggaaatgaggggactagaaaagagaaaaaagagataaaacattgactaacgtgtctttgtgccattttcagtcactgctttggaatctggcaggagagctaatattcctgtttcatttttattgggcttaaaatatatgtttatcttctcttgatgaagatttggtattttttttatccctcggatttcttctttgaggtgactaaatgtgctgtttcttagaaagcttggctggaacttttcatctagtgtgctagagtctctataaaacatatctaaataattttcaaagactttgctttaaatgcctgttgaattctcctgggtaatattagctgagtttcctcatgtacatttggtggtacatttttataattatttctatttggtgctattcggcttttcacaaaaattatgtatctggtcatatcccttggtctgtgggccattgtgactcagatttcagattgcatacgtatgtgttaaatggagtttcattctcgtaaaagaaaccttactgaacatgaccactcttctagtggtttccatgtgaaatgaattatgttctattgtaatctggagtcttttcattttcctgtgagaaatggtttgaaaattgtattctgttgtttacactgttgggtatctcttaggaggcttatacagaggataagaactaagatagctttgctctccttacttcttggtgtatctacatagcataaaaattaagatttatttcttaaggactatgaatgttttgtaacattcaattttgagacattcaaatatgctgagtgttttttaaacagatactctgtaaaaatgaatgtactaagttctcagactaaggtgtttttttttcccactcatatgtagaggaagtttggtgttgtggttaaaattatgaactctggggtaagactgatttgatttgggtatcaatctctgcctctatttgactgagtaaatttcataactaccttaaagctccgtttcatcacctttaaaatggggataataatagttcccatcacccattttactcaacaagatttatcaaaggcccaatatgtgtgagtttatgttgtaaatggtagggatgccccataagagaaaattcctatttttgacttctactgaaaggaaataagcaacatgagtaaatgtgcatgaaaaagcagtagaaacaactctgataaaataggattgggcactatattaggttcaatagtttatgaaatcctttctgcagaggatatttttaagctggggctttaagaaggaaatgagagaagagcattcaagcaaaggaaacacatatggtaacaattctgtgctaagaatgagtttgctatattcgagtaaaaggcaaaaaggccagtgagacttgagcatgatcatctaaggagaaagtcattcaggtattagacaaagacaggctcaggaactgtagagtcctgtaagccaagaaaggagatggggttttatttgaagtatgttgggagccactggaaggttgtgaggaggaagcaccatggcttgcttagtatttttttacatattacttgggatattgtgtggagaatggaatgtacaaagaaggcatgttatgaggctactgcaatagcccagatgagaaatagtagtggattagatgagggtggtacttctggagatggagacaaatgggtagtttcagagtatgttttgggggtgaagtcaacaggcttgctcatggattggatatggggagtgaaaggatgggaagaatcaagaacaaatcctaggtttttggcttgagcaactgatggatgacaacaccatttcctgagatacgagagggaggagaagcaggttttggaagtgataacaagagttgtttcttggccttgttaacagctacttcagggtattaagtagcacttgaaaatgtgaatctggagttagggggccagtcagggataaaaatataaattttggagtcattggtttataagtattgagaatggatgagatcacctaagcagagaatggagatggaaaaaagaagcttccccagaatgaatagtgtagtgcaccagtgtttagacatcagggagaagagaaatcagcaaaggagacagagaaggcatgcaaactgagctagaaagaaaaatagaatatgaagcccttagcatgctcatatatagtagcttctctataaatgttgatatattatgtgtgtttccccagaacactgagataaggagactgagagatggtccctggaagtgctggtacggaagtagaaagtgaggcaatggaaggagaggaagccagcaaagcttgtgttttcaagcaggttaccagcaaaaaactgaagctccattctgctggtgaccgctgggaaacaatatagaatatgcctcagagtagccgccccagagggtgaggacatagatgtattcatcctccaacccccatttgtcattaactgagggctgctctctggtgagtgaactcctcagcactttggggctgctctatatgggccaagaaaaagcccttaggggttgcagatgctgtttgcacaggaaacagtgtgtgcacccacagtgtgtgctagaacaggtgctgagcagatctgacagtggttcctgttatcatgtcccttacgtgactggctctcatcattatacctttcttcattgaaatattataggaacaaaggaaattccaattgataaaaatgaattattaaaacaagagagaattcaaaattcttcataatggtcataccaaaagatgtgatgaactcattgaagcatattaaccaatggctcagtaattctccttatattcttgtttgaaagtagcaataaattttaaggcatattccttgagtgccaaagacatcattaaatgtgacaccatcaaatatgaagatgaacacatataaccttgatattttgaaatactagaataagaattcataccatacagtaccttgaaatccaatgcctttctcccaaagggatcaaaggttacgcttgatgcttttcagggcaccttgtacacaggagatcacttgatcctaactcctgggatcagaacgaatgaagcgattagtgtcacaggcgaaactgaattgcttttaagcttcttatctgagcaagtgtcgatactgagatcaagacttaggtttgctaaactctgatttggtttcctcatctctctgccataatggaaatagtaaaatgtttcctagtgcttataatatgccagacactgccctaatcactttacaaaattagctaattttatcgtcaaaacaacactatggcttaagtagcattattgtcttgcttttaactactcgggcatcaagttaggaaactggttcagttcacatctcataagtacgaaagtagggattcaaacccaggcacctgcctccagctctgttctcctcagatgactcttacacagctgttacacagcttatgtggcagtaataggctgtgatcttatccctgactatatgaattacttggaaaaaatcacacacatgatgtgtttactactttttccataaatccactttaaaaatcattttaccagaggttaaaaaaaaccctcccatcagcagtcttatttataattgaaaaaatttaggttcctttttattaaatctctttcatatggtttaaaccatatggtgactaattttttatacagtctaaagtgtatacaatttgttcaatgtagttttgcctttttgtgaattcctatgctttatcattaggctgaaaagcatgcaggataccagaaatactcttaccagtaaacttccattgaaaatctggctatggaagaaaagtctgccagccagtactttgtactttggaaaggaagccatagatccagatattctccaagaaatacaggcagtggctcatgcctgtaaacccagcactttgggaggctgaggtggattgatcacttgagcccaggagtccaacaccagcctgggcaacatagtgagaccctgtctctacaaaaaaataatttaaaaattagcctggcatggtggcatgcacctgtggtcacagctacttgggaggctgaggtaggaggatcatttgagcctgggaggttgaagctgcagtgagccatgattactccatgacattccagcctgggcaatggagtgagaccctgtctcaaaacagaaagagagagagagagagagaagaaacaaagtagttactttatcactccccaaatgtaatttatcaactgtctcttcagtctcatttgctgttacctgcctgctataccaagtaactaatcataattttcaaaggaatttcaaatatgttacgtcatttgatctcagtaagatttttgatgccaggtagatctgcaagattactttcataacacaggagaatctgatattccacctttagggaaagggattgctcctggaagctctttccaactcttttcccatatggaagaattttccagtcccatttcactctgagatattattattacttttcctggctactttatattagtgactattttaaatcctactggaggggatttaaaggctcttgtgcaatcctttcatagcccatgaatttcaagaataagagttgcttaacttactggccccagaattctgtttccacttatctctatgttaaactagagccacagagaaaaattatgacccagtaatttcttctcttatttaaaatgtcaagctcctatgtcctgaaagttagtactagattttatatgtctgcattttagttttagttttgttttttatttcagatcggaagaaaatgaagtattctgttaatttaaagttacttatggcacatccctgtaatactaatcacttaaagatgtagcaatttatattttttacagtgttaattcataagtggataggactgtgaacaaatgaattaaaccgaagtccttataatttaaacattcctttttggaaagtactttaaaaataaactgacttaaatacttcctatttgaattattattttctttattcttctcatattggttctaagatatgcaattttatatagcatacgtaatagctaaatgttaaagactgaatacctgtgcttctctttaaagtctgttttgtcttctggctaaagccagattccatttaaaaaccttacagaatatgagacactattttaccattattgtttgtgtcaactgcagccagagatgagctcccgatatctctggaataatttagaagttgatgccaagtcatgattctggtcaatacagtaatttcagttttgtaaagtttatttatttaaaaaaattagttcagtgtttcattcatgatttttgtaataccacaaggaagaatagaaaaatgtaaggataagcatgagaaacaaattagttgataaattattataagcttcttataataatgtcaactcagataactctccatgtaagctgcatatgagcataaataaagttaactgtatgattaatctctactattgtgtttgcatccaagagatattaaaataaacattatggttagatagagtaaattctaaaaagctgcaaaaacatttaggttatatatttaacacatagtaatatgcctgtgtttacatcttccaattagataaatttctgataatttttgtctccttaggattttctaatgaaaatagagagcagtattttaattgtttagtatcacataattgttctagccttcatatacaatttaaaataaatggcacaaaagtgcttggtaaagcactttataaaactatatgaatttcatctgttattctgactttaacaaattatacaaatatcatagatgattataagttaaaatacagatatgctctagtagcagaatttccacataagcatgctaccgtacatactttaaaccaagaacttccatttctaatgataagattgactagactagatatgttgacaatccttttatcacgcatgaaaaacacttaatatattttatgtagtatcctcaataactgtttaagatatatgattagctggcttgaaaataaagaaattgtctaaggtcaaaggactaagtgagagctggaatctgaatacacaagggaacattgatctcctttgacctgggcaattcttaacgtctctgtgggggtaagaaccaaagcccagggcccatgcaaggtgaggagtgtttgcaactacaagctcaccatctaatggattggcggcacacattcatgcgacttatttgctcaaaaactcccaagctaaatatttactttaaggttctcttgggtgatttatagcagaaaatgagagtccttgttaaaggtacacactctcaatacaaatcacaaaataattttatgaataaagttaaaatggtcacaaactcagtatgaaaaaaagcactaaatgtacgaagaagtcaccatgatctaggatccacaaaagcagcaaaggtaggattatagtattagaatcattaggtaagaatgtaactaagtatttgcattacatttattaaaataaaagggaactaaatgttcttaagaggtgagagactataaaaaattattaaaccatttttttaggagaatcaaatagaaaattagcaaataaaataataaattttgaagagcacaacgtggatgaacaattaagacctggcaaactagaagatctaaacaattgcagcctgaagagtcaaagaggtagaaaatatgggagccagatgaagagatgtggagggtgtggtgagcagacctagcacacattcaaatgaaattccagaggaaagcatagagaaagcggaggacactggtttttgacaataaaatgggtaagaattttccagaattaatgaaagacataaatctttagtttcaggaacaccaacaaatcccaagcaggaaaaagaaaaataaatctacatctaaacacattgaggcccaatcatgctactccagagacaagactaaaattgtaaaagcagccactgagaaaggacgactcacccacatgaccaacaaccgttattagactggcaggtctctctcatggcgttagcgaaagatggaaaacattagaataaaagcttcagagtgctgggaaccacagctgtcaaaatagacttataaacccagtgaaactgtctttaaagaaggagagatacctttcaagaaattaagaacaaagaatttgctagcaacagacccttccagaaggaatttctacgttatgcacttcaagaagagaatcctaaaaggatggcacaaatatgaaaataaatagcgagaaaagaaattcatacatatatagtatatagataaatctaatataatattgactgtataaaccaataatagcatccgttcataagattcaaaaacagataaaaaaaatactggacaaaagttacatgtaagctgagaaaagggagatcaggtttaaagtgtttttttaaagatctttctattattccagaggtgaattcagattacatttaaacattgttaaattaggtatgcatgttttacataataaactctaaaataatagaaattagctgtgtattgcccaaacaggtttagcacacacacacacacacacacacacacacatgcacacacacactcacaaacacatacattaattttgcatcaaaaatattgtcttctgtaatttcaggaactattttctgctcataaccttgtaggccctacctgaatccaacaagaaaaatgtaaaaataatgctcaatcctggtaataaaagaaatcatatgtttaacaatataaagatccatcaaaaacaacactttaaagagatgaatgagactgagacctttgctggcctacctgggaggaaacgtgcctgtcctgagttcatgctgcccctataatgcaggattagagaacacatcatatttgtcctcattatagagatcgttctaatgaggaaaaaacttatgtcaccgaatctacttttctaaacagaatccacgatctcttagaagaccaggaagcccttccaacgtaccacatggtgctgacactcaatctctgcctaaatgaactcagagaactataactggtgggacatatatttagaagaaatagttatgaaaaccatagcatggtgctgccattgttatttgctaggtaggagtctgctaatagttatctccttcatgtggcttcaatttctatatgatttggggatattctaaagcactagtatttaaagtgtggtgtggggacctctggaggtcccccgggccctttcgtccaggttcatgaggtcaactctattttcatttaaatactaatgagtgatatgtgccttttttcactctctttctctcttaaatgcatggtgttttccagagggctacataacaggtgataccttaacatattgaatgcagaagcagatacgagaatccagtcgtctttttttaaaaccagacattaaagatatttgcaaagatttaaacaatgccattcttctcactaaattttttggttttgaaaacatggttatttttatatgttaatttatattcatctgtattgttaatctttacatgaattaaatattttttaaattctcgcttaatttctaatatggtaaatatctatagatataacacatagaaacacaactgtaaggtcttaatttttaagaatgtaaaggggcttctgcaaacaaaaagtttgaaaatgacttctctaatacaacagaaagggaatatttatagtccagtaagactttgaaaaggtatagagttcttaggtattttggaggagactgtggctggcgtcattttgtaatgttcctatgtagcaacatctattgggaaaaataaagcatgtgtgtatttgggggcaggtgtttctagtatttcttgggcaaactttgagtgctatgtattatctgtaatctttgtttggactttctttgtggtaaattagaaccccaaatgttttcataacttcaaccttgaactgttgttttaggatagacaccaataaatataaggggtccactgggaaggcagagagcatttttagatttatgaagggggaaaaaaatcaatagtgtccctaaggccgtgtaagtcatgagtaacacaagtattcttatgcaaagttgacaatatcatgaaacataaacctttgctttggaattttaccagaaattaaagtggcattataaaggaaagtcgatgttttagcccgtatctcaggaggaatttgtccttctgattgctttgctctgttacctcactttggctgagctctgtgaagaatttttttttcttttcccctgaaaagttaggtgacctcctcacattcttctgccttctggctcattcactttttctcccccttcaatctttgattaaagcttctaggcccctaggagttcttatttcttatacagcaagccatgcactttgtcctcttgttaaggaatgaattaataagcttaactccctctttgaagaagagtttggaatgctttcttggagaaaattaatattcaattaccaaggttgtcatctcaccaaatagaagaataaaagacatagcatagccacacttgaagataattgaaatcgaatttcagtttgtattataccttaattacccaagctttcaggggaaattcttaattcttatgtctactttcttatgaaagtgagtacatttttcctgatgcatatttataacaagactgtttaacacactgctttaaaagaacttggattgagtggttcttcttgcaatggactttggagttttagacacatcctagttacctatgaaattcatagtgtttatcttttttgacattgcataagtcctccaaaggacaataaaaataatacttctcctaattgcatcctttatattttataatattcctgtgatactttgattggtgatagtgaacaggtacataagaggcagctcagggtacttccttataggtaacccttttcctgcataggtttttaaatcacagaatatacataaacatttatgttggttaattgtatgataaaaatattttatagttaataataatttaaagatcaaacaaaaactttgtgagggcaaggagagtaagaaattgataatgtatcagtacatggagaagaattacagcatagcatagagtgtagaaaaatgaattcatagatggtaaatctacacacagataactctgggaagaattaaaatctgtgcttggcatctgcattttacatttgtttctctgggaacttggaataaacaatgaacctgcagaagcaattataaaagctttgatgcattataaaataggcaggggttttttttccccaaactggggtaaaattataaatgaagccaagtttatccaaggctgatgttgacctgtcaagctaaaatagaaccgacttgagaatccaaggacatagcattttgttggggctctagtacttatttgctgtgcaacattgagctaattgcttaacctcttaatgccttagtttccccatttgtatattgaggataatcgtgtgttctctgactacttcacaggacttttgttagaaaatatcagatactgtatgtaggcactttcaaaaatgatcttatattactgatttcaaagagttattattaagctcccttaccctctgatttctcccattctgacacatcttcttaaaaaccgtcaaagagtctgaaaacatatccctccccaccctttttttcagccaagacctcactcttacaatgtccaagaaatattttatattaaaattaacaataaggggccgggcgtggtggctcacacctgtaatcccagcactttgggaggccgaggcaggcggatcatgaggtcaggagatcaagaccatcctggctaacacagtgaaaccctgtctctactaaaaatacgaaaaaaaattagccacgtgtagtggcgggtgcctgtagtcccagctactcaggaggctgaggcaggaaaatggagtgaacctgggaggtggagcttgcagtgagccgagatcaaaccactgcactccagcctgggtaacagagtgaaactccatatcaaaaaaaacaaaaaaacaaaaaaaacaaaaacaaaaacaaaaaagcaaaaaaaaaaacaaccaataacaggaaggtactaacaactaccagagccttgttatgtcttcatccaaaaaacaactttttttttcttaatagtaactttattaaaactaaagtcttttgactccatagccaaaatgactttgataaagaaggagaaagttggagggttcacatttcccaatgttaaaacatattacaaaaatacagtagtcaaaacagcttggtactggcatgaatataggcatatagaccaatgaaatagaatttatcatccagaaataaatccatgcatctatgggccactgattttcaacaagactatcaagaccattgcatggacaaagaataatatcttcaacaaatagtactgggatgactgaatattcatatgcaaaaggatgacattgagcccttacctcataccatttacaaaaattaactcatgatagattaatgatataaatatgagctaaaactataaaacccttagaaaaaaaataggagtaagtcttcatgacttagagttggtgatggattcttacatatgacaccaacaagtaataaaagaaaaatattaatagataaattagacgttattaaaacaaaaaaagcccttttgtgcctcaaacgacactatgaagaaagtgaaaggacagcccactgaatgagagaaaatatttgcctgtcatatctgatgagtctatctagaatatataaaggacacttacaactaaacaactgaaagagaaacaatgtaagtaaaaattagacaatgaacttgaaaagacatttgtctaaagaaggtatacgaatggccaacaagcacatgaagcacatgaacaggcgtccacactgtcagtcattagggaagtgcaaatgaaaaccaaagtgaaatacctcttcacacccctgataatggcaaataataataaaaaacaagtaacaagtgttggtgagaatgcggagaaattgaatggaccctgcatactttgctggtggaaatataaagtggtgcaaccaggctggcatggtggctcatgtttgtaatcccagcactttaggaggctgaggtgggtggcttgcttgagcccaggagttcgtgaccagcctggacaatgtggcaaaaccgtgtctctattttaaaaatacaaaaattagctggacatgatggtgcatgcctgtagtctcagctacttgggaggctgaggtggaaggatcacctgatcccaggaggtggttttacagtgagccaagattgtgccactgcactccagcttggttgacagagccagactcggactcaaaataaataaataaataacaataaataaataaataaagtggtgtagctactgtggaaaagtttcgtgattcttcaatatgtaaaatgtagaattaccatatgatccagcaattctacgcctagatatagatgccaaagaactgaaaacaggtgttcaaacaaaaacttgtacacaaatgtttatagcagcaatattcataatagccaaaaggtagaaacaagcccatatatccatcatttgatgaatggataaaggaaatgtctcatatacatatgtataatggaatattatttagccataaggagaaatgaagcactaacacatgcaacaatggagatgaacctcagaaacattacactaagtgaaaaaagccagacacagaggccacaaattgtgttactccatttatataaaatattcagaataggaaaatccatagagacataaagcaaattagtgattgccagagggagacaggagtggggagtgattgcttaatgggtatgggatttccttttggagtgatgaaaatgttgtggaactagatagtggtgactgctgtacaacattgtgaaagtatactgaaagtcactggattgtatacttcaaaatggcaaagtttaaatattaaaaaacctaaagtaaacaaagtgtttttcaaatatatcagtcagtaaccaaaccaaacatccttcatgtatttacatgaagtatctccacaacaacagtgatatcattaatatcagtgataatcatagataatgataacgtactcattatgcacaaggtgctattctaagagttttgcatggatttgcccatttaatcatcatgacgactctctgaaataatcttcatatttttattttaatatgagaaaaccaagacacagaaagtttatgacttatataacatcacatacatggttaataagagatttgattctaattggtctgtttccgaagccaaagctcttacccagtacattgtattgtctctgcagcaaaaaatggaaacaaatagatacttcttggacctgatttttttattagaagatgttaagaaaattatacaacagaatctgtatcaccattgtctttttttttagaatttttaaaatatactttaagttctgggacacgtgtgcagaatgtgcaggtttgttacataggtatacacatgccatggtggtttgctgcacccatcaacccgtcacctacattaggtatttctcctaatgctatccttcccctagcccccaccacccaacaggccctggtgtgtgttgttcccctccctgtgtccatgtgttctcattgttcaactcctgcttatgcgtgagaacatgtggtgtttggttttctgtttctctgtttgtttgctgagaataatggtttccagcatcatccatgtccctgcaaaggacgtgaactcatccttttttgtggctgcagagtattccatggtgtatatgtgccacattttcttcatccagtctgtcattgatgggcatttgtgttggttccaagtctttgctattgtgaatagtgctgcagtaaacatacatgtgcatgtgtctttatagtagaatcatttataatcctttgggtatatacccagtaatgggattgctgggtcaaatggtatttctggttctagatccttgaggaatcgccacactgtcttccatgatggttgacgtaatttacactcccaccaacagtgtaaaagccttcctatttctccacatcctctccagcatctattgtttcctgactgtttaatgatcaccattctaactggcttgagatggtgtctcattgtggttttgatttgcatttctctaatgaccagtgatgatgagctttttttcatatgttcattggccacataaatgttttctttgagaagtgtctgttcatatccttcatccgctttttgatggggttgtttttttcttgtaaatttgttttagttccttgtagattctggatattagccctttgtcagatggatagatagttttctatagctaggaaaaaagtttctttggaagaactgaaagctggcctatgccagatgttaacaaaatagcaatacatgctaggagttagttgtttattatgtcctctacacagtcctcattggttttgtgtttacctctgataatagttgctatatacatatttcagaaatttgcaaactgttttgtttttctcaacatattctatcaagtgtttttttttttcatctcttgaactgagatagaaatttgagaatgaaaatggttggtttttggaattttaggagagtattttaaaagtcagtttcctgaaagctgtttaggcaaacatttataaaaggcaaaatataattaacaaagaataatttcaaaaaatattatgcaaggtaaaagatgtctaaagtctgaataaagagtattaaaacactctttccgatcataaagaacaactttggtgatataaaaaagctgtttctatttggtgatcgccttatacttcaagagggtctaatcagtcctttttgaaaccgacaccttcaatgtctcctaccctatctgaaaccaaaaaaggtaaaatgaaaattcatctcacccactagtctccagcctcttcccctccgttatttttcccctcattgaaatgtaagtgagggagggctggaactgattcttctctgtcagtgcttagaacagtacttagcaaacatagatatttgacacattttgaatgagcaaatgcacgcatacatgaataaatgaatttaccaatttctttgagtctgttatttctgcaaattatatatttatgtatatgtatatattaacatataatctatagattatatgttctttacataaaatatctactcaatccatttccaaataattttaaacatcacaaataaaattaaaagagaaataatgacataaaaaaattcacaagtatccttaatatagagtacgctattggaaaacagaagggaaaatactaatactttaatcaaattagaaaataatagaaatagatttctgctaagtataattaataaaaattttaaaagttccacgtcactaatttataaaaatacacaagtggaattaataggagataccattttcttacttaaaatatttgtaaaatctttaaatcataatgttcaattccatagaggaatgatgaagtaaggtatatcaagtgaaatatataccatcatatgctgatggctgttaggactttaaattggtatagcatttggaggaaataatttagcaatgtgaatcaatagtttcaaaaataatcttactcttgctctcataattttacttctagaattctagtatgagaaattatgatacaaatatgcaaccataaacaaaagaatgaaaaatctctttaagtactgatctagaaataactgtatattaagtggagaaagcaaaatatgtatgatgtatattgtatgctaccttttttggcaaaaaaggacaggataattacatatattcatcttcacctatatactgaaaggtaaaatataaaagattatatatattaataacaatgttacctgtggggtagatgaggtggaagtggataaataagaccatggacgggagcaagatttttcactgtctacactttgtttatataaaaacaacttataagacaaacaaaggtattatctactcaaaaattaaatattaaaaactattaatagaaaaaagtgggatttgtagaaatgcatgttttcaggttgaagggaggaaaaatatataaatgcttttgtttgtgggatgttgtcataattatgtttgggttaaaagaaaattagaaatgtacacaaatacttattggaagctagctatatacattacactgtttttttacattgactgaatattggaagcattccaaatactttgatatattcacataataaaagaccattgaagttaaaatgatgttgtaaaataatacataaaatggtattaaatatatggaaatgcattcatggtatgttaaggtagggcatggatagggaagcaaatgagatgatagtatgtaaagtaggaatctatatttttaaagtaaaaattttcaaagcatgcatacaagcttatatgtacatatagagaaagaactggaaggatattcacctattaatgatagtgcttttctcagggtagggggatgatgggtatgtttcctattatctttattctttaaagttcttcaaataaatactttatgaaacaaaaaccaaaattcctccgcttattaaaggcttagaatgggctatttattatattaagcattttgagcatagtctcttaaatttcttaaaatcacacaaggtaggtcttatgaaccattttacagatggaaaatctgaggctcagagagattgagtaacttactcaacactgcacaactagtgtaagatgcaaaactcaaacgctggtctgtctgtctccaatgctatttctctatcaccctactaaataattcaacaaaaaaaccctgcttgcaattggaaaacatttttcctactagttttctttttaagtggcaaatcttttccttggttatcagaacttacatttttgtgaagtgtgctaaaatgctcaagaattccctgacagtaatttaaattaaactatcttgcatatgtgaattatttcatgtttttttacagtagataaaatatgctaatttgtgtaaatggtcttctgggtacagatgcttacactgaaagcaagcttatcttaaaagctgcttatctttcatttgaggcttctttatatgcatagtttatttttctaatgctgtctcaatataggaataattttaaggaggtatttgtggctaaatgaaagattaaaaaaaaaccaggtctcttggctttggtaaatattaatgagctcatagaaaatcttgttactgaagtgggccctcttttgagagttttctgccatcttggccctttgtgggcccttctcctttgttggggattagcatactgggttgtgtgtgctgttgtgagttctgcttcagttcctttgtgtgtgctgacagaaggctcaccttggtctattaccagaatagtctaggcatcttaatattatattggatttctgtgagaaaaaagcaaatcatccagaaataattaatctgacttattcatttaaaagctttaacacaaaatggacagtgttcatttcggtcatttatatattgtcatcattaacaaagtaaagtccaatgtttattaattttcaagtgaggagaagttcagaatttgaattatttttatcgatattcacacatatattgtatgtgcaaaattattacagcacatacacaacttgatttaggcactctgttttcctttagaccaagcatcatgttcacttgcctacagatttctaaaaattatttttagtttcataagcagtaatattttttaattgtgttaagaactcagagaaggtaatgttggcgctattattaccacattggtcatcctctaaaaacagtgttgtgaggttggtgttagatataaattgtgaatgatgattaagtacatttactgatttcattctactatatgcaatcctgaaatatgagaataggtatatttaacttgttaggtaatttaatgaaatatatttgctgatatcattctactatatacaatcctgacattatgtaagaagaaaaaaggcaattccactattgacaggatataggaatgatcaaaattacttaacataaattttgaaaaattaaatttcccatgcatattttaacttctccattagtccaacaggttgtatgatgcttataagggaattatttggcaaagaaatattttctttttaagaatgcagtatatgagtatagtcacaaggggtcataaattcacacccagtttttttaaaatgagcccattggattaaaaaaaatcagaaaaactaaagcagttgtttgaaaactttttttaggcaagaaaaaaatgcattaagcactttcaagagttattactgtcatcatacacttcttcatcttctttcatagaagttcaatataccagacatttttactgtcatgaagagagaaaaatgatagttcaagaatataacaagagtatttggaaacacagatagaagtgtcattagcccactattaagtctgtactgaaaaacgttctttaaattttgtgctcaatcatttgaataaaggatttaagtccttttataaaaactgtttttggaagaaattttataagaatttttatcagagccaattttgagctgaggttgtggctggtaatattcagttgttgataaatggagtgtgaatcctgagagaaaccacttcaatagtttgagaaagaaggagacaatttctgaaaatgatttcctaatctgagaaacagagctttcttctgagaaaagttttaataattttaaaaactacagaaatatggagtcatggtcacatatagccatttttccatagttgtatttgtggtgagttagaaaatagatatataataaaggtctggaaatgcaaacagtcaaatttaggtttgattattattagttttgagagaaagacagagaatagtacttaatataaactatcattatgttacttctaagtatgttcctttcaattcagctgtactagtaaaattttactttttttttttaataagggttaaaatcatggttgaaatctgaagcatagacttgatatattgctttcctatgctaaggttcctagccctggacactaattctaggaaaaatattgaaaagaggaaaagagctctcaaatattaaaactgcaccataaagttcaaaagtaatataaactttattttattttattttatttttttttttgagatggagtctcactctgtcgcccaggctggagtgcagtgacgggatctcggctcactgcaagctccacctcccgggttcacgccattctcctgcctcagcctcccaagtagctgggtctacaggcgcccgccactatgcccggctaattttttgtatttttagtagagacggggtttcaccgttttagccgggatggtctcgatctcctgacctcgtgatccgcccgcctcggcctcccaaattgctgggattacaggtgtgagccaccgcgcccggcctataaactttattttaaaagcttgactggtattaagaaagcctataataaaactcaaatgtatttttttaaaagatagctaatttcttcaatgaaattcaatatgatctgaatttttacttagacacagctttccaataacatattgtggtagtaagaatgctggtccttccaagatgtccacaccctaatctctggaacctgtgaatattaccttacatggctagagggatgttatatagttgtgatgaaagttaaggaccttaagatgaggagattatcctagattatttgggtgcgcccagtctaatcatatgagtccttaaaagcagagaaccttgctgtgatttaatcagacagagatgtgcctgaaaaaaagacacagagatacaacagtgctggctttgaagatgaaggaagacgaccacaagtcaaggattatgggcagactctagtaactagaaaagacaagaaaatggtttcttcccaaatgtcccagttaacacttagtccagtgagacctgtgttggacttatgtcatacagaacaccaaaataataaatttgtgtagtttaagccactaaatttgtgttgatttgttacaagagcaatagaaaattaatacacgcgatagtaggttgaataatgtccttccatatatgtccatatcctaattcccagaacctgtgaatgtttccttaaatggcaaaatggactttgcagatgtgagtaaggactttcagatcgggagattatcttgaattgtctaggtagaactggatgtagtcttaacagtctttataatacagacacaggggtggtccaagtcagaggagagggtgataagctgatgggaccagagactgaactttgaagatggaagtaggggccacaagccaagaaaaataggcagacaccagaagctgaaaaagtcaaggaaatagatgctgttttcagagactccagaaaaaaaatcagcttgaccacacttcaactttagatcattcaaatagagtttggacttctgacttccagagcaataagataataaattcgtgttgttttaagtgattacacttgttgaaatttgttacagcagccagaatacactaatagagacacatttatgatataaagtgaggtatatatatgcaagaggctgcatgggcataggatggatttttgattctttgaatagaaattttgctataagatcatagaagctatgttttcaggtaaaacccagtttactttaaaaaaattttttaattgacgtataaaattgtatgtatttaccatgtacaacatattgtttggaagtatatgtaccttgtggaatgactaaatctagctaattaacatatatattatcttacataattatcatgtttgtggcaagaacactttacatacactgtcttagctttttttcaagtatttacatctatattaagtgaatttaactttaaaaacttacaatgtagtagcttgtgagaaaatggcggtcatagttcacatctgtattttcacacattgagtaggcccctcccacatcagctctgggttttaccagataacttactttggctgatagaacagtgtcaaaaatggctcaagcaaaggcttaagaagtgcttttgcattcgacttgctctttcttgtcgctgataccctttttcactgtctgaagaaacctgagttagccttttagaggatgagataccttgtagagaggtcccagctaaggcccctaacgtgagagttttgctgtcatagaccatcaaaccccagccaaactggtacagactggaagaactactcactcaacccacaaaatcagaagtaagaaacgtttgtttttttcagccactaagttttgggatgatgtgtttctcagcaatagataaccactgtagtgcatttattttctcaggctgtaaggtgcatttcagacatgactgttcctccagcaatcataaggaggtagcattagctatcctatattagatttcttctgaatcatttgttgcctttggtttttcagggaggtgggctagaaattggactagggacttcctgggcatcctgaaactactgaaattgagtaccttgacttgtacttttcagaaccaatttttaaaaatctttatcctccagaatatatccaactaaaaaaattaggttagaaatatttttgtaaagtattttaccctttgaatagattctgaatgaaaaggagaatgtacttcttgctaaatgtctatatttgtataggcctatatgagtatggtagaagagaggttgtctaagcagccacctaacatgttttaatgctgcggaatatcatggctgatgggtgtcctgcagaggcagtgttacagcactgaggacatgcctcagaacatttccctaggcattctaacatgttcagagatggatatcatagtggttaaggctatggctgtggatatagactttcagccatccaattctggttccgctttttactaggttatttacttcaccacatggggacaataattgtacttattcattgggttgttatgaggctttaataagttaatgtacaacatttgtaggagttgctggctggttgttagtgctcaataaatgcctctcattgtatgtaccaggcgattttacccccacccagagtctgccttgctgtagctgtgctactgtcctatgttggagaggaggtgttacctcattgggacccttcagtcaggtggttgaagtcagagctttgtagaaaagaaactaaagatccatttgcttctgatgaaaacttactaccagaaaatttcctgaaaaattaaagaatatggatgcagtccctcctggtctctcagagagctgtatattaatctctagggctctgaaggaacagtttgaagacaacttggccagataacctctgaagtccccacaccccgccccaatgctgctctcaaattaccacctcatggctactcctctcatattaggaaggtgatatttatttccatggaaaacaacaaagttaactgactcctttgggaatggaaagaatgacaatgtttccttcaccatgaactcaatcaactaaaataaccattcacgcctcccagctgctttcaacttttcactaccaggaatttccctttacctcttgacagaggaactcctgcagttatcttctcctgtgaccgctcatgtttgcaggcaaatatattctccttcagaggagctgacataaaagtattttaaatcaaaatgggatttaatatcacttgttattaaaatacatttctggtgcctgttttaagggtttattttcttgccaaatagtttagtgtaaaaggagagaaaataagtaaatcttatactatctaaggttaaaaaatttacgttttgtgatcatgatgtttgtattgagaaagtatgtgtgtgtgtctgtgtctgtgtgtatagcctgtaatgtgtaaggatatgatagaaactatatcacccacgcatttcattctattgccttcatgcttagttatttgataaataactgtatctcttatggcctaatgtaaaataatgaatcaaatttccccagtgctgaaactagtcgaggccttttgggaatacttttcaaaccattaacgcattaatgtgctgctacctatgtgtcctgaaagggttactgtaggtttcaaaaagggtctaatttactagctaatggtatttttttcgtaagagtcacttggctttgcggaatcgaatttcatctttctgcttttgggttaattcaattgaatttccagcaaactacattgtttcattctcattgcagtcagtccctcatcttacaaaccattgtgttccaaaaactcatttgttatttggttatttggaacttagaggtagttttcaatagaaaaattaaagctacaaatgttgggtgtgttcccagaatagcccacagaagccaacttaacccatcatatgtccagtcctcatgctgctatccaacaaaaccaacatgaatagcagtgcctataaaggtagcgtgctttgccagatccaagctgggagtcccagagctcattcttctatagcagccctgtcagtaggagtgagaactttcctgtcttcattcctccaacctcaaaagaagcaaagtgagaacacagcccagccataaaccatcaacagtgactgtgattgtttgggccaggggttgggggtagaattactcagggacaggggactatgtaatagagcttaagcatcaagatagaggcagaggagaatgaagagtcaaaattgtttataagttgtcaggatgtagtgaggtcttagaatgaggagtagaaagattgacaactaggtgactgggtgagtgaagacctgaaactagattagatttaaaggcttctgccaccctctcttcccctttacaatttcagagtcagctacagattcaagttcacctaagtaggattgcttggtaaagagcaggcatttcactcactggaaggctttataagaaatagctcattttttctgccattttttttgcccctgaggctcttgctcgggtggaaggagggaggccaagggagaatctcaggagagcatgggagcagattagagtggtatgatagaggttctcaggcagagacaaaaaagggatctcaatcttggtgtgcctctgctcctatctctgttgttataatgggaaaagtttgaacgtcaaatggaagagaaagtgaacttctagaagaagggatgtcaatagaggagcctctcctgcatgtctactaggacagtatccacgtgtaataaagtcaaaccaaggtggtctttctggatttggcttttctgacagtttcctgagaattgtctcaggaggaaaggatgcagttctcaaatgtttctttggaggaagccatatacctgtctaaggaaaccattataatcttagaaatgagcttttgtaccagatgtaccacatatacaagattctcataggaggatccttgatgagcctttccttctcctgtcttgagtgctcttctcccctcatttaacccagttagttcctacacgcctcttagcatgcccatgtcatgtgctcacgaaaacctttcctgaacatgtttcccagtcaggctaggccagaccctgagatagaagcacactcaaagcatattttgctgctgcttttcattatttttactctctgtcacaatttgaagtacataactcattggggaactcctttttaaatggttgtcttccccttcaagaaaccatctccatcaagacagagactatgaattaaccactgtatccagtgcctagttcagtgcctaacacttagtaggtctttgtaaatatttgtcacgaactatcaagaagcagaaattttgtatcttaacatgtctttgtagggaggtcacctttaatgcatacctttgactattaagaaacttaagtagtgcacagagaagatgtagagaactgttaaataaaataaattgacttaaatgtatcattgcttagtataagggtggactctagacagcctttatatctcaagaaatttgcctacttctatgtcaaaattgtattagtacctatgaactttccaaactagttaatgctgttttgagttgaattggctttagaaattctaaagtggagagctgcccttggcttgctgcattgagcagactacagttcttaggtaggaggcaggaatggtcctgaggaacagtcagcatctctgccatccatgcaccacggtagtctagagcaactgagaaaaccagatgcctccatagaacccacaggtgtagacattaacaataggacactgtggatctttgtgttgatttcagccacccacccaagtcattaatttatagtttatgcccttcacaaaggaaatgtttttgctaacaaatctcttatgatttcatctatttgtcttttcctctttgtgttttgtctcatacaaataatagttaacatagtgacacaaacaccactaaaatacttcagtatttttctcaggacttattcattttacctggaaggaaattgccgtataacccatgccattagaaaattaaaaatgcaaccatttctgcagctcgtacgtcatatgctatgtaatgaaaacgtgcctagcctcctactcccttgtatttgccaacagaacttaagcaagttctgtctgggctgcactcacactttcttagtgccagggagatgattggatataaattacatagcttatatttcctaatatactaaaaagaaagggaaaaacagaaaaggaaggaagtaaaggaaggaaaaaaagaaaaggaaggaaggaaggaaggatctctaagtgtgtatcaccagaagcttagagagatgatattttaactgtagaaaattctcgaagattaatctactatatcatgattctttgaacttcaaagtatacccccaaaatataatatgtgaacagttgagtactattgcatatttcagtcaaaactaaaaacaataatctgtaactgaatatgtaacttagaaaatatcaatataaattttaatctaaatgatctgtttattcctttctcaaataatgacttcattttagtaatagagtgttttatttactcatataggcatacataaatagattttaagcattatttgtgatgaggcataaacatgaatcttctaatagaaagtggtaccttggggtaaattttattagggaaagatttcacttatgtgagctatcaaagtgatcaaattcatggaaacagaaggtagaatggtaattaccaggggctaggaggatggagaaaagaagagttgtttaatgtgtacatagtttcagatctgtgggaggaaaatgttctggagatctgtttacaaaaatatgagtatacttaacacttctgaactatacacttccaaatgcttaagatggtaaattttatgttgtgtgttttaatcacaattttcaaaaagaaaagaaatattcataagaaacttgaatattcttctagttttgcaaattatccttattgtttagcctcttaattgtatatcttacaaaaatctagatttagaatacaaaattattatgtgtattttatcatataaactcatttgagatgttaaatgatttagaaacactataaaattatagacagtttgtattcactttttcaaagttagttaaaacagtgttgatgtttctctgaatattgtcatgtttcataaaaacgttaatcttcagtaatttacatttattagaataatagtgtaaaacatgttatttacgatcattaaaagttagagtgttctaaccaattattactatttattgttgttattattattattagtttgagacaggatctcactttgtcatcccagctcaagtgcagtggcacaatctgcttactgcaatctctgcctcctgggcgcaagtgatctgctcaccttagcctcctgagtaactgggactacaggtgcatgccaccacacccaaataatttttgtattttttgtagagatggggttttgccatgttgcccaggctggtgttgaactcctgggctcaagtgatctacccaactcagcctcccaaatgctgggattacgagtgtgagccaccatgcctggccgtaaccaattattttaattaatataaataatcagagtataacaaaatacaccaaaactggttatattatctttataaaatatgttttataaatcactaacaaataactaatctggttggtgataaatatgtctgcttttacttattcctctccattttagtattgtaattttttagcattctatactagatcccatgtacagttgaagttttcttttgtttgttttccctgtcaggcttttaattaaagaataataagatcttatattattatagatcttatatcgcttatataactaaagagtacattcaaccaaactttaactgaactttacttgtttcatactggtggaaataagcacaatgtgaataacacctgagactgtcactggtggagagcgctcatgagcccagccctccttgggcttccttactggcctcccagccccacccttggcctgtgccatccttaatgtgaaatcccattacaccttacctaatctctcaaatggcacctatcagatcttctcttttattcttgagtattcagttcctcccttttttttttgatctttctaactgacatgtttacagccatttaagacacacagcacatgtacacatgtaacttccctcaaatccatgtgcttcttccattactctgtctcttttcttctttgcatagcaaaactgatctgtaccaattagtgaccgacatccttaatctagcagacaggttttagtctagttttctattgtccagatgatgttgcataatcaacaatgtcaaacttcaggggcaaacaattctgaagttaaataaagcactgcctagttcttgtacctgtgagttcgctccacccttgggctctgccctgctgtctctatttcttctggaactcaatggctagacaggcgtgtccttctcatgggaagagcagaagcacaagagggcaagtggaaatgctcagatcctacatgccatcaatttttcctttttcttttggctaaaacaagtcacttgaacaaaagaaactatactccactgatttttgtgggtgaaactgcaaagtcacacagtaaagaatgtggatatatgaagaggggaagaactggggccaagaacatcatctaccataataatcttacctacctttggagtagcaatgagtactataggcttttgccttctttaggaaataccctcttcctgtggcttccataatgaaacattgtcttgatttcctcccatccctctggctgcctttgtttagtttcctttgctggtccagctttctcaagacctggtaccaccatctcctcatctttttttttttttttttttaatatggcctctctacttagtgttatccatgattctggaactcattgccacccaaataaagctgaagcagagatgcttaaattgttcccttagtttcaaaaccatatatttaattacctattttatatttcttccaagatgtttcaaagacacctcagactcaacttaagcctaaatttaaatttaaaacatttataattattccctcttgtacccccagacttcttcagtgctccctagctcagtgaatcctactacatccattgagttatagaagccaaaaaaaaataagactcatcctcaacacttcttttctcattaagctctattgattttattgcctaaatagtcctggaatgtatctgcttctttctgtcactgtggtttctccctagtctaatccaccattctctctcacctgtagcattgtattatcttctgaacctcatctccttttgcccccatctgatctgttctctgcattggagccagaaaaatcttattgaaaagcacatctaataatgtctccttccttttaaaatacttcgaggactttccattgaatggatagaggtaaaatgcctgacagacctatatgcatttttgtccctgtctcatgccatgcttaaccgtattactttgcagttccgcaaaaaacatatcatgagacacagattttgtagggcatttatttggaatatgaggccaggaagtaggagtgagggaataaggagaatgaggaaaaaacaaaataacacaagcaaaagccattgtaagagtgtatgattgagtttgcctctctagggaacggtggtctgatttcatagcacatctagaaagtctgcagattaggacccataattatatgcctgaagaataagcacctagttgcatatatccactggctccccattgtttgagggttgcactcacttgtgtttagctcccctgcatttcagagccagacacgtgcacatcctccctgtctttgcctagttaactcctatttatttttctgaacccacctcattcctgtgacagaaaacccctgcctctaaatgaagcaggttcttccagttttctcaagaccacatgcctctactatacaccatatatatcttctttgcagtgctgattgctgtgatgagtttgcattttttaatgattatttcatgaaaatctttctgccctctggactgcaagcttgagaagaccaagtttcatgtcagcttttgattttcattgccttaccagcacccaacctaggacctggtacataaaatatgttcaatatattttcaacaaatgtgtaagtataggtgtgtgtgtattaatatgtgtgcatgcatgtatatttataaagggaaactttgaatttttagagcttaaatagattactatcaatatctaaaaaggttatcatttttaattcaaatttcatattctatttttacttattgctttcttttagtgcttacatagtcgaattataccagaggcatctgtttaaaaaaagtcatacggagaaaaaacagagaactcttgctttacattatcatgatttatctgacagcttatagtattggtggcacttttctgtagaaagttatcgctaggcagttgctttaataaaacagagatttttgagttaaaatgggtaatatcagaccataaaagacaatcctttacaatcctgccttattcagtagaagtcacattcgttagtgttgagcaatttgaggacttaggtacttacaaatatatatatatatccatcccctaaaacaccatgtccaaatttttgtttcatgaactgggaactgtgacttgataacaggaaatatgtggcaaaaatagatgagtgttcagtctctggggttttatgctgatataaaataataacaaccaaaatgggaatggagaggcagatggaaatcaacaaattatttttaatgaagtaaaatacttccataaaagtaagctaccagttggaagttatcactatttaataaatgttttttatatttctagttaccatgttgtatgccagatgatccagcattaattcaacaaataatatggtacccttggcaaatagaatggtcatcatggagatggacatagtctccaccttcaccgggatggttgttattgctttatttaaaaatgcagttattttctctgaaaacatctatacagatctatcatgtcctgagctttttctaatttcttggaagggaagccaaagtagcatgcatctaattcagtctcagacctcagcttccaagagatgttattaactgtggtgaaaggattagtaaaatagtaaatggattatgagatagttgtatctgtgtcaattagtggttgctgtcaattactagttgcttatattcactttctctcatttagggagtgtggagagtagaatattaaatgtctggtgggcacagagtctcttttcatctggtagttgtcttagttatacacggggctataaactgaaaatggtgtgtaaccctttaattgaagactctggggtcctaaaataatttcctcaagaacactctggcccatagaataaacattttgaaaaatattttctttggtttattgcatatttgaaatcagataatatctgtcactccaggatctataaactcttgcatgtgggatatttttaggtaaagtgatttttttttttttttgaggaataccaaggggatagtggatttccatgaacttaaggatcacagtttttgttaagccgaatacccaacttgaacaaattttctatttttttgttgttgcttattgacagatgtgccatgaaggtgtttttaaggtctcatgaccctaaaaatggcttacgataagcaaaagtaatgtcagctttgtcctgaggggatcttgattcacttatcagctgaaaacagctgagcaatcaaagcacaggttcttccttggtggaagtgacaactctagttcagaatcttccaatctgaatctaagatcatccttagaaattagggtgggtggagaaaccagagtgatgtgtgctggagccaatactccatcagagtgggagagtccactctttcctgttgctttccccactcaggccttgggctattttagatgaggtcaccttagccatgttctcaccactccagctttgggccatctctgatgagttcacctcagccatgttctcatcattcctcctctggggcatttcggatgaggttaccatggtgggcacatttcttgcctcatgtactttagaatgccatgtatgcttttaaaatcagagacaagtgcctaacaacttcttatttatatgtttttaggttagatgtaaaatgacctgagaactgcagccctcatgagcattggctacgtgaatttttgattaataaagtctagtaaattcattgactatatagccttatctaccaagaaaagataacttaatttttgaaaggattacttagcttgctttggagagggtcaaaatttagtagaaggtgtgtcaaatgaacattattgctgaagtaagtctgaaaaattcaaaactgttgatggtgagaactgaagtgtttattatattaccctgggtacttttctatgtctattttcctttggaggaaaacatagttctaagaatctaggaggcctgtggatgtatgaaattaagaggaaataaatattctatcaataggaagaacttcaagaaaacccaaattgtccatattctgaacataacatttgttatatgtgttatactcaatttagttgcttttgtttatctgagatttctgtagctttcaaaactgatctcttaagatttactagtaatgtgagttattaaggggggcaaaatttcattaattcattctgttttctaaatactttcccttatccttgcctctctcatgcagtctttcattgtttctctcccatttattttacaagaaaataaaaaatcttactgagacttttaggccttacatgatttggcatctccagtgaccagaaacatctcctgtctcaccattgcttactaaactccgtggcttccatcaattcctaaattatgtcaagcttttttttcatatctgaatcttgctttctgttccctctttctaggttactttttatgtatgttactccttcttctggtctgagcttaatcatgtcccctcctcagaatagtattgtctgaccacttttctaaattcaacatttcatcttatttttctcacagcatctgtttattgtcttcattgcatttgacataatttatgatttgtaaaaatgtgttggcttttctccttaggtagtgagcttcatgacagtaggaaccttatgtatcctgattattaattatatccctggtactaatagttagtttgacatatgggaggttatcacaaaaattataatgtatgaatttcaactgtaaattggaagcttgtcaagccccttcatggttagtgactgacctgttttcctcaatcttgatctaatgaggctttagactactgctcctagctttatgaaaatatttctaacaaataccatgagaacaaaaaaagacaatgtttaaattctgaatcttgacaatgttatactcttttataagtgatatgctttggctctgtgtccccactcagatatcaccttaaattgtaataatcccacgtgtcaacggtgggaccaggtggagataatgtttcccccatactgttctcgtgatagtgagtgagttctcgtgggatctgacggtcttataaggggcttccccttggctcttttctcattcttctctctcctgccaccatgtgaagaatgacatgtttgcttccctttccaccatgactgtaagtttcctgaggcctccccagccatgcagaagtcaattaaacttctttccattataaattacccaatctcagatatttcttcatagccgcatgagaatggactaatataatgtttattgcaaaagatgacatttttgaattaaatatctgaaagaaaataaaggtgtcttgtagagttttgtttccttcatttgttatcctaacataatagaaataaagaagtaatacaaagttttaggaaaacatagcaaatgaataatacagttatgactttaaaaggaaatcactttcagtaacagtaaattaaaatcttaattattatatttcacttctctatagcaaattgaaaaacaaaacaagcactgtgaaacaaattagaaattcagtcgtaatactctcaaatgtactaaggaatttagaagagtaaatttcatttagtttcaaaagattaaaaagtacaactttggacaataacgttatttttcttaggtaggcattaaagaaaatagatcccatatgtctctttttaaaagactgtatctaggccctggccccggaccctacagccatcaagatgttgatgcctaagaagaaccagattgccatttatgactcctttttaaggagggagtcatggtggccaaggacatccacatgcctaagcacctggagctgtcagacaagaatgtgtccaaccttcctgtcataaaggccatgcagtctctcaagtcccgaggctacgtgaaggcacagtttgcctggagacatttctactggtaccttcccaatgagggtatccagtatctccgtgattaccttcatctgcccccggagattgtgcctgccactctatgccgtagccgtccagggactggcaggcctcggcctaaaggtctgaagggtgagtgacctgcaagactcacaagagggaaagccgacagagatacctacagacggagtgctgtgccccctggtgccgacaagaaagccgaggctgggactgggtcagcaactgaattccagtttagaggcgaatttggtcatggacatggtcggccacctcaataaatttggagagggttattttgcattgtataaacatccagccaaaaaagcttaaaaaaaaaaaagaaaaaatctaaaccctcactgatttcagatttattaaaaaaataaacacaggtaatttccattttctagtgtctcctttgctgcgtatttcttttgtttaaccagaagatcacttgtgccactagatttatagaatattaagtgttactcacttcagtatttgtaatgtcattatccattttaggataatttcaacatttgtttattctggaaagcagaagtaatctgcattcagatacaatggcaattccatgcccagaatgcttccctgagcttcacggcttattaaagcatgcagtcctgtatttccacagccatactaagtagctggattcaggcctgtgaatttggtaatgctcagtacatttcaaaacgtggactgggattgaatatttaggtaagattgacttaaagataattagttcatatattataacagatgctttaaaggagtttgtgactgagcaaatccactgggggacccatgcactgtacagcattttaatagcttcccatggagctggtttttatccagctaggctttagtgtgctgccatctccttgtgtggagaggatttgagtctcactgtggatcctatcattggaattactctaagaatatcatagaaaatactgaggatctctttaggatttcagtatcagagatacttgttctcatccttagataagtactattaaagtagtttttattaggtaaacactgcaaatcttgaaattgatcatttttttctctctttaggttggcttctataactctaagaaccaaatatgggggcccacttataattgcagtatttcatggcatgtatctctgtatgaatccacctatgctctccatcttactctcctttttctatctcctttttcaagttcatattcaattcattgtaccttgcttaattatatgctttctgttaagctgacttgcgtgcctttttgaaatgaggtagattattaattcattaattactgtatagattgcttttctggctcattgtaattttcaagtcattagcacaacaggagaatttataaggtatttttgatatgccattagacgtatcaaaactagacattgggaaggtcttacactcttcatatgcttatgtaccttatatttgagttaattttcttaaataatttctactacataggaagctgctgaaaaattttaaagagtatttgatagcataactaatctagtacaaaaattaattaataatcttggaaaagacatcattaatgtttaggtagatattccatgccatcatttgcataacaatatcacattatgctttatcttcatattcaaagagttttcaacatacaaagagattctattataaaggtgtatttataagttagtcatttagaatgcagagttcattttcatgaacaatcaagtttctaaatgacagctaggttagcccataaaacctgttttgcccatagtatataagaaataattttaatttacagtgacaaattacagaaaatattattttacatcttaaaatagaaataaaagcacaaaaattaccttattttaattttgaaggctaagacaaaaatggtataattaggaaatcaggacgtagatacgcaggttcttgtagatgctggagagaaattctgggtatctttaaagggaggaggatttattgtactgtgtgatttcactccactgtatattagttgtcccttctttttataaatatatcattaatggtaggtgcttttctgattatcaaggaggattaagttccctttcaacttaaaaattaaatgagtaacagaggagaggagcagcaaaagacagagtaagtgaattggtattcctgagataaacagatgggagctggagcagaggcatctgagtaagggaagtgcttacctgggcattggacatgggagagattttctgaggtggctctaaatgagccataaactgctgaaatcatgagggtagagaggattcatgtgttgcacagaactcccaaggggaaaataacaactgcagatgaagggatatggatcacacaggtccccacgtttcctgtcgggctgggggcagggtggagtgagggcagggagggatcccgcgtagatggcaagttctttatttccaggtggtggcaagctgggtgtttgcaatcttggaagtgcttatacttataaaactttcacttactctgggggtatctgatactataagcatacagaaatgatgcagaattttattttaagtataaagttctgagcctggggccaggtacataggaaagtattaattaattttagttcttattattttctggcatttaatacaattgtcagtggaagttattaatactcactatttattattactgaacacagtcctctaaatcatgagttaagtaaatctaaaacaaaatacagagtactgtttccccatcactctgccccagctccatttaggaccttgttccctaacatgcaccatccaccaggccttttggttctttttaaccttttagtttcccttccttcacattattctgagttatctgctatccctcccagaaagtgaacatatgccctttaattactctgcctccattcaacgttttgaacctttcctcttcttccctttaccagccaacaactacaaacttaggtctccacttattattgtcacatttttactagcaatttacaacctcagctgttcaaaatcgagccctgattcgtcaacgttactgaaactgctattatggaagtgaccaaaactctcctttgtgcagaatttaatagtcttttctctgttcttgttctctttgatttttttgcagtattgcagtatcgaggctgttagccaccttcttctggagctcctcctcattgtttctctgagacctcctcatcgcacagctcagtctattgaaatcttgccctttcaggttccatcttagatgcctcctccttattggacccttcctgattctcccagctgccctcaataccattttgtctttgcctctattggaaagtctgttttcatctttgacatatagatatttgggtattgttaagatctctgctctggattctgagaatgaggttcttgggaataggaaattgccttacatttacttactgagtaaattcccaatcaacagttgctgaggactggctttctttctccatgcaacctcctgaaacattgccattgctgtacattattaatatttgagtcacgatatctatacctgaggtttaaaagctgacgaattgctcatttgattgccagcatcataccccgactggtgagtgtgctccatttttggtgaacacagaattttatacatttatttcagtgagtttactgccccttccttcaaagtagttctcacctaaacttgttttttattcccaagatccttattatgaaatagctgtttcagctcactggtatgcgagagcaagtctaatagcactgaatcctgacactggttctgtgttccagctctcactggttcctctcctggggtgctttttctctgactgcttttttaaggccaccaatctgaaatgcagtttccatttgacagagctgtagatgagcttactctgaaaacacactacttgcccttgggtctaaggtgctcatttgtagtccccgcacataaacctaggagctccttactttgcaatctgcaggtgctcagcctattgcatattggaaagaaatgttgtcaacaatgaaaacaagtcagtaaatacttaggcattttctcactagtaaattgctgcaatctgaatcatcaccatgttctcccaattcttttcccattccatactaggtagatttatgtgacatccctgaatatggcttctgctggtggctgctacctgaggtctgttctcctgccaccctctccgctcagggcctcggctggttcacatggcctcctgctggtgaggctgatcacttccttgcctgggacccttattaactctgcaaggtatccacagccttccccaagagagattggcagtcacttttatgcccgccagggtctgtgtcatgctttcagcacaaccctccacttattccgtcatgtagcatattagggattccctcctctcgaacttatctcctctcaagtgtctatacaagctaagaagacttactcaggagtggggtcatggtgtctcttcactgagtgacagattcttctttctcagctcctttgaaatagataagagctagtagtactgactcaatttataagatggcaaaaaactaagtaaataaaaccatgccaaatcaaaaacaaaaataaaacccacctaccctgatgtcttttaaagaagccttttgatcataggattggacattctctcacttacttactgagcatttatttctcaggtgtctacttagggtaaactccgcaaaagttcctggtaatgctttgcctatgtcagtgtggaacttggcctattaaatgacaggcagacaggccaggtgcagtggctcatgcctgtaatcctggcactttgggaggctgaggtgggtagattgcttgaggccaggagtttgagaccagcctgtgcaacatgacgaaactctgtctctactgaaaatgcaaaaattagccagatgtggctgtgggcatctgtagtcccagctactggggaggctgaggcacaaaaactgcttgaacccaggaggtagaggttgcggtgagctgagattgcgccactgcactccagcatgggagacagagcaagattccgtctcaaaaaacaaacaaacaaacaaacaaaaaacataaatgacagacaggtaagctaagcacagaacaatgtcagagtgcagttaccatcgagagcaggaaaataacagagaacagagaaagggggaaatgagcttcacaggatggggttaggaccaaagaaagtgatccaggaagtggatgttaaggaatgaatgaaaatgcagagaaaaggatgtaaaggagatctttgtgatatttatgcaagtcttctgtattttcaaaactccttctaaataaaaagttaccacctcaccaggccaataaagaggaagctaagagaaaggtattcacaacatacagtatgcaaaaaaacttgtcgctcatttggtgttactagaccttcagagtcacggggaaaccctggagacaaagctggtgtacatgcagttgaatctggatggatttggatttctaaaagggaaagacagaagagttctaattaatggaatggaatgatgtgattttctttttagaaaagtttctctctgtgactttgtggaaaataggtaagaggtcagggatgcatgtgaagggaccgtgatctaggtgaaaagtgatggaaatctgtatcaaggaggtggcaatatgactgacagtaaaagaagaagttcttgagatacttagaagatggaattaatagggcttagtcactgatgggatttaagagagaaggaaaaggatttaaagatttagacttatctggccagagtgattcaaattcatagaaaaagtaacctgtgagaaggagcaggttaaaaggaagaggaagggaaccacttctgttttgagcagcctgaatctgcactgcctatcggatagctgagagacggtgtctagtggcagctgtacatctaaaacccggacttgggggaaagatcacaatataacttagagatatagatttgaaagtcattaatagatttagactgtcttaccctggaatccatgaatagtcctaaggggttcacaaacctcagatatatgtatatactttccccttgggctaaggatctgcactgagtatttccagttgccttatcccacatgcatatatgtgcatgagatcacttatatcccttctctgtcctatgtctatctatgtccccaagaggctgatgtgtttgctggcattacccgactcccttgccatttcttatggtgaggcattggcaggagatgagagggaaggagaaggaaaaggttgggatattcttttcccgccttccccacattgggtcccatttctggcagaggctgtattcctccaggactatggtcctgtccagagtcccctccttcatggagccagcactcccaagcctgcagtaacacaaggccttcagtcccagcgggtcccactttttgctcttgccgtcctcttggtgatttgacatgcttttccagttgcctgaaacctgcccatacatcatgaggagtcccttcattatggtctttgtaccatctgaggtggattgtttcttgccagattccatgtgtctttttttggtgctctagtatacacttgtgggagaaaaaaactcttacaagctatggggacggctgaccacacccacagattgtggcccgtaaactacctgtgaggaccagcaagtaccttcatggatccttatttaccctaaaacagtttctaaaatcttagtgacaagaagttgttaccagacatcccaggtgaaactgcacccagtgagtattgtaccaaattcctaggactggcctcaagtactgctgagcttagaaggggaagagaatgtgagagttcagaatctatgaatgtgtccagcataaagagggctgaatgttacagtgatgccttcaatctaacctgaatgttcttcttgtatttttgatatttattttttttctccactttttgaggtggagagggggatcaggatggatggaatatttgatagacaaggaacccaggaatttctccaccctgtccagctaaaactatactgcttggcagagttcccaagacggcactgtgcaaacaatggcagtgaactggatatccaagtgctgccttaccagctgaaccggtacctagtgttccagcaaatacttcagttcaaaacttaagcagtgcctcctgccctctttaaatttgagaatacatatcaagcacctggagtgcaggttcttacattttaagaaacagtgaccccactcattagaaaatgtgattcaattagtagcttaggctctaaccagtcagattaacaactccattctctattccctccccgctttctctttctcccctacacccatccttactctctctgaggacacacaggagttggcagaaatgggtctggtatgaggagagggctgaaagctccctgtccctggactcgcctcagcttctcttctgccatattcctgccattttttttttcctactgactctcctcgctggcacacttttttcttcctgactttttgttgaaaacgaagcattagataacctgggggacaactgaccttgtatgcctatgtttacaacatgttgccacccataggtagccaagtcagtgattcatcaggagttagtagatagggtagctagtggtggtgagaatagaaccattcacctcttttctcttccagaggaatcagggggtaagatattagggttgaaagggaccctagggatcactgggtttaattttttttaacattttcaaaacgccttagaaacctgtatttaaataaaatctttaaaataaatcaacatatgaaacaggccttgttctggatgaagtaggttggaagtctgagtccacatgaaaacaccatggctccttcccattgtcactattgcgtggaggctcctgggaaccctgaatgcttcatgaagtccacctcgaaagccttcagttatgaaaaccttatgaaaacctgctgtaccacagacttaaaggacttgctcacagaagttaaatggcctagagaattggagagcctcctaaatctaggaagcagcaccttaatccacattacattgccttcctcttctctgccccttcaaatctacaacattggattcaggatcacacagctgacaccccattcacattgccctcacacttacgattcactagaaagctgtttatctcagaagacatttttatatttaaaatggtgtgtgtgtgtgtacactgaagagtgtagtcattataggtttattctcacgggtagtcggccaattctggacagggagtgctggcttacactgttagccaatgagtatctgaccatcgcccatgctatacttccctcatttagaatggcacccctaagttatttatttactctggcatggtccttctgtctgtgattgtaactgctctggcacacggttttgactattattagctgaaaaagagaatcccagtgatagtgctggaagtgctgataaagtgaacacttggtggtaaaaggcaattttatggcagcgccaggaagaaaaagagggtcaaattcacaaagcaattagagattggtggaagtcctttgagatatgagggatataaacctcactgaagccttgtaagattaaccaataattgtatggacaatatctggaaagaaaggaaaactattgctgaggcatatctccagttaatggctattgaaagaaaaagaaaaatggttgcttatgtttgatattgaagacaacatattcaaaatgactgtgctccaaggaatccatgtaggatagattaaattagtttgtcatctcaaggagcttgttcttaaagttaagtgttgtactcatttatcagtccaggtaaggatacagtaatcaacgcaaaagaaggcaagatctcttttttcttttgtgttgtcatatactcaaaacaattttcagctctattccaagtattggcttaaacaattctgattatatcagtttaactggactataaatgatacttaaatatttcccagtaagccgttggtataacatcataccaatgactggaattttctgatcttcatggttggtcacacagttagatgtgcgaacaaacattctcgtataagagcaaaggccaggcgtggtggcttacacttgtaatcccagcactttgggaggccaaagcaggagaagtgcttgaggccaggagttcaagaccagcctaggcaacataacaagatcccatctgtaccatcaataatcaatcaataatgtatttatttattagtccaaatgaaaagaaataaacacttcatttttttaatagtacagttctattatatttttaaaatatagttgccatggtcaacagttatccagaatccgacttggtataaaaggattaatttttttttgttttttgttttttaaggaaaaacactagctggaaccaactgtgtggacagtgaaaatgatgaaagactgagagaaactttagaaatgcaagtgagggagtaaggtgctaagaggcccttagaagtcttggcagatgaaagatactgagtgtcagtttgcctgaagacaatacatatataaacagaatgggtttgactcagattccaccatttattgctgtgcccctaggaacccactcagtcttactgagcctcagtttcttctttggttaaattggggtaaccatacttgtctaatttactttctttcttttttttaaaaaaaattatattttaagttctggagtacatatgcagaacctgcaggtttgtcacataggtatacacgtgtcatggtggtttgccgcacccatcaacctgtcatctacattaggtatttctcctaatgctatccgtcctctagtcccccaccccctgacaggccccggtgtgtgattttcccctccctgtgtccatgtgttctattgttcaactcccacttataagtgagaacatgcagtgtttggttttctgttcttgtattagtttggtgagaatgatggtttccagcatcatccatgtccctgcaaggacatgaactcatccttttttatggctgcatagtattccatggtgtatatgtgccacattttcttaatccagtctatcgttgttggacattttggttggttccaagtctttgctattgtgaatactgccgcaataaacatatgtgtgcatgtgtctttatagcagcatgatttataatcctttgtgtatatacccagtaatgggatggctgggtcaaatggtatttctggttctagatccttgaggaatcaccacactgtcttccacaatggctgaagtaatttacactcccaccagcagtgtaaaagccttcctatttctccacatcctctctagcatctgttgtttcctgactttttaatgatcgccattctaatttactttctagggttgctgcaggaacccagtggaatagagtatgtgaacatttcccaggaatttgggaattgatatcagttttatttccctgttctcagttggactgtgtgtaatcttaaagacccagccagatatgaacctttccctttttaacatttttaaagtttttatgggatctctttatggtgcctaggcttgtctcaagcacgtggcctcaagcaatcctcctgcctcagccttccaaagcactgggattacaggtatgagccactgtgcccgacctttcctctttttttttgagatggagtctcgctctgttgcccaggttggagggcagtggtgtgatctcggctcactgcagcctctgcctcccgggttcaagtgattctccttcctcagcctcccatgtagctgggattacaggcctgcactactgcatccagctaatcctttgctcttttaagagagtgtttgattgcacatattcctgagtgaacagccataaagatcagaaaattccagtaacaataactttttaaccaacaccttctaaagagcaccttgaatttatttctcaataaagaagaagtaaggaggttttgaaactcaagaaaaggataaaggaatgtttgagtttgattgagaccaggagacagagtttaagataattcttaatctattattaatagtgaggccttaggcctcatttaaaaaatgacctccttatagaatatgaggtggtacccttaagacctaaccattgatgagcttacaaaaagagatatgttttcccccatcggaaagcttccctctcagtgcagtttgaaaaatgaaggtctaccccagggtagtcatccttcatgtaacattaaatattaaattaaattggttggttgtagagccagtgttttctttgaattctttagtgtaaagaggtatttcttctggaatattttctggtagtgtatcttatttctttacccacctgtgatgtagaatctcttctgtcttggcaggaagagaaatttgtactacacttatttacttttggcaaagcagttcctattttaacacctacttgaaagtgttaagacttttattttattgttgttgtgagggggatgaattatttatacaaatttctccctttaaaccagaacaatgatacactgctctgtaaatatctgttggaaaggctttcagttttaactcatcatattgtaccgcacctatcaagtcctttactgggttttgcatcagagtcaaaacactcaaaaatgattcagggttctagatgacttcttagctgtaaaataagtttgcctttttctcaccattttggtgcaaccttacatacacatctggttgagatcattttcttgaagtcaattgaaacctattggaaacacacaagacatagcacaaatattgcatttttggagtacggctatgctgtgtgtcaaaaacctaaaatcatttatttctataattgagctcaaccatatgaaaaagtattagctacaagaagcaatcagcattatttatgacagagaaaacacagaaactaattaaatgtccaatgagttacccgaggaaatgttgaaaaaattcataagaactagctatttaaaatgatgctgtaaaaatatttatttaaaatatttattgacatgaaaatcatttcatgaaattctaaataaaagaaaaagattgcaaatagtatgaatatgtgatctaattttggtattaaaatatatattatttatttaaattgttaaaaatgcatagaaaatggtatgaaaggacacatacgaaaatgtgtttatctctgggtagtggaaatctaagtagtgtttactttttttttctttttgcctatttatttactattttgtgttttggattatgctgtggtgaacatatgttacttactgcataaaaagtaagaaaaactgttcaggatgatagacccatcttcaaataggggactacaggagagggaggtggtagaaattgaccattctgtagggggaccattctgattttaggatttctctttttagctttggtaaaaataaacaaaaaataaaactatgtcttaaaatataagtataaaaactgtgtttgttctatatgtttatactgaggttcaaatagctctcgtagatttacactttttgagtgactaatctctacatttttagtctaattttttcatttgctttttgaaccaatataggtgatattcacttctagaatattttatgatgatgtctgtatcacaaaataatagttaaatgcattgcgtgctgactagatctgactagattctaggcctattctaaatacttggcatgtatttacttgcctaattctcacaatatcctataaggcaggtactattattttctctattttacatctggatgaagaacctgaagcccacaggagctaagtctttattggaagttgtaaaacctgtggtagatctgggatttgaatcaagcaggctggctccagtgccatacaaatatgtgtcacatatgctacattatattttcatatttaccaaagatgttatgatggttaattttctgtgtcaacttgactagatcatagggtgcccagatatttggttaaatgttaactcttggtggctttatgatggtgtttctggatgagattagcattggaatcagcagactgcataaagctgattgccctctccaatatgggagggcattgtctgattgactgagggcctgaatagaacaaaaatgtagaggaagggagaattcactctttctgcctgatggcttgagctggaacatcagtcttctcctgttttgactggtactagacttatatcatcagccctccagttctcagaactacactactagcttcctgggtctctagtttgtaaatggcagatggagttttttaacctccataattacggtagccaatttctattggctttgcttctatggagaaccataacacagatttgatgaatgaaaatgctcatttaaaatgaaaggaaacttcaaacaccatattataattataactataaagtaggtaatatatttttaatagaagaacaaaaacacccaaagaattttattttcacaaatagcttgtaaagaggtttaaaattttaatttgtatttttttctctttttgttaatatgtgtgtgacacattttgtatgaatgtcacaatataccataccctaaaatacatcatttttgtgccactggttaatttaatatttcttttctttgtaatatttatccaaaaatacacacacacacacacacacacacacatatatatatatatttaaacatatatgtttatacttatcctatacacacacacgttatacttatcctacacacacacacacacacacacacacatacacatatggtgtatatatgtatgtgtatatatatatgtatatgtatgtgtgtttgtgtgtgtgtaggataagtaattctttttttcttttttgtatgtaacccataaaataattagaacgtgcaaactcactctgtgttttcaaaggtccaattcattatcacctcacaccttttcaggaaagacagttatcaaaagcatctcaaatttaggctttcactgtgtaatgtcaaagttcaaaaagcaggaaaagaaatttatgcttacaaacatctcatggtgcatgacattttaaaaagcgtccgccatcctagaaagagacaataaatgtttttacactttaatctttagactgttaaaaattttcacactaatttcctttcacaggcctaaaaatgtacttttccccctctaccattttttcccttatttatatcattttatgttggcctctttcttttcactttcttccattcttttatctctttcatttttctccttctaataactttttatccatactaataatatagatgaagatagtatatgtgtattagttcattttcacacagctgataaagacatacccgagactgggaagtttatataagaaagaggtttaactggacttacagtttcatggggccagggaagcctcacaatcatggtggaaggcaagaaggaccaagtcacatgttatgtggatggcagcaggcaaagagagagcttgtgcagggaaactcccgtttttaaaaccatcagatctcctgagactcactcactatcatgagaaaagcatgggaaagacctgcccccgtgattcagtcatcttccactgagtccctcccataacacgtgggaattatgggagctacaagatgagatttcggtggggacacagagccaaaccatagcagtacacaaaaggtgttgctaaagatttttaaacataaattgacaatacttttaatgacagtgagtcagtgctatttttcaagaataaaaagagaagcaatgccagatttcccccagtgacataaaagagaaaagtagttattccagaaaagattgtattccagtttctggtaaaagaaaaactgactaaaaagtggcttaaacaattttttctctttcttcatataacaagtccaaaggtaggcaatttctggtattactttagcaactccaagacatcagggtcgaggtcagtatgattctcctgacttttccatctagtggtgaagtggttgtttcagcttcagccatcacacccacattcaaggtaggatgaaagaaatcacatttatcaggacagaaaaatggcgctagaaatcccctgcaaatttctatatgagctcactgcctcacccatgctgcagggccaattctagctgcacaaaagactgagcagtatatttttgccactaaaattgccaactgaataataaatcaggtttcccttaaaagaaaatgaaaactgaatatctgatagatgtattactagatatttctatgcaataaattctcccaaaatctagtggtaagaagcaacaaacatttactatcaagcagtttctttttctttttgaaccctttgaccaacatctcatttcccctatttcccagcccctggtaaccaccttttcactctctgcttacttgagtttgagtttttagacttcacatataaatgaaatcatatatttgtctttctctgtctaatttctttcacttagcataatgtcctgcaggttctttcatgttgtcatgttatcacaaatgggaggattttctttattatggccaaataatattctattatgtatacatatataaatggatatagaaaataggatgtgtatatatgtcacatttgcctctttcatcacaatatgcctcaagtgatagagtgactcaccaaagggcttaactcacatctaatatatagttgacttcattgtacagtaagtctgacatcaagtatggtgcctgttttaatttgctagggctgccataataaagtaccacaaactgaatggcttaaagaacagaaaatcattctcacccatattaatgtgcacacagattgaagtgtccttatgtgatgtagctatacttactttttggtgtcaaacatcttaatgtcttttttaaaactatgagtcagtgagaactaccacctgataggaaagcatatttagattctttttcaaacaaatctcattgggtctaatatataatagttttacagattgtatgtcttatctttataatatacatttacttgattactggtgtttttatcccaaagttacagttctgtttgttatcatttgatattatcatagaggaatagcctttaaagaccttggaagtagagtattactgcaaggtttgaaagaaaaacggcagcattaaagagtgtcagctcttatatgtatatgctttttaggaacataaacttagaacattaaaactcttaggtcatacttgtcaataaatgatttttttctcaacagtactttataaccttttagaaatttgccaacaggtgacaatactccctaacagtctgctagaagtgtcagagctcaggatatctgctttttaattgccatattcaaggtctaattattttctctatattggggtaagagaactgtaatgaggaagtaaaatcattaaacaccagtgagtaagggaacagagtcttcttgaattctgatgtgaattagcttccccagcagagctttggctgtggataatttctatctgaatgtctccttctcagttatttgagaggacacataaaatataaaggaagactgctcaactcttgtggtctttaaagagaagggaagacaatggattaaaaggctattattacatctagacttatagactgttaatacttaagagtttattaacctcaaagtgtcaaaatgttctataaatgagtaagatactatgtaaatcaggctacacatatgataaaagttgtcattagaataagtggcctagaaatatataatactacacagttttcatactttttgaattcatagaatttagacactcagattcctttaaaaccaattttgctgctttatttattatttatcatattgcctttcacagttattcttttctgtaattctcagctgttttagaaaactaccacaattaccaaactgtctcaaaagcaaaatttgttgctgtagctactagaaggctaagaaatcacaaacatttgattctgtaagagtctatgtgtgtgcctgagtgtatctcatgcatggttttatgataaagcatgctaaataaattgtttatatttgtgtttgtgtgtatatgtttaccacttatgaaaagaacatacccaatggcagagattgaattaagtgctttctgcatgatctcatttttccttatgacaattcttgaatgaaggtattgtacacatttattagctaacgcggtgggcttagcaagtggctgtattagtccatttgtcttgctgtaaaggaatacctgaggcggggtaatttattttaaaaacaggtttattttggctcatggttctgtagactgtataagaagcatagtggtggcatctgtttctggtgagggcttgtagaagcttacaatcatggcagatggggaaggagagcaggtatttgacatgatgagagaggaagcaagagaaagagagggagtaccatattcttttttaacaaccaattcccacgtgaactagcacagcaagaactcactcattactgaggggaggacatcaagctattcatgagggattcacccccatgtctctaacacctcccaccaggtcacaccatcaacactgggggtcacatttcaacatgcgatttggaggggacaaacatccaaactacatcagtggtttagctgggatatgaacctaggtctgcctgtctctagagaccattcatgtaagtacatagaaaccatattcttccttgccactagaaaaaaccctctagcaatttttgccaatgttgattataaaaaattttatatggacccataaagaaaagagcaaattttgagcctctctgggaactgtgaaaaaaaaagatctgtcctcatatcaacctttgacaattcaaagagcaaacagaagattgggttacttctgtgatcacactgataattccagcaggcaaatcttagtcacaacaagtccctggagtccagccaatctggctgctttgatgctaggctcagtagaactgaaccaaatgtgcgtgggaaagagaagaaccagatattgccatgactgctcatcagtcaggatttcagagactgaagaatgcagactgaacaaacctgaacccatacaggaaaaatgaacatagtaggagcaaaccatcgccctctcatacagcatagggagggattttctggagccaaagagtgggtttggggtttcgtagtccaaagtctggactcaagggaacctcagataaccagtaaaaatgatcatccatatcttgggtctcctaacaacttgacatgagtagtttaatatgttgaaacttcagtttccacccttgcaaaatgaaagttatattgttctcttccaaggctgttggtgaggttgaatgagataaggttgatgaaaggaacctcaatacagtgcctgatacacaataatgacaataattatatcataatcacagtcataatcacaataatgccctttctagccacatatggcagagacattggtgcagtggtcctcaaacatacgggtcagatttgtcgctcaagtctgtgatctaatgacatgatgaacccattagatgcctccctatcatctggatattgttccttgctttttccaagatctttttgaagatgacaatatattttcataatatttcactattttaaaagctttctgttgagcataatatacatattggaatgtgcaagtatcagttatactgcttgatgaaattttaccagctggatgtttttgtagccagtacccagttgagaaacagaacactttctccagtcactatcctcccgcaatgaagtgtaccttgggctaatagataagttttgcctattttccaaatttaaataaatagagccatatactctgtatatgtttacacctcacttcttttagtcaagataatggttgtgagattcatagattcattcatgttttgcatgtagtcatgctttgttcttttttattgctatgtaatattctattgtgtgactataccacaatttatccattttcctattgacgggcatttgattagcttccagtttggggatattatgaatagagattctataaatattcttgcacatgtctttagtgtacaaatggaagcattcttgcatgcctaggtttgggactgctaggtcatagtatgcatatgtttagcatcttttcgaaagcaagggtatcattttacatttccaccagctgtgtactgggttgttttcaatgattattgtgtgttaggaatcattcttcctgcatcacggttatttttaaagcatccacctgagaaaaatgcagctctactaagggctggttcttgtggacattagatcccaccaagatggctgagagcaggacgtgccctatgatatgtgtatgtgttagaggctggaaagctatcagaaccatgtacctctgctgctgttttatggcttcatatattttggtggcagtccttaacagctgtggatttatttttctaatgtttgcttggaaactgaaatgagtttgaaagcagcccgattcatatagaccacacaagtaagaagaagcatattagataacacaaatatgggctagagtggcgccagagaacaaaaaagaaacaactaatgattaggtaactagtggacccaggcatgaaatttagtaatatgctgtttaaacataaaaggctaagaaaaacttgtttgaaattgtagaagtgtctgacagctagtgtaaggaatgtgtgagtttccacgctgacatcctcccataccaacagcagtttcaacttatcaggtggccttcaattttagcaatgaggagaaaaatgggtaataaatatgagatcttgtgttaattcaaaccattcacaaatctctttattttagggaaagtcacgctaaaaccacaaaccagcaggaagaagtaaaactttcaataatgggttgagcatcgactgagcttgaggcctgacacgctgcattcccattttatcctcaagccaggccagttgtgtgttttcaccaacatgtttcccacagattggtcccagagatgctaagtcacttgtcccaagttccaaaagtttgtgaatgacagagccattttcaaattgaggttgagctgattcctcactgcttcatgttgcgagagagaagtaatagggaagtagtatgatttggcagtaaacagcaggcaaactataaaacattatctgatggacgacacaaacgctctttacatctctgtcattgcgccctgtccggtaggagcagctgaatgccatttggctctttcaccttctgctatctcaggaaggcaagctgagcttagacaactccgtgcctttgttgtcccctcacctcatgtctgtattcatctctgttcccttatgttgtaattttctaaccttttcccctcccatccagtggccttatctgaaaaatgaatcctcaagttgtccacagctcttcactaagacccggtctagatccaaaatgaattcagaaggctctcagccagcggggcaatgtgtggaatttatggtagtttgggggcgtaatcttagtgcagacaagtttcctttgccttgttggaatcacatcggagccatcaaattatattgcttctcaagatgcagttaaagtgatttgggatgtgctcctctggctctcccacttgaagagctttactgtgaagcttgagcttaaggtagagatgagctggtaggcccaggtgaggaaagtggttagattccttgtgacatctggaatcagtacttgactgatagagttggacagtactttcatgatcaagcattccaaacacctcatttaatgagggaagctccaaaagtcaaatccaagaatgccaagttagggaggagtaagagctagaataaaaatctctcaatgcatggtacagtcctctttgcttttttaaaaaagttattgtaatctcacagatgagtaaaattaagcaaaatgaagctagctggtttaacaaacttcattgtagcatcaaccaaaaatgtgtgagtcagcattaaattgggccagatttggggtgggagaaaaaaatggtcagatttcttccaccaaaaggcatcattagatgtcttcattccaagctcagagtgtacatacagcaatttgctgctcacagcacgtccacagcaaattatttcccttcgtcaatcagaattgtggtcgtctaatttgccattctcaatactagtcacgctttcactctgtgtaaaaattcagattttcttctctcttcttagacacatggcaccttttacctgcaaaaggtaattgcagtgactgtattgacatgtaatgatatattcacgagctaatcacatttgcatttcctccgcttgctactgaaaagctgcaaaggagtccctgtcatcatgtgtaggtcctcttccagcccagcattcacagcaggctggcaacaccaggcattcagtcagcaggtcataatgactctaccgctttctattattcaaaatggaatttaactgggaacttcatattgtattgtacacttaacccagttttcttatttgttataggtttatattgttaagcagtatggtaaaaataaaattctatttaccaaattctccttaacagatggaatgtttaataggccaataaataataggttttaaaataacttactaatctttatattctccgtattcttaatatccttcttatctactccagaccttttattttaaaactttagaatatcttaaataattaccagtcaatatttattacatcattatattctgcatttagctttattgcttatattttaacaaatgtaataaagacaatggcatatgcagcttgtagtttgttgctatgagccaggccctgtgttaagcaattagaggatctaagtgagtcctcaccttaactgtgtgaagtagatatcactgtcctctttttacagatgaagaaactgaggttcagagaggttgaatcactctttcaatgccacacttaaaaaagtggtcaaaccaggagtgatggcgagtgcctatagtcccagcaactcaaaaggctgaggtgaaagggtcacttgataccgggaattcgagtccagtttgggcaacttaagagaccttgtttcaaaaaagcaaaaacaaaaataagtggtcaaattaggatttataatcagaactatctgacattaaagtgctcttaaaagtgaaaacacgactgggcgcagtggctcacacctgtaatcccagcactttgagaggccgaggcaggcggatcacctgaggtcaggggttcgagagcagcctgaccaacatggaaaaacgccatctctacaaaaaatacaaacttagtcgggcgtggtgacgcatgccggtaatcccagctactcgggaggctgaggcaggagaatcgcttgaacctgggaggcggaggttgcagtgagcagagagcactccattgcactccagcctgggcaacaagagtgaaactccgtctcaaaaaaaaaaaaaaaaagtgaaaactcattattctgcttttgaaatggagtgacctttcttccttgttccatattcacatggaccatttcatccacaggaaaagaagaggaaattataaataccatgattcataatttaattactagtgaattgatagatagtaatgaaacaaaagtatgagataacagagaggaatgagagtggtattagtcagtcaaaatctattcagatgccagcaatggaccgttttcacaaaatctaggatctttataaaaacttttttaaagatagctgaactttattgattcaaatactaaaacttttacaaagaaacttttttagttttattttatttttaattgacaaatagtaattttatttaaggggcatacagtgatattttgatacatgtatatattgtggaatgatcaaatcacagaactagcatatctatcacttcaaatatttatgatatttttgtggtaagaacattaaacatcgtctctgtttgctgttttgaaatatacaatacattactattgactataatcactttgctgctcaatagaacaccagaacttatttttctcagctgcaactttgtatccattggccagtaatagttccccctaccccgccccacctcaaacctctggtaaccaccaatctactccctacttctatgagttcaacttttaaaagtaacttttcatggaaatctttctaaaatattctataggcatttctgtatagcatttaaacagatgacctcaggacatgacttgaaaaatccaggatttcactacgtggtggaatagctctggtccgttttcatttgtcttgagctctgctctcctgatgtttactctcatgtctgaatccacttggttcttgccttagtgacttctcttccatctagtgtgctatggaccatataacacagagttgcaaaaaaatctgtgtatggagtgattgggattctgaaggaaaaccttacagaggaaagtggtacttcagttatagctttttggggtaccagacaagttttacaattttgaaatactgatttatttatatttcacattgttcactacatataaatgcacatgtaagaaaatgatggtaaatgtacatacagaaaaattaggcatagaagtgtacaaatgagaacccatatcaaggagcttcttggcagtcaaaccaaggcaaaaagaggcagatttagttatgatttttattatcatagaagataatgtataacagccgtgaaagagctcatagaaagcttcatgtatctttttttaaaaaaattccctaagtcagagctgtgttgtagtgggctaaaatttctttttctgtttttctttttcctttttttttgagacagagtcttgctctgtcacccaggctggagtgcagtggtgatctcagctcactgcaacctccgcctcccgggttcaagtgatcctcccacctcagcctcccgagtagctgggactacagtcatgtgccaccacgcccagataatttttgcatttttagtagagatggggtttcaccatgttggccaggctggtcttgaactcctgacctcaagtgatctgcctgatttggcctcccaaagtgctgggattataggcatgagctaccgtacccagcctaagatttcttcttggtgttgctttcactaaaaaaataatcattagcagtaataacaactgaacaattatattaaaatactgtggatcaaataatgaaatagagagttatgctccctagggccttaactatctattcagaaagcaaagataaaactttatacggctagccaattcaagttagtatatgttgtcattactgaatttatgtaaattttagatataacgttctaaccccagtttttcaacttcataactaagatatgtagttgaagattcctcaaatgcttacgaggacattaacatcacccaaatcagccaaaatatgtcatataccattgaattggacacccacatctaatgactggttaatgcagatatgaaaaggccagccccttcacctcaattcctgacaactgtaaagtgtatcccagtttcagagacctccacagggttggcggaggcctggtgatgaccgcctctctgcccaacttctccctctgcccagtcctgcttccctcacttccactgtagttgttaatctcaagatcactccctaataaatttcctgattttctgtactccagtctctatcccaggtgctgcttcccctaaaaagaacatgccgcattacaggtcactttgtgcaagccactaagaacactgttcaagggaagttacagtctaatttacaagacaaggcacagcagtgcatacacaggctgaggggcaaacaaacccttcagcttctgaatgctgttacctctcagaagccagggagattgctgagagttgggggagccaaggaaggcttctcagaggaagcatcttttaaatattttcttcttccacccaaagcacctatcttggaatgtcaaatgattcaacactactacttttccatgtgcgtttgtaaaagtatataacaatttgagggatcatgttcttatgctgtaatctttctaaatcctctttctaaatcctaatgatgtgtatgaataccatagaagtagcaatagctcacaaaggcctgcaagaaggtagttgtgtttcctgcatagaaccctgttcaattgctgcctttctcttaagattatcatgtagcttttcaccttaagaaattaatatgctgtcatctgactaaataatgcttttggctgaaatactggtcccaaacatctcttattttgttgtgtctaatattttaccatctctgctcagcataacttattctcctcataatttcactttttctctgcttacactaacacgtggttttaaaggaaatattgatgattcatggtgataatagtacgtactttaatgaggttctgccattcatcatgttgttacatccatgtattataacactgaattgtagtcacctgtactggtagtcttcagtttggtttccccagaagcagactctgagattttaaggatttgagggtaggtagtttattagggaggtaactccaagtaggagagaggaaaagtgaaataaggaagaaaagcccatcaataaatgtatattatcaagccacttacaactgtgagcaagtatagcttaatccaactaaggaactctggtgacccctgtagaatatgtacctccctttcccacctaaaggcaagggatctgggctacttttacccaactattgtcagtaatctcttaagaactgttcctcttagacattaagtcctgagcactctcagtttcccaagtgcttgagcaaagtaaattcttgaagtcagagaaagctcttaggcaaaataaataaaatgcaggtactagcagtcaggcctaagggctctgagatggtaaaggcagggggatgtgggtgatgtcctgaaacatcatctacactggctaattaagagaaaacacaggattgcaatcacattgcgtagactggatattctcttcctcgctcctacagtcaatcacgccccaatttctgctgatgccatttccctgctagctctggggactccctttcctttgctgtttttgctgtcttctagccacatatgtctgctttcttgcctgttaataccccaagagttcttgcctctgagcctttgttcaggacggagcttgggtccctttgctaaaatgtgtttttaccttgtatatttctattgcagtccttctccaagctcactttctctaagatacttcacacatctttctgctatagttggtggcacttcattttagcttcattttagcacttctcataatctgaccttttattaagtcgggttcatagacatctctgtttctcactcaattgtgaatttctgaggggcaggtgctggcatgcaattactgtggtacccactccagtgcttcacatgtagtagatatttgataaatgcttgttgaattaaattgaataatttaaatccaaattaggtcagaaaaggatggtgttttaagtgggggggggggggcaccagattcagttacctggatagggaaaacatacacttgaattttctaacagcttgcactcaagctgtcattaaaattaaagtcctttattagatgctttcattgttgccgaaataatactccctgtgccttggagcagtagatgtaacagcctctcttagttataattttgtgacatcaggcatcaagcagtcgggaaattgcgagagctggtaatataactttacatatagtatatcattacaaatgagaaaacagggcctgcgggcagggatgctctgtaacatatttttctgagaagaaagaaaactcaatggaataacagtaaattctgtaaaaaacattttctccttaaaaaaagacagtgcccatttagttatcctttaataatttcaattaacttctgcatggcagcatgctaaaagaaacaaattgcctctcagtcagaaaactgtctgtctctccctgtcagtctctcatgaacacacacaaacacacacacacccacacacacacgcatgcacacaactctaagagcaatcattttaggagtctgggctgactctgaacactgctccaggaattaagggcctagactgggcaaatcactctgtttactggaagtatccaccatttcctctcctgtttcccacccatttctatgtttgcacacttgtaagctaatctaatttaaacaagaaaaaaaaagcctttaatgggatgataaccagaaaaaatgttcccattgtgtttaaatgaattcaaatgaagtcatattttgagggaaggggagagggccagtccccctgggggacttggagtcaagacagacaactgtgggtaagctttactggcaagcctctttcaatctatttcatagcttacatacccccgctcctctgatgccccagcccaaacaatgatacacagtgtgtcaggaggctgtagtagcctaaaccccaaattactgtgacttaaagtcaacgtagtattatttttgcttcttattgttgtgtttttctgtttttattttcaatctcacctgagaaggaggcagaccaggggtaatctgggagatccatgatcattagggacctagactccttttatcatctttctctctgtatttgtcttccatcttcagtgttgcctcatggtcacagatgacttgctggagcaccatcaatcacctctttgttccaggaagaaaaaagggggagcaaggaaaaaagattaaaaggacaatgcttcttcagtacatcagcagcttactttctcttggccacctctatcaaaaaacaagaatggagaacatattttgatgaaaatgcatattataaaaagaagggaagaatggctatcaagtagacaaaacacacagacatacacaatattgcttctgtcagatccttatgtggattgggttgcaaaagagtagtgacagcatgctttaagtgcctaaaaagtctctgtaaattcccagttctcttgttgatagtgtttggttcactcagagaaagatagagagagagagagagagagagagagagagagaatatgagggaagaggcctgacattttcttgagaactgaaacctttcttttaagatggcttgcctttatcaccatccgaaattctaagcactggatatttgtaccagactctaaggtaggacagcacaaatcctttgttaacatgacttggtccttaactcttaatatccctatttcttccctgagggagagtttggctgggaaggacgcaagtatcattatttttcttctgctggccaaagttgtctctttgtgcattctcagctttcaaaagaaattgagctgaatccacttttaaactctaagggattcgttatcagaaaagaaaaaaaaaaagagagagagagatttgagttggctttgaaggaagtggagactaggaggtccaaggttgaactccttgctcttaaaagcaaaaactagagtgagtcttaggattgcagtgggctctgtgcaccagtatccatagcccttggagaggaatgcccacagtcttttgttgagatgatcacctatctcttcagaatctccaatctagaatttcccatttcactttttagtaagaatataaagttggatactgggtattcagattcctgtttctgctctctctgtaccctgaggcctccaaatacgtataaagaaagaggcaatgtggcagtataacagctaagataggagtggtaacatgcctgtgggatcctcagaacagccaccactgggaaattcaaatgatcataggcaatttctaaggaggtcaaggttgcaggcttaagtcttacatgaatcatttagctctagtacattcaccagccataagctatacacataatgatgatcattgctaccaagaatttatttatttctcatttttgatctgtcatgtacaatatgatctaaatgtaatagaccatttgattcaatattaaatgcctattaaagagatggtcagtttttaagttttaataactaatttgaagcttcttcatcaatcttctctcaattgccttttatattttaaatgatcgtttttgaaaggctttgtcattgaatatattgtaacgtgtgaaaaaaaaagtgtttatactaaatgtgacttatcctcaaaggtccacagaaaagaacatctgtcattgttaaagatcatgcagcctttttcctctgcctggggaaaagttcaaagttgacagtgagttcacttgaagagatgtaatatgaagtcagagcgaaggtaagttgacaggaccaggacaagcaagataaggtttaccaaggagtcttggcccctttcatctgttccatgatctcacctgaaacaaaatccttgttctgctttatcttcctatgtatccaggagatttaagtagtaactgaagctgtctgtagagtaagtacagtagacataacaccacacctcgttttccttttcatgccggggaagccatgttcccgtgttgagactacctttagtggggactttctattcctttccagaacaccatttacaagggaagagggagcagaattattcctctttacagtgcttggaggagattcagaaggtgatcttgttcggactataccttccttaagtattatttccctgaagaaatgctgcagagtctattctgtggcattcttggaccacaggattggaagcacttgattgggaataagacagcacatttctaagatctctttactatattttggcttttttactcactataaaacatttacctagagggctttctattaaatttagtccagcccattctctgacaggtaagtccaggcatcaaaaagtgtgtattttctaaatattgaagtaccattcagcctgtgaaaaataaagcaaatttgtactgatgtggaaagatgttccagtgcatattaagcaccaagaaatgaattagatttgaaagcattcataatattatccttttttaaaagtgggagttggtagatggatgagcagacacattagggcgacttgctgcagcctctggggataagcagtgtatgcagaaactttgatagtcaatttctttattaagaaggactgtggcccggtgcggtggctcacacctgtaattccagcactttgggaggccaaggcgggcggattgcttgagtccaagagttcaagagcagcctgggcaacatgttgaaaccacatctctactaaaaatataaaatattagccaggtgtgatggtgtgcacctgtattcccagctactccggaggctaaggtgggaggatcatcagagcttaggaggttgagggtgcagtgagccgagatgtagcctccagcctggggcaaccaaagtgagatcacatctcaaaaaaaaaaaaaaaaaaaagacttttaggaaagagaacattctgattatttacttttaagtagtttgacttaaaaaccatattaacagggtttatttgaaccctggaagatagtggaccatttttattttcttctttgtactttttgtatttaaaaaaaaattcctcaaactagtggtggtgtttttttttttttttttttttttgagacagactcttgctctgtcccccaggctggagtgcggtggtgcgatctcggcttactgcaatctccgcttcctgggttgaagcaattcccctgcctcagccccctgagtagctaggattacaggcactcaccacgatgcccggctaatttttgtatttttaatagagacggggtttcaccatgttggtcaggctggtctcgaactcctgacctcaggtgatctgcctgcctcggcctcccaaagttctgggattacaggcatgagccaccacgcctggtccccgtgttatttttaaaaggtatccttgctgtaatttttctttatattaaggattctattttagacttttatatatactattctaattcatccattaaaaatttaggcctatatcgaaacctgtaaatctcttaaataattattcaaccagaaaaaaaagttaaatgcaattaaactttgccatatgtgtatgatatgcctaaactaaatggtaataaaaccatccctggttttcattagttagatatgtgtactctcagggataaaagaaagaaataagatcattttgcagcctttctttgaatccagggcagccatccaagaggccaaaaacgtaacgcctggaaaaaataaattccttttaatcttgtggattaatcaggtagtgcaaattttttttttttttttttttttttttttttttgagatggagtttcactgttgttgcccaggctggagtgcaatggcaggatctcagctcactgcaacctccgcctcccaggttcatgcgattctcctgcctcagcttcctgagtagctgagattacaggaagtagccaccatgcctggctaatttttgtatttttagtagaagcgaggtttcactatgttagccaggttgttctcgaactcctgacctcaggtgatcctcctgagttggcctcccaaagtgctgggattacaggtgtgagccactgcacccggccaggtcctgcaaattctgatgcaaacttataaaccacccaccttgatttacattaggaatataactgtatttaccttcccaacattacataaatactatgatgagaaatcaaaattaaagtgctcaaaattgaaagaaaaaatgtagttttgaaataggaaaaccatataaaaatgaaatttagattgcattttctattagaaaaatgtaaatatgtaaatgattacttaggatgctaaaatatgcttttattcacttatatgcaaacaaacctaaacaacatatctaatatgtaaataataaaaccaaaattatcttctttatttcaattggcaacttttttctccttaagtgcatattttatataaacacttcttatttgtttagaaataaaaactgcatgtaaaattcttttattcatttttatagactgcaaatatgccatagccttctgtgagctcgataaatatcaggtgataatttggttcatttaaaaaaaaaacaaatattttacagcttttgtcagattttattgctttaggccaaaggtcaatccaaggcccagggcaaagtataggtagtgtgttttttgagtaggtatacattggaaggagttgctgaaaaggattatatgtcatatttcagaggtacttccataaaagggatgataaccaagctggcctgatgagccacaattgaagttgttccgttttataaaagagtacaccatttcccacagtaggactcctcaaatgaccttcaccaaggcagaggcatattgtgctgaggcttttcagggattaattaaggggctgtgaatagtgtaggctagacataattgtatgtgttttgtgtgcttgtaaagttacctgttatgcatccccttaccttgctcatataattaaaagtagactccaaagaccaaaatttaaagcagcccctgttcactaatcgccccatggacttttgcagagatagttccgttttgggaatgaatttgtaagtggagtttagaccacaaacactcaaaataatgctttcatctgctccactggttgaagttgcccccagcggtgttgcttctcctctgtacatttcctcaattgactttcaggttacctctctgtgcgagctctgggggtgccagagaaaggcagagaaaaagagagacctaagtgcttgaggcagaacatcgacagctaccagtacgtgttctcagctgcaggtttactcagctgttccaaaggacagagaggcagggcagccgcagggtctgctctagactattctttccctttgagaaaatgccctctgaaatttcacgtggctatatgcaatatctatatttggtctagagtattataaaaacgaactagtcctacattgtacaaaaaagctaatttaataattgagagtaatttttgtttaaatatactatgttgaatcatgcatctagacatttgagcttaagttttgagactcagtatgtactgcaagactgaagaaatgtatcacatctgtgctccaacgatccctgtgtctgcagagtgcttcgtggtttaggaagtgctttcacaagcacatttttggatacttacaaaagatgtgaggtttacagaggcgttattgagatttttcagttgagaacactaacacccaggatggaatagtgggataaaaacacagctatcagtgtcaagagacatggatactgcccctggttttacccatggccttttctggatatatatatttttttctctgggcctaattttcttcatgtggaacatgagaaaatggacaaaatagctataaaattttgagcatcctgaagtgatgaccttagacatgaatcaaagactcttgaatctcattatttccatgatcccctcaagttccacgggaccctcattaccacttgtaaattcagtatctactataatgaagaaattcgtatatgtaactgtaaatcaaaactggtataataaagcctttcaaaaagcatataaacaatgtataaatatgaatacactcctattttgttaatatatacatgcatttatattatatataattatattttttacttggtaaacatttcaaattagaatattctctaattttgaaatgttaataataatccatttattgattattgttgatgttgatatcattgaaaattttacaaaatctttttatattcccaataaagaatcctatctttctcaacattatgaacatttatcttacagttacataatgtttagaattaatgtatttatctcaaaacacttgagggtttttttaatgaaagatgcattatataacttgcctcatatcatgtatcatgcatttggtatttaacttagcgaactgtttgttatcatggaatggcggccactgtttctctttttatgcaatccattagaacattggattagcactaaattattctgtattaattgtgaatataagactgttagattagttctgaattgttctgtgttacttgtggatacacacacatattttaatacagaacatatatttcttctgaatccatttctctctcctacttgaccgtagtaaacatactctgcactccagtgtcagtgccaggttatttttgttctctaagattttaattgcattcattattttgggctcagtactggttaggaatagtcttcaaagattaaagctgtttatgtggatatgaaaaatcatttggtgatctgccgaaaccctcctgttcataagaggaagcttttctgtcaaaagaaagaatcagacacataaaacagattttctcaattgatatcacagctctatagagtcattaggctaaagcacctgcaccttgaaatgctttgattgcccagtgtgctgtgaggacctgggctgtcaccttgaatgctgatattcccttcctctgagttaaagtaacatcctagatttatcaccatattggaaattcatttaccaagttgattcagtttgttttccccactcagtgttgtcctagtcagcagatgggccccttatttattagaatggtgcggtcactgaattgtatccaccaagctctgctacttttgcagtggaaatgttagcagttttatttaccaatgcaaatatttaccgagaagctaccaaataaaagttattttggattttttttaaatgtctaattgtttatgcaatcatctactcaagaaacatttactgagcacctatttttacatgattctatcttgtttgtggcaaggaatacaaaggtaaataagaggaaacagcctggtctaatggagatgagggcactggagtactaaagacatgggttacaatttttccttagtcatttattaaccatctggcattatcttctactctgtcttccctgtacttgtgtgtgtgtgtgtgtaaagtgggaagaatatatctttatcaggttatagtgtgaattagaaattaaacatatatagtattcaataaaagcatagtggcagaataaacagttcttctcagcatcatggtagtatcaataagacccggactgtgtcctcaaaggagtgtacattttgttggtgtaatttatgagatgcctaacataaaaactctccaacttattcattacatagactgatacttcattttatctccccccaccatgccccccgccagcatattttctggctcatttgtccctttagttctcttctgtgtcatccagagtccagtcaggaaacaggaatcttagcagttatttcaattgaaaaaggttaacatagggaatcgattataccggggttggaaagctacaaagccaaaaagagacctgtgagccaacagcaatcctaaggatgggggaacaaattaaaagacattcgcgttatcagattccaaaagctcgaagaaaagacccccaaaacttaggctgagacctccacccagctggggctgataactcacaggctgcaggagggtcccagtacagccatccttctcaagctgctatctctaaggtacaatgagaattgcaccgacagtgccaaaaacagtagaagatagaagatgaggctgactgctgctgctggagggaagagctatggccggggcttctctgacagtaatgatgggtgaaaaaggaaggagtaggtcttctcctgcctgccagtttcataccagtgtcctatggcagaatctaacagggagccagctgtgaagaggaggtgtagcttcatggtcccaggtgcagcatcacagagccaggaatagaaagggattggggcttacttactaactagcacaggtctgttttagcagggtgactttatgtccagatttgcaggattacaatttaccctcaaagactggagaactcactggctcctttcatttcgtctactatgatatgttcacttttgaagagaccccaatccacatgaatgttgaaagtaaacatttgtagttatatactcaaattatcttttgaaaagaatggatctgacttttcctacttactatgtcaccattgaagactaccttctcaaaagacttctgttgttactttaaaattcttaaaagacaaatcttcatgtaattctgttggtatcaacaagggaaacacctaatgtgggaaattaacttgtcattcttctccagttaaaatggttagaaatatgaccattaccattaggaaattgtatatgaggttaaacatttattaaatgcaaacacttttccaataaatttaaaataagagatatttctcgttttttttctggtttcaactgaaatagaagatgacatagcctctgtaagaagatgtagaagatgaattttggtatttacaagtttgcatgttgttgaataaaggtttatattaggtttcataattaattctaatattcaaatatctgtttgtagagcattttaattagtttaacaaatgtttactggggtcttataagtgccaggcactgaggaatcaaagttaacaagaccgccaaggtctcagcatgcagggagcacatattctagtggagacaagtagaaaaacagcaattaaacacagaaacaatgtaaaagtgcacaaagggaaaaaaactgagttattttggggagtgtgtttgtataagtagccatgaaagtcttcttgaacagatgctatttaagatgagaactgaaggctgaaaaggaaggaggaggaggtacctatgtgaaatacagaggaaataggaaagacaccattccttaagcagaatacaacttggcattttcaagataccgccatagaagctactggagccaatgcacagggagaggagagagaatgagtttgaagggattggaggggccagaccgtgaaggaccttgtagggcccagtaaacagttgggattttattccaaccaaaatgggaaaccatggaatgttttaaatctgggagtcatgaaagctgatttatagttttaaaagtcactctgttgactgcagagaatggattttagaggttagaatagaaacagagagagtatgaggagaagaaagccaggatctagggaagagataaagatggtggtttgagatacacttcagaagtgaatcttgaaggactagcgagtaacttggacatgagcatgggtaggaaaatgggagtggggaaaggatttacgaatgcttcctatggattagaataagcaactgggtagatgttgatgtcattatgaatctggtagaaacaaagagaggaatagatacctgaaagagtggaagaaaagtgaatcttattttagacacataggatgtttgagacatctgtgaaatattcaagtgcaaatattaaatagacagttgaatatccaagtttggaaattacagcaggaggcaaggccagtgataggaattagtaagttatttatttttgttttcgtttttttaaaaatcatcaaccatgtatctggatatgttcacttgcagagagaatctgcatagtaaagagaacatccagcattgtaaagactggaatagtaggagtgacaaataaattcagcagagaggtcagaaggaaagcaggagtcaagtcctgtgaaaaccaggagagacgattggtgcatgaataaaggagccaagtgtatcttgtgggagccaatcgaacttgcagagaagtccaagtagatcaagagacagaagtgtccattagatttggccacatggagatttccattgaccttgacatgaacagttccacattatatgaagttttatgagcctatatatattcagtttttatgagcctcaggtggttgataggaaggaataataatcacgacaacttttgtcaagtctgaggaagaactgtctgctgacttatcacattttcaattaggggataatatttgatgtaagtggctctgaaaggttttctgtctcctctctgattggaatccataacttgaaattgatccagtgtggtaacaagaatgctattctcctgtttgatctcttaggctttttcactgtagggcattcgctgaaaatgatgaccaagaattgtttaagtgcaaccaggctgggaaagccagtagtaaccaccgtaggacagacaagaggtacttcatctgaataaccataagaatgatagagcaatgtttttttcactcaatgtcaatttaaattacttgaactaaaaagtgaaatatagtttacttattcgaggatactctatagcagacaatctaatgtctgtggatgttattgaattacttccttatcggagggcaagctgaatttgtctgcagttattttcgtttataagagtacagcatttattttttcttaactgtgctcgactttttgttttgatggcaaaaagcattacttggaatgctgaattttaagtatagaattgtgcccttcatattctcacatacataactttgctttaccacatagagacctgatatgtatacatagctttaatatatatcttgtgtattcagctttaccaaatttgtgaacttttcttattttaaatctggttttaaaatttttgaaggggcattctagtgttgctttctcccaacaaaccccagactgatgccttaaaaatttgtctcaagttacatatagaccacactttctcaacattttctcttagatatctcagatctaagatgtctggaacaagctcacactctttcttccataagccccctcctcttccattgtttcttatcacaatgtatagtatcaatgaggaggtgaagccaaaaatctcgattttatactctcccttgctaccataagcaattcattatcacagtctgtccgtgttactctcgcatctccttctctgtattcattgacttgacccctgctgagcccaaactaccatcactattcacctagactgttgcgatatccttctaaatggtctctatgtatttctttcaacccatttcctagaccgcagtcagaatgccgttttcaaaatccaaatcaagcatatcattcctccacttagtactcttcaatgaccggccattgcctttgggatcatgaccaaaattcttaacccagtctaccaagcttgcatgatctggctcctgcagttctctcctggctcaccttgtagcactctgtccccactctctctctccattactctgctccagacatactggccttcctttctggactatgccaagccccttcaccctcagcgcctttgtgcctgctgtcccatctgctaaggatgctcttcctctccgttctttctcacctagttaatgcttatttctacttttgactcctactcaaatgacatttcctcatgaagtcttccccaagccccgggttcagccctatccctttgtagcactggctgctttctttcacagcacatatagctgtagatttttattcctgcactgggatatgggctatgaaggatattttattaacatttgtttctaattgtacactaccaattccatggggacctggatgatgcctgctttacttgacctttgtattcccagtgcgtattgccagtagcgtaagagtgttcactaagcatttattgctggatgaatgaatgaatgaatgaatggtgtcgagaggactgcggagaaacataaggctgactctgcatcttattaccaagactggaaaaaacaatttaaagttcatatcctactgtgttaatagaactttctgtgtatgcaaaggtcagtacattttaagattaaagttgattttctatgaacttactatatatagattgaggtgtaattaataatgtcaggctatggggctctatggacaagtaattattttcagatatgttctacagcatttattattgttaccatcgataactgtaatagctagcattagtagcttgcaaaacccactcataaacctgatttcatttactttaaatggatttagtgtaaaattcaattggaaacagtgcttaagatatagatttgaggtaaatttaactttactataaatatactgaacaaaagtctaatttttttccctgtgtttttaaagtttcaatttttctataatttctcaacatggatttgtcttgataattttgcagcacaggtctggtttgggaagatcattgcttttctatttgtagctgaagtctctgccagaaaaaagtattcatcatgtgtgtaacatggtatgattggcagttatataattgatcagagagagactttttttgtctcatcactggatttcataagttgatggaaccttaatggttgtgtagctgctacccatatttcattagtgcatactacattatggacacacagtaaatattaactgtgttaattcaaatgtaatttataatttaggaagtaaattgatttctgtgtctttctgacaaatcctttcatttctttgaagtattgtttattttagtttgatgtataaatacagccacataaacaagaaaaggtaactctgtcaccttatgttttaataactttgaaataatgagacatttataagtatgctgagattttcctccaagttaatttttcattgtgatttgttttaaatctttctactaaaaactatcatattcagattttgtatgatgcaagaatgtgataatataaatcgggacagatttttctggagtaaaattcaactgtatatattgaaatatataacagttgtatacagtgaatatatattgaaatgtaacagttaatttaacattatttatgatatcttttaacattcttcctaacatacatttcctcttttagaaatttacctaaagtaaatcgttagagaaggggcccttgtagaattataaaaaaagttatgaaatacaataacttaatactattttatcctataaagatttcttatttgtataaatatacttctgatgagattttgattttgaagaaattaagtcatttttccctttgtatcccaaatcaacttgatgaagcccttacttattaacattttaatttgagaaatcccagcacaatcttactattaaaataataagagatagtaattttgattgtcattgtgacctttttaaacaggagctaaagcacaccaattggatagtttatgcaaattgtaatgttttcttttaagaaagtgcttaaaattatgtttcaaaggtttttatactcactttaatcttagcatagatgatgttgagttctgcattaacgaggaaagtatcaccttaattatgtaatagggtaacataacatcattagataaaggcaaaaataggcatggcattgccgctaatgtgtttaagtttaaaataataatttagatgtctttgtgtgtttccttagaagttgctctgaggagatagtatgctctgcttcttggccagcttctggggaggactggctctcacattaagtatattaggtaacagtacaaagcaccaggacacatctatataattgcagagaccttacttgctgggttggaatctcacttggggccctgtttgttgatatatttgcaacaaaaagccattaacttacagggtcaagggttaatggaagaaatattcttgtcttcctattatcttgcaacgttttgctgggagctgaagaaagataacgcttttctctcccagtttctcctggcagttttaaaaatggtgacttcttgtttctgtgactaaataaaagattagatgccaatatggaaagctttagaattgtactcagtcaagctgacagttcagacaagtgttccatcacgaccacctttgctgaggtcactggatggtcccagtcacagaaactaggaggaaggcacctaaataatttcttgatttctatgacttcagttttttttttttcctgctccattttaggtaagttagtcatcttgcacaagaaggcgagaaaatttcataaaactttaaaggagagaacaaaaactactgctaagtccaaaaggaattctatgtctaaaagagagaatttagctaatcagattggtgcccctcaaattccaattattttagagtgtataaagagagtgaaataaatccttgtcccaaagaaattcttattcattaaaactatgttgatgattttaaatggaattatggattaaattagtttgcccagattttatgggtgaaaatcattgcctaccaaaggttatttctgtcatttttaaaaatacattacatagactaactgtttcattataacgtatctgatgagagtaggttgcccaatgcaatttaagagtcagtggaaggtcttttcttatatgtaagcgttccactgggaaattttttccggaaattccaccaattaggggattctccaggttaattaaaataagtcctttcaggttataataaaaatatcgctgagtactttagggaacttgtgaactcctttctgtttgaaggccggaatacctttataatttcatccggaggttagtcgtagccatgggtatagttaccactccagaattgtcttgaattgaaaaaatctcagcctatttaattgtagtgctctgccaacaaacacaggttgtgctggtttgatttgacacagcttggatggtgggtttgactaattttcctaattaaatctgccacaacagtcaatgcatgtggacacatatggttacagtcctccatttcacccataatttagcttgacaacacacatgtgagttttctctttactcaatgtttatacaaagggactttttagcacataattttctaattttcctgaaattctaacttcaaaataatacaagggagaaaatggaatcacaagtctgcttaatttaaaatgaagctggtggaaaacttttccctaattgggatatttgttttcttcccaaattagttgagatcatgctttatagcaggttagccagcatggctgataggctgataagccgtttcccctgcgcccctcagcagtgacagcgtgcttctctacagaaaagctactctgtgtctttgcaaaatgacccaagcctcagtcccttaagtccgtggaccataatcattagaccaatttgtccacttagcatctcatgtagtcaaagggcagattttgtatattcatttgtgcagactttgtatattcatacacctgttaaagatttcagcgttaatgtttttccccagagatttttttaagaccttcttctgtaatctgtttattttacatattctcacaccaggagttttttatacagtaatagctacaatggcaatatatattgaccttctgctaaggcatgtttctaaaatatctctcatcagaaaaaccaagcatatttggagtttccagggagagttttatgtatgctcaccagtaacctagtcaactgtgcagactgctgctatatggtggttactgttttggcttcatctgtggtgctagggtgactgaacttgatgatctctaatagccattccaactggacacctctactgttctatgaaaaaggaaagtgaaaggcaaaagcagaaatgcaggcaattgattaacaccgagcatcactgtactttcctttcacggcttccagtcctatttttctgattgttttcgttttgactttccaaaagatgaaattgtagaaacctctctcttaagtttcatccagaaaaggtacagggggtcaatatcagtgactttgaggacttcaacataattaattctagaaacatcaggaacatagcagaatttaattatatatgtctttatcaaattacagaacttgagtgtggctggcaagggcatctcggcccatcatcaaatgtgatgtcgcatgtgctgaactgagtggtgtgcctgcagaagaagcctgagacagcatgcctgagtttctttttaatgcatgatcatatgagcacctgctctactgtgcaaactgtttctaaccatagaaggcaggaatctagttcactagtgggagaattctgaggtaaaaattggagtgaagaaacttggatatggttttcacatgcttctgaacatctttacattaattgagtttttcttttatggctaaacgcttttattaaaggaagacttaaagatctagaatgacttgtcattgttaaattttcccttctgctatatagtttcagaaggaagttcagaagcattaaaactgtccctcttcttagcacacactgttgatacatgtgcttacacattcagtcacacatacgcaattatttcttttaatttagacatatctagtgtacatgctgagtgtgcctataagtgttaattataacaatatttttgaaataaaaatatataatatgcataccttctatgaagtaaataatgatgaggcaaaataataattgttccatctgatatcttcgtaaatttgtattacaaatgattatctctcgtgtgtctctgtctttggatctcatttctttgtatttctcttaacaagcacacacatacacacatacacacacacacacacacacacacacatccttggtgatttcaaaagaaataattggttttacagtttgtatctgcaaaagatttttttttcagttagaatatctcatttttaatgatagtattagagatatgcctaccattggcattctactatgattcaattttttattagtcatctttcacccgttgcttaacgtcaatggctctttcattcttagaccctgagttgaaatgaatttttacatatactcaatatggtttggggcccaccagttcccactacagtggtgctccccatcactcacatacaattttatttaagacaaaacagcagctccagcagaaaataagtgtaatcttctcctttgtaagttgtaattgaggttatggcacagcatattgcctgtggcagaatctattaccaagaagtggagaccatgatttgaagctggctgcagtgtaagcaaaatgaattaattatcagcagtacagaattgaagggaaatacagggtttcctaaagtgaaatatattggcatttttaaatagagaacactcactgcaaggaacttattgatgaatcaccaagtcttttctacttttcttgcctttcagaatttgtatatactcaggttaagatgactatgtgtaaattaaatcacactttgctcagaatgcatagaaatattttatagtatattttgttctttttcttagttgttgaaatggagtctcactctgttgcccaggctggagttcaatggtgcaatctcggctcactgcaacctctgcctcctgggttcaagtgattctccagcctcagcctcccgagtagctgggattacaggtgtgcaccaccacacctggctaatttttatatttttagtagagacggggtttcactacattgaccaggctggtctggaacccctgacctcaggcgattcacccaccttggcctcccaaagtgctgggattacaggcgtgagccacggcacctggcctgttctttattaatttaaagtttgcctatttttaacatataactgttactgtcacttggacaggtaaatgggcaaataatgaatggactaaattagcttcagtattattctttaatagaaaaataactctctccttatcaagtgtggctcaaagaaggcaaaatggaacgttttttgagagtttataaacatttataattttacgtcataagttgtgaactttagtgaccataacttttgttggtaattatttagcaaaattgagtatcttcatagcagcaagataattagcttatttgtatttctttatgtgtggttttccatttaatttaaatttcattcagttgactaacaatgatttttcacttttaaatatcaccattcaaaaaccaaatacaattacattttgccaaatttatttttaatttttttttctaggaataggtcgttatttggctgtttttatttttctgtttttagataattgtttcatataattgtaatgaaactgtttgcttttaagcttcatttagattcttttgtgaaaggatgctctgtctctactgggtattttctagcagttgtgcacattgacttttctttaagttgtagaggatctgagcagatggttttctcagcatctagacaaatagcatacatggttcaaggtcactccatgcaacctgcctatgataaattgggaatccagaatttgtctcatttacaaatgtccaacaacataggtccatggaaaacagtgaagtgccaaagaaaaagatcagcctcctgggaaggaggagacccatggaaaatccccctagtttcagaggctttcatgtgagagggctgtactgacctgtggtggggtcttctgatagtgcttctcccttctacctgccgttcagatgctctgaactgatgacctccatggaaactacaattaccaggaaagcctcctgttgccgtggtcactagtgactgtgcccatgctaatctttcccaatttcctttccagttgttttctagggatttctgtctttgatagaatgtaagagaagagatgaagaggtgtccaggtgtgtgtgtgtgtgtgcttttgtgtgtgtgtgtgtgagagagagagagagagagacagagagagagaaatgttgatgatgggtagtgaggtaaattctggtgcctcaacaatgagtttctacacagaaaaccacagttattaagttgatgtctgtggagctctatgaagtctttatgtgagcttcagtgggtccgtggatcctctaatattttgtgtgcatgcatatatgcctttttaggggagagagttcattgcttctaccagattctcaaagggaaatatgaaatttctcccaagaaaatcctacctcctgtggtataatggttgcccaaaatgttggttgctggatgctttctacttccttaaggaaaagttaagacgttttgtacctactttcaggcagtcctggcatgtatgggccatggattgaacattagaattcagtttaattgatcttacatttagagaaatttttccctagcctctggcaatgatttggctgttatcctttttacttattttcttttttacctctatttttccccagttttgtatttaggaccaggagaagacagttctatgagtaaccagctagacaccatattaaaagtagtctgttcatattaaatattgatcacatgaatgattgtaataatcatacatgcttaaagctgtatgtgcattaaccaaacctgtgtaaaaatttagcgaagctctgaaaggttaaagaatttgccaaaaaagacacagctggggagtaacagagccagggttcaaatctaggtctctgattttaaactccatgttctcaacactatgctattatgccagccatagtgggtgaacaaagcccaccagttttcacactctatccatacgtctaacaagactcatcttccgaacatttttttttcctctcctggcttttaagagcaatggcttagctagaaaaaagtgaaccctagcaagtgtttgctacccagttcacaaaggtaagaatttcaggttgtctgttaggtttaggttttcatagatagtcagatcctgaccactttctcttgtgtgacctcagacacataatctggcatctctttgcttctgttcctttgtgtctaaagtggggtcattgtgaagattcgatgagtttatacagataaagcattaaaaatagtgcctggtacatagtaagcactcactaaaagatagctgtcattattagttataacttagttggaaggtcttatttcctgagggcatctggtacgtctttggataaatgtggccatgaaaatgacagtgactcgaagagggccgaataggatcagctcagatctggagctcccagtgagaccaatgtagaaggcaggtgatttctgcatttccaactgaggtacccggttgatctcactgggactggttagacagtgggtgcagcccatggagggcgaccagaagcagggtggggcgttgcctcactgaagaagcacaaggggttggggaactctctcctctagccaagggaagtcttgagggacggtgctatccagcccagatactatgcttttcccatagtcttcacaacccacagaccaggagattacctcaggtgcctataccaccagggccctgggtttcaagccctaaactgggcggctgtttgggcacacatcaagctagctgcaggaattttctttttgtaccccactggcacctggaatgccagtgagactgaaccattcactcccctggaaagggggctgaagccagggagccaagtggtcttgctcagtggatcccacccccacggagaccagcaagctaatatccactggcttgaaattcttgctgccagcacaatagtctgaagttgacctgggatgctcgagcttggtgggggaggggcatccatcattactgaggcttgagtaggcggttttccccttcacactgtaaacaaagctgctgggaagttcgaactgggcagggcccaccgcagcactgcatagctgctgtagccagactgcctctctagatttctcctctctgggcagggcatctctgaaataaaggcagcagccccagccaggggcttatagataaaactctcatctccctgggacagagcacctgggagaaggagtggctgtaggcacagctttagcagacttaaacgttccttcctgcctgctctgaagagagtagcagatctcccagcacagtgctggagctctgccaagggacagactgcctcctcaagtgtgtccctgtcccctgtgcctcccaacggggagacacctcccagcaggggttgacagacacctcacacaggagagctctggctggcgtctagcaggtgcccctctgggacaaagcttccagaggaaggagcaggcagcaatctttactgttctgcagcctctgctggtaatatccaggcaaagaaggcctggagtctaacccaaaaaactccagaagacctacagaagaggggcctgactgttagaaggaaactaacaaacagaaagcaatatcatcaacatcaacaaaaaggatgaccatgcaaaaactccatccaaaggtcaccaacagcaaaggccaaaggtagataaacccacgaagatgaggaaaaacgagtgccaaaaggtgaaaattccaaaaaccacaatgcctcttctcctccaaaggatcagaactccttgccaataagggaacaaagctggatggaaaatgaatttgacaaattgacagaagtaggcttcagaaggtgagtaataacaaattcctctgagctaaaggagcatgtcctaacccaatggaaggaagctaagaaccttgataaaaggttagaggaacggctaagtagaataaccagtgtagagaagaacataaatgacctgatggagatgaaaaacacagcacaagaactttgtgaagcatacacaagtatcaatagctgaatcaataaagcagaagaaaggatatcagagattgaagatcaacttaatgaaataaagtgtgaagacaagattagagaaaaaaacaatgagaaaaaatgaacaaatcctctaagaaatatggaactatctgaaaagaccaaacctacgattgattggtgtacctgaaagtgatggggagaatggaaccaagttggaaaacacacttcaggatattatccaggagaacttccccaaccgagcaagacaggccaacattcaaattcaggaaatacagagaacattgcaaagatactcctcaagaagagtaacataattgtcagattcaccaaggttgaaatgaaggaaaaaatgttaagggcagccagagagaaaggtcgggttacccacaaagggaagcccatcagactaacagtggatctctcagcagaaactctacaatacagaagagagtgggggttgatattcaaaatttttaaagaaaataattttcaacccagaattttatatccagccaaactaagcttcataagtgaagaagaaataaaatcctttacagacaagcacatgctgagggattttgtcaccaccagacctgccttacaagagctcctgaaggaagcactaaatatggaaaggaaaaaccagtaccagccactgcaaaaacaacccaaaatgtaaagactattgacactatgaagaaactgcataaactaatgggcaaaataaccagctagcatgataatgacaggatcaaattcacacataacaatattaatcttaaatgtaaacaggctaaatgccccaattaaaagatataaactagcaaattggataaagagtcaagacccatcattgtgctatattcaggagacccatctcatgtgcaaagacacacataggctcaaaataaagggatggagcaagatttaccaagaaaatggaaagaaaaaaaaaaaagcaggggttgtaatcccagtttctgataaaagagactttaaaccagcaaagatcaaaaaagacaaagaagggcattacataatggtaaagggatcaatgcaacaagaagagctaactatcctaaatatatatgcacccaatacaggagcacccagattcataaagcaagttcttagagacctacaaagagacttagactcctacacaataatagtgggagactttaacaccccactgtcaatattagatcaacgagacagaaaattaacaaggatattcaggacttgaactcagctctggaccaagtggacctaatagacatctacagaattctccaccccaaatcaacagaatatacattcttctcagtaccacatagcacttattctaaaatcaaccgcataattggaagtaaaacactcctcagcaaaggcaaaagaacagaaattataacaaacagtttctcagaccacagtgcaatcaaattagaattcaggattaagaaactcactcaaaaccacacaattacatggaaactgaacaatctgcttctgaatgactactgggtaaataacgaaattaaggcagaaataaataagttctttgaaaccaatgagaacaaagatacagcataccagaatctctgggacacagctaaaacagtgtttagagggaaatttatagcactaaatgcccacaagagaaagcaggaaacacctaaaattgacaccctaacatcacaattaaaagaactagagaagcaagagcaaacaaattcaaaagctagcagaagacaagaaataaccaagatcagagcagaaatgaaggagaaagagacacaaaaaaactcttcaaaaaaatcaatgaatccaggagctcatttttttgaaaagattaacaaaatagactgctagccagactaaaaaagaagaaaagagagaagaatcaaatagacacaatgaaaaacaataaaggggatatcaccagtgatcccacagaaatacgaactaccattagagaatagtataaacacctctatgcaaataaactagaaaatctagaagaaatggataaattcctggacacatacactgcccccgcaagattaaaccaggaagaatttgaatccctgaatagaccaatatgaagttctgaaattgaggcaataattaatagcctaccaaccaaaaaaaggcccaggaccagacagattcacagctgaattctaccagaggtacaaagaggagccggtaccattccttctgaaactattccaaacaatagaaaaagaaagtctcctccctaagtcattgtataaggccagcatcatcctgataccaaaacctggcagagacacaacaacgacaaaataatttcaggccaatatccctgatgaactttgatgcgaaaatcctcaataaaatactggcaaaccaaatccaacagcatatcaaaaaacttatccaccatgatcaagtcggcttcatccctgggatgcaaggctggttcaacatatgaaaatcaataaacgtaatccatcacataaacagaaccattgacaaaaaccacatgattatctcaatagatacaggaaaagcctttgataaaattcaacaccccttcatgctaaaaactctcaataaactagatattgatggaatgtatctcaaaataataagagctatttatgaaaaacccacagccaatatcatactgaatgaacaaaagctggaagcattcccttcgaaaactggcacaagacaaggatgccctctctcaccactcctattcaacatagtattggaagttctggccagggcagtgagacaagagaaagaaatgaagggtattcaaataggaagagaggaagtcaaattatctctgtttgcagatgacatgattgtatatttagaaaaccccatcgtcagcccaaaaactccttaagctgataaggaacttcagcaaagtctcaggatacaaaatcaacatgaaaaaatcacaggcattcctatacaccaatagtagacaaacagagagccaattcacgagcaaactcccattcacaattgctacgaagagaataaaatacctagaaatacaacttacaagggatgtgaaggacctcttcaaggagaactacaaaccactgctcaaggaaataagagaggacacaaacaaatggaaaaacatttcatgctcatggataggaagaatcaatatcatgaaaatggccatactgcccaaagtaatttatagattcaatgctattcccatgaagctaccattggctttcttcacagaattagaaaaactactttaaatttcatatggaaacaaaaaagagcccatatagccaagtcaatcctaagcaaaaagaacgaagctggtggcatcacattacctgacttcaaagtatactacaaggctaccgtaaccaaaacagcatggtactggtaccaaaacagatatatagaccaatgaaacagaacataggcctcagaaataacaccacacatctacaaccacctgatctttcacaaacctcacaaaaacaagcaatggggaaaggattccctatttaataaatggtgttgggaaaactggctagctgtatgcagaaaactgaaactggaccccttccttacaccttttacaaaatcaactcaagatggattaaagatttaaatgtaaaccataaaaagccctagaggaaaacctaggcaatatcattcaggacataggcatgggcaaagacttcatgactaaagcaccaaaagcaatggcaacaaaagccaaaattgacaaatgggatctaattgaactaaagagcttctgcacagcaaaagaaactattatcagagtgaccaggcaacctacagaataggagaaaagttttgcaatccatccatctgacaaagggctaatatccagagtctacaaggaacttaaacaaatttacaagaaaaaaaacaaccccatcaaaaagtgggcaaaggatatgaatggacacttctcaaaagaagacatttgtgtggccaacgagcatatgaaaaaaagctcatcatcactggtcattagagaaatgcaaatcaaaaccacaatgagataccatcttgcgccagttagaatggcgatcattaaaaagtcaggaaacaacagatgctggagaggacgtggagacataggaacgctttacactgttcgtgggagtgtaagttacttcaaccattgtggaagacagtgtggtgattcctcaaggatctagaaccagaaataccatttgacccagccatcccattactgggtatatacccaaaggattgtaaatcattctactataaagacacatgcacacatatgtttattgcagcactattcacaattgcaaaggcttggaacccacccaaatgttcatcaatgttggactggataaagaaaatgtggtacatatacaccatggaatactatgcagccataaaaaagaatgagttcatgtggggacatgggtgaagctggaacccatcattctcagcaaactaacacaggaagagaaaaccaaacaccacatgttctcactcatgagtgggaattgaacaatggtaacatatgggcacagtgaggggaacatcacacaccagggcctgttgggaggtagggggcaaggggaggaatagcattaggagaaatacctaatgtaggtgacgggatgctaggtgcagcaaaccaccatgggacatgtatacctatgtaacaaacctgcacgttctgcacatgtatcccagaacttaaagtataataataaataaataaatataaaattacagtgattcactaataatcatattctgtgtctgaaattccttttcccctcctttatctttctgcacccctacagagataggaaaaaccaaagtgttttttctccgctcaaacatcactcaacacaacacttctcacaccagatgtatgggggtttctctccacacaccaagtgatcagttctctagcagacaccaagtgggtgtaattcacttcatttctgatgctggctacctggaggaagagtcaaccccacagattaaaagctcagtcccacaagactgcctcccacttcaaatgccagtagcaagccccaggttatgacctgtacttctgatgtgctggctatggatctaggtttccaaaacctccttctcaggttttatgaatttgctggagtggctcacagaacacagggacatgctttgcttacatttacccgtttattgcaaaggatattttaattttaatttttgtttttttttacagagttgatatgatttactaacaagtattaattgtcgatcttgagacttctgaaatattttcattggctttatattttaatatgaaaattaataatttcttttttttaaattttattttattttaagttccaggatacatgtacagggtgtgcaggtttgtttcataggtaaatgtgggccatggtgtttaactgcacctatcaacccatcacctaggtattaagccttacatgcattatctgtttatcctgatgctctcccccttcctctgcccccctcccaccccttcaggccccagtgtatgttgtttccctccctgtgtctatgtgttctcattgttcagctccccacttataagtgagaacatacagtgtttggttttctgtttcctgcattagtttgctgaggataatggcttctagattcatccatgtccctgcaaagggcatgatctcattcctttttatggctgcatagtattccatggtgtatatgtaccacattttctttacaaggatattttaaaggatacaaataaggagccagatggaggaggtgctcagggcaaggcatgtgggaaggggtgtggagtttccatgccctccctgagtgtgccactctccatatacctccatacattcatcaatctggaagctcattcaagcccagtcctttggggtttgtatagaagtttcattatgtaggtatgattgattacattattggccattggtgatccacttaaccttcagccttcctcccctccctcgatgttgtaggttggggctgaaggtgccaaccctctgatcatgtcttgacttttctggtgaccagcccccattctgaagctgtctaggggtttcatatccactgacaagctatctcattaaccagcaaccagctatctcattaacatacaaaatacactcttatcactccagaattccaaggcttttaggagctgtgtgccaggaaactggaagaaaaccaaataggtatttcttagtatacatcacaatatcatatccctgcagccacagcaactttgtagataatctttaaacatcagaatggagaaagtggaagatgagcccggacagagtgcattccaaatcagtgctgtttcgtgtctctctttttcaccgtataatctgaagtttagtctcaagattctgccatctcaccactacccatttctaaatggaaatttttcagctggtcacagccaggagccacatatgaagaggaataagagacagaagacttctaacttttcattgcttggcaacagtaaatgcttacagtttttttaaaaaataaaattgatgttataactttatggaaatcagttgtaaaagggagttagcagatattttatctttgtgataagacattctactggtctgtggatatgtgaatagtagatcgttttttggaagacactaaaaaaattaaagttttgtaataagagatgtaaattaaagtcatcagtagagagaaatgggtgccctaaaatatggaatatttggagttataatgccttctaaaggaggatatattattataaccatcatttattcaataaaaactataggtacttaccatgttccaggtacatggctaatttctggggcaacaaaaatgacaaagttattgtcatccttgcccttgaagtgctggttaaaggtgacagataatcaaagaaataattgcagagcgtggcactgagtatgatgataaaagttaaaaaaaagagtgctgagagaccacagaagaggaagctatcagctcttaagatgcttggaaaaataacagatgaaaggacatgcattgaacatttattgaatgaatgaatgaatgaatgaatgaatgagtgaatggtgtcaccaaagcttatgtcatcacagtgttaaacactatatcctgaaacaatgacctggaattttgcaaacaaaagagaagattcaatgtagtagtcaactccattgcagaacactggggcctcaaggtgagagaggaagctttatgactcctacagtcccctaaaaattgagtaacatattttaatctgttacccaataacatactttaaataatgtaagctgcatgctgttatttcctagaaagatgtggtttcctggagataagttgtgtctaggtgaagcttctgcatgatagcttatttcaactatgtaacaaagtatatattttaaagacagccagtagtgaatctttcggaaagaaaaaagttatcttaaaagtagatgcattttgatttaggattttgcatgtctgctttcataaataggttttcatatctggtttcctgcattaccaaatgacattgaagtttttatagatttaatatttatcataacatacaactacatctattccctggaattatgtgtgggtgtgtgtgtgtgtgcacgcacatgtgcatatttatctgccaacatctgaattccctctatagcattgcaaatgtaaaattagtatgtcattcttagaggtgctgtttagtattacaatctgtagctaaatactaggctaattattctgtgaataagtctctttctctggtataatgtagcactcaagcacaagcgatcaataaatgttattatgttatatattttaatgttattctacaagttagtaaataaaatatctaacatagtaacattttttgttttttatttttatttttaaaatatctaacataataacattgccaactcttttcacacatgagttcatgtaacccttatgatttgccatctacaaccatattttaaagtgccaaatataaagttggtcattgtttctaaaaagtcagtgttctcacgttctatttgactcttcgtgtctaatagtgatatttaaagtaggtcatttagctgctgattttactcctgaataactccggtccccttaacactatcagatgttcctttccatcacgtgtttttctgcttccagttgaagaacccacattaaaaggagttgagtggaaaatggaatgagcaatacgccctcagtttactattccttccagatatttttaaatgaaggtacggaaagataagatggtaggtttgttgcggggcagagggaggatggaaggagagtttatcaaaagcgaaaaaataaacagatgagggatataagaatcattcccacagcctccatctccctttatgttctctgatttccaaacatctgtatttctatttttaactttataatagcaaaaatgttgtttaagaagtaaataattcctaacattttaaggataaattagtgtagtatacccagtataaggcaagggcccagatccatgaaggtatcagcattaaagaagacaaattacagaagaccttcaaaagcctttagaagcttatgtactccttaacagtttacaaattgccttatctccatttttcatctgtataaattgatcacatttcctcaatttctaacatagagcagaaccactttcatattttttatttatatgtgtgtgttatactcatacatataaactgtatttttaaggacacatttaagtgttcccttttttcacctgacactaatgttaagaatggaaaattatgatacaattcagcaaggagaggaattgcggtgcatgttattattgactacattcaggtatagttggacaaattgggtaatggaaccaaattggattatatgagattctggccttaaaactatcattctattatgtcttctgatgaaacacaattgaatttgagttgtgtaaactgaaaaaaaaataaataattgcaaaatgtaaagtgaaagatacaagagtagctacatagaatcgaaataaaactactcacgtaaataaaatatttcttacacacttaaagcacatatattaacattatataagaacacatctaaatgaatgcttatcactgagcaatatgattttcaaaatgttattcgaagacaacttggctgttcataaatcttttaattttaagctgccgatttacagtttttcctttcatcctcttgttttgaaggcttgatgtgggagtgctaattaatgttagaattcttatccaatgtacttgttgctaagcagatagaactatcagagcattttattttgaaactgcactcttttttgactgatatagcatttgaaatcgtgcttgaagaaacatttcatggcagggagccagttttctcattaagaacatattgcccatgaccaattcactggtttatttatttccacaatgcctgttgcccctgtggctcatacatgcgtcgtgttgaaaaccacatgtaaaagacatgaacactaagttgtcttatcagtatgagaatacacaatttataaaatcataaaacatggaagttaatgaaaagtttatttagaactgtatattttgccttccaggcagaagttcttactgactccttgggctgtcttagctgattgcacgttgacttctgtattcttcatatacgttttttgtctcaatttgagtttcttcagaagcagttcctgtgtcagaggtcctgtttgtttggtttattttataagttcataaaatactgatagggatctgagaaatgagaaaggggacagcaactgagagaagccttggaaatggtttaaaaccatgtctcagagttaagggacaacggaggtaggatatttatgcaccaactcttcagtcactggctgagtgtcacaaggtttgaagaagatgtgatgtccctgacacttaccagcctgccatgcaaaaggacagagtagtctttgaagtttcagagaaagcactgagccaatgagaggcgatgacctgtactagcagttggatgccagttggggcacactgaagcagtaacagctaagtgctctaggtgggccaccaaaaacatctgccatatcttctgtgggcttacatccacccaaagtgttatttttattctatcctgatctatggaagatggaaggatcatttcgtagttgtgtattcatttttttcattagtttgtacacatttatggatatcccctgctggggccactgttctaggcatggaggcagacaccagggaagaatatgacacaccaccatcattgaggtccgcacagtcagggtaatgggcagaggcagtgaagagccacggaaaatccttgaggtgcaaatgaagttgaatcatttactccatctatgggaatcatttacttcgtctactatgagtagtacaaaatcctactaccttctggagtggctttggctctttgtctggcattgagtttctttctctgtcttagcccgctggtctctgagtacccccctgaagatgcattcatatagaaaagggaggagtcagtaatatcttgtttttctattcggggtattttagtaactgcatcctgtggctgaaacattcagatgatttcaagattttgacacatgaagattccaggttcacctatgaaagaaaatagggagtctgcctgccaaaattctagttttatctaaaggatgccaactagcatatagcatgcatgcagaagatggccagtattacattttttgaaggagtccattacaaaaactataatatttagggatatgtacttattaatctagaatgagagctacagctatggtaatatgaatggaagcataataatttttccaaatagtattactgtttagagattgtttttgtttctcttccttaggttttttttttttttttttttttttttgagagaggagatagaggtggctgctgtgatggcaatgatagctatggttactgtcttattgaatgcctattattatattaacaaaaccgaagttcagagaggttaattaacttgtctaaaatcacaagcttggctgggcatggtggctcatgcctgcaatcccagcactttgggaggccgaggtgggtggatcacttgaggtcaggagttcgaaaccagcctggccaacatgatgaaaccccatttctactaaaaatacagaaaaattgctgggtgtggtggcaggcatctgtaatcccagctacttgggaagctgaagcagtagaatcacttgaaccagggaggcagaggttgtagtgagccaagatcacacaactgcaccccagcctgggtgacagagcaagactctgcctcaaaaacaacaaaaaacaaaaacaaacaaaaaacccccaaaaaatcacaaactagtcagtcagtattttgacctgagtatcttgaattctcaggtgtggctgcaagacgtattgataagaaaaaaaaaaaaaaaaggtacaacataagagaattcaagtttcattcacttttccagcaaatattctgtagaaaatccactatggcccagccacttagctaggcaatgtgagtaccaccttctaagacagagaaacaaaaccttcccctcatacagcttaccatccggtagggaggttagctaagctattaaacagatcagtacataccgggggatgagtgttgtgatgggaaattcagttgataagagagcccgaagccagaagacctcattgattttagggatcagaaaaggctttctgcaggaagtaaattttaagctgaaagttaaaagaggatgactaagctaaagtgggagtcaggggagcggaaaggagagaagtgttctaggcactgggaaggcccagaggccttattctagcattgaaaggacaatgtggctgggacattgagttcaggagggagagtggagacagaagaagccgaggagatggaagccctgtgaaagatgcagcagatatcatgatgttgttcccaacctaaaagccctgggaagcccatgaaggagattcctctggctctggtgtgtgggcagattgaagaggaatataccaaatgaaaggaagcatcctaagtaattctgatgatcatcccggagtgctgctggtgaaggtggacagagtagatttctttgagagatactgaggacttaggaagagaagacttgggagagtttgcactgaagaagggagaaagcaatagcattgtctgtgcttttgatttgaaggaaagggtaaatgttagtgaaatagcttctgaaggcctttaagaagactgcctacatagaaagcctacttctatctgccggccaaagatctggaggaacctcatcctttcattctaaaaggagtcgtggatgtagatttaaccgttctggtatctgaaggtggtgggattaggaataatttttcttcctttttttttttttttttttgttttctctgctttagttttataattaaaaaggaattttcttataaaaatacagctactgtgatatcttctgctgaacatgtggctcaacttactcacaaggtcaggaaagttgggcccaaggcataactgcttaaactcaagaaaagagaaaagacaatttcatcaccagtgtaattaagtgagcttccctacaatatcttaacttagcttctcatctaagtaatatgaatccaggtatagtgggttttggtgtttattttaatcttgtattgtcattagccagttagttacattagttacccttgggtgtattgtggaaatagatttccgttacattctttttttcccccctttttaaggatttagagtattatgcctgagtgaattgattcatagggattttacttactcattcgttgtgcgctgctgtgtttttgttctccatctggttaagctgccgtgactctctgtatagcatttgcacagtgttcacatgatgcttgggtacttaggtgtcagtttttcattatgcccggatgatgtgcgttgcgtggaaagcctccggaaccgtaaactctcatttcccaatcatgaatagttaggaaaccagagttcggcattttcattaacatagggtcttacatgccagttcagcttactacctgctaagcctcctagtctgttggaaaatgtgcattggcagttttccagtcttgctaagactcataaatagatgcctttcatatgaaatgtatttgctttggcatattgacactggaatacattattcttttagcagttgaacaaattaaaataaaaatgatgacttctttttttcagtatactaaaatgagcataattgggttaatatcttaatctggcagtcaggaattagcttgtatacccacaaccacataatttcactaagggaagtttacatgtttccttttccttgttctgttgatgaccttcctacgtgtcaataactagcagagagtttggtcagataaaggggttggaataacctggagagcttaccaaaaaaaatccttatctctgagtaccatctctgtaaaatcctggtttaattggtcttgggttcagcctgagcacctggatttttttcaaagttcccagatgatttcaatgtgcagtcaaggctgagaacactcgctctcatcatgtgtaccagagacaatactttcgtaagcaaacagcctcacctaattgtttctttctcttttgttttccctaagtctagtccacatctttgggcatggtccttgagtaggagaataagagagctattgaatggtccaagaagattcagatggcttcattttacactccagttgatcatatagaagtttagggagaacactcaagaccactgggagctactatgtaggtgaatagatttgtccaagacccactctggcacttccaagctggccctggtgtactcatgagtaaagcctgccagtgtatacttacatttccaaagacttccgtttagtaagggctgcctgatcttataggtgcctcagactggtccttctacaagtatagttgttttatttcatacttctaaatggatgtttgatattgtttaggattcaaatgtttattcagaaatccataaagtaggtatttgacatctcatagttttgaacaaaatggtaagaacaagatatatcaaaatatatcttgaaggcatgagtaccatagaccttttagaagtgcattttctagcatcttgtacaaaacaagacccttatttctgtaaaacttgatggaccttagctgggaatgtgatatcacttatccttcaatgattttttaaaagaattatacctgcatttaaagccttggcaaaatatggtaacattctagctactgaaaacccataagatattgtcccacataagatggataactttccactgaagatggataagttttagggtatctgaaccttttaaaccttgtgggtatcatttgtataatattctacttaatagtaaactctgccattcacagtgtcccctttctcatttttctagctacagttttcggcaagccatttggtgtgcttgcaatgctatcatgagctatggcttggcgttacaaggtctggagagtgaaagtgttttctgagtttctattttcaatagttattaggaaaacaattgaactttggctatttcctggtaggtttaactttcatttaagtgaggcatctgaatatttttgttgaaaatataatctttcaccatgaaactatctgagtttgagatttcagttataaaacacgctcttttcagtcattgaaaaaataacctcctgcaattttcctctgaaaaataaaaatgtgctttgatagagttttcgataattattatcatacatctgtgcatgtacccacaccattgtgttcatctcccatccatgtcattagtgaagatatggattaattccacattggatttcattgtatagaatctgggtatttatatctaaaaaaaagtgctgtcatttgattacatttaggcaaattttctcagtttataatctagaatgtgtgtttcggtcttcttctttaactggatgttctcaaagtatacttaaatggcatggccaaaccattgaagaaatacaacagtgatgactagtttctctgtgtctttccctgttcagcagttatagaggcatgattctatgattatttttgtgtaatctttgaatatgcaaaacaaattataacaaaaagctgtggactcttatgggattctaggtcgtgtatatttaattttcagcagcaaacttctccctatttgtaacttgttgatcttcttcagaaatattttcttttccatttaaaaattttaaactgagactacaatcaaacctttttcttttcttcatgtatagcaatgcttaagttatttgtatttcttataattaattttatctgcaaataacagaaatcctgaaataatagtggcttaaacaaagtagaagttaattttttatcctcatgttaaaacaaaaagtgcagacataaggagtctggagctggcagagtggctcagctgtcatcagggacctgggtttctgtatccttagcacactcaaggttgcctcatggttcaagactgctgctagattaccagccatcgcattaagaaggaagctagaaaagcgaagtgggaaaccaagagagttgtcctcttctttacaaagagtctttctgtggatcccatacatcacttctgcttaggtcttgttggtcagagctaattcacatgaccataccttgctgacgggaaggcttgggatgctagaactgtagttgggtgtaataccatcccaaatcccaaatatatttggtggctttttttgtttgtttgtttgtttgtttgttgttttttcgctaagaagaggaaatagactttgggataggaaatagcagtctttgctacctcactgttttcagattatgatattgtaagatatgctcaaaatactccaagtacaaatacttacattgcttgttgacagagtaaaataaattatataagtaaagctagttaggaacttgccatattggcagttcattttgaggatatttctaaaaatcatggactgcaggaggagaaataccaaagccaaacacataaaaatttcccacaactatatgaaaattccaaaatttatctatatggtaatcatatgtctggtgactttatttattcagaatatctctaagaaagagagagggttgtatatttgaccaattgtttttgtcaattcagagctgttgaacaattataaaattccaaagttctcagaaaatacttggctagtcatggtattgcatactgtagcttctttaaacactctgcagaattcttgggagttggtcatcagtagcagacggtaagaaaggttatgaagtctcctggttgtctgttgctaaaaaatcatcccaaaatatagtggcctgaaacagcaacaattattgatttgctcataattctacagtttggacaagattcagtggggatggcttatctctgccccatgtgccatcagatgggatagctcacctggaggggctgaaggatccacttccatggtggtttaatatacacagctatgaagtcagtgctggctgtctactgggaggtctcaattctcctcacgtgacctctccacatgactaggctgagcttttcacagaatggcagctgatttcaaagagggatcatcttggagaataagcattccaagagtacaagtcccagtgtgcaagtacttatccagttttttgttaatgtctcattagccaaatctagtcccatggcaattgggaggggctacccatggatatataaataccaggaggtgtggttctttggaggccatgaaagaaactttctgccacatttaagttctcaggcagaaaaaatagtgtttattgaggtactaccatgtgccggtcactgtccttaaacacagagctgccctgcataaaaggtcttattcgtcccattttccatttaagataaatgaggttcaaaatgttttaaatgacctgcaggaggttacaaaggtcctgtggtgaggctccatgtttcaatctacctctgaaaaactcctaagtctttgcactttgcagggcctccagctgcctttttaaccacatggtccattgtcactgctgcaggcacgtctgccctgtgtgctttcactctaagcacaataaaagacttaccacccgataagtctgttttttgaattgagaacaagagaaagagattcctgaacattctaattaaccaagtaccgctcctgtgccacagagatgcctagcagtgagagccgtaaaaggaaagtgcttggcagtgaagcaagacaagaaacctggtcctttgtgctctgccccattgcaagctttctcctagcaaacctgaccagtgacaacagtgtccaaagtcttttctagaaaggtctccatattggtacctttttcctgaagtaagggcttataacaagggcattaaaatatgctaatttctaatgctttctattaggcgtatccacatatcaaagcttttactggaacacctttgtcaaaaaaaaatataggtcatgcacatggccatgaaattccattctttatattttaagcagcatcaagattgttcttttccttcgctgtttggcagattagaattcctctttaaagtgggagaagttagttacttatcaaaccatttgattaattagctagacctgtcaggccaaacaggactagccaagtcttttaaatctcttaatatgagccaattttcacaataacttgttttattcatggccttcacattttaaattcttgctcattagtgacctggtatttgggcttgtctgaaaggagagcatccgttgtgttaaacagggctcattatggattataggttttcgaatggggatgcctatgcacaaaagatcgccctcccattttcctctgaatagttaattggaccttcaccttgtttttacaagcaaaggctaagcttcaataaggagataggcttttataatgccacagtttgggttgtactgaagagctggtgacctatcattatcaatacagatgtggaactaaagtacagcatgtgtttggttttgctagagacaataaaagtaatggctgtttttaaaaccagtaaaacactgaacttgatagaaggagaaattcattgaatatatcactctgcaatagttcaattccttgagtaataaaatacaaccaccaaacactcagaaataaacactagttaaaaaaaaaaaatgaaacacaagcctgaacccacaatacccatgcattgactcccaagaaaacagatttttacattccctaataaatacatgtattactatatccccaaggttttagcatcctcattgtatatcaggctaatgtctctaatacaaattctttttgaatttttcttagttaaaataatcttctgttttggtgtgtattttcaatttgttttaagattctgtttctgttgcttgcagtaattctttttattttcttttcctacagaatttactgtttatttccaaattactccagaccctaatagtctattttgcttttggcagaattcgtgtatctattgagttgcattctgttttgttgaatttcactcaatgcgtgtctctccaaaggcttcgttcagggacaaaacattcaactgcttctttagggcctttgggttgtgtttgtaacatgtatccacaatcagctgtcataataagccgagcatcctgattaattcactgtaccctccagtcgaagtattcacggatgtaactagttgaaatgcggatacacaagttcctactggtcttaaaagaaatgatttttctggtagttttataattttagcaattcagatttcgtacatttgaggttagaaaattcagcagacagcctaaatgcggcatcatgctaatggagtcctggaagctgctggtgttaaaatgagtaaattaaggagtcaacactgcttatttaggcacattaggataaaatagtatgagagctcggacttaacaaaaatcaattcagcacgcagagtgcacatccatcagggctttgttatgatgtcagggcgagcagcaaccctgttttattttatgaagaatgctacattagcatcatcgcgtccttggatggctgtgacatttgctgttatggaactactttgcggcagccacagggcccccagggactactccaactacattaaaaaattaggttggcatcaaatgacttattgaactctgtattgatatccttgggatttggttgtcaatctacacagtagttagtctcctttcacagcgaccgcattaagtaggaagttgtaacagttattgacgatttgagcaaattattttcctctatccagcccctacatacaacaacaatagtaataaacacagcttgagtgaaaagtatattccacatatggcatggatgctttgtttacatggtacgtggttttatttcacaataactcctaggtagatattatgtcctttctgagatttaagcattactttagtcacttaatcaaaaatcataaactgaagctcatgccattgaccccagttatataaaagaagtttgaaattttcttttgatctaggttttgcaccctgatagacttcacagataatgtaactaattagtaactgtgttttatttttgtgtacccatattctccttgccagaaaaaaaaaaaaagttgttggaacatactctttgctgtgtttcctcttggaaactattagccttcattattcagagtattggaggttagatatttaattttacaagcctaattattgactaacattttaataaacatttgacatttattaataagaattcaaaatatataaccatttaattttttacatactatctaatatctaatagtctcatatgaagtagaaaaaattacattcatgaaacactacactctattcatattatgatcacaccatcttttgttttccttcttttaaaatttttattttttgattatgaaattaatgtgcattcattggtaaagttcgggaaggcataataaagaaaataaagatgatatataccaattaaaggtaagccctgctaatagttgatattctttcagaattttttatattcattttcttctgtatatgtatacaattttcctatgtttgctttatatatattgttttgcaactagttcatgcattctaagtatatagcagaatttgtttcattaattacttgctattggaagttggttctgagctattttgaggatgaaaaacgtttctttgaccattcctgtatatacaacttctatgaaagaggcaaaaggttatgcatgctaaatattcagatgtgttaccaaaataccatccagaataacacctatgtaagaagttccctgattctcacttcacttttagggttaactgggacagtatggacattcttttcttaattcagtcattcaaagccatttgagtgcttactatgcattaggcactctgcaagacccaagagacagcagtggtaggagacagataatcctgctgcttacctggaatgtaccatgcaatgggtggagactaatctgaaataaataattgtacaaatgcctttctaatggaacttgtgctgtgaaggaatgttacgtcattgaacctgatctaggatggagagtcaggaaaagcttccctgaagaggtgacatttgacacttgaaaggggcaggtgtaatgagtttaatatatactgtgttacatcatgctaataactattaaccattgcatttttactgaggaatgctatgtatgttttggcacatcttaagtcagataattttattctgttttattgttggaccaaaaaaatggacaagttctcttttccacttctcttcccctttttgcccacaactacaattaacatgtgatggtccagaactattttttccttcttttttttttttttctatttaatgttacaaaggtaaacgtgtgccatggtagtttgctgtgcctatcaagctatcacctaggtgttaagcccagcgtgcattagctgcttttcctgatgctctccctcccaccgctccctgctcccccgccccacagtgtgttgcagaactatttttttttttttttttttgagacagagtctcactctgtcgcccaggctggagtacagtggcacaacctcccctcactgcaatcttcgcctcccgggttcatgccattctcctgcctcagcctcccaagtagctgggactacaggtgcctgccaccacgcccggctaatttttttgtatttttagcagagacggggtttcaccattttagccaggatggtctcaatctcctgacctcgtgatccacccgcctcggcctcccaaagtgctgggagaactattttttaaaggaaaatatggtctccaattcagaagagttgcacatctccaggatagggtttcatcttccaggcagtgtattcaggcagctcaacactactcattttttcacctgagccagctgaagttctagcggcagttgtctaatgatgatttttaagagtcataagcaaaaatgaggggacattggagcagtaccatatttagaatgcgaatattagtgcctccatagtctgaccttttctctctggacatattttatccatcactgtgtccacacatgccaaaatgactagtaaggaaatgaaaatatgtggcctttgaatgcaatttgtgaccaacattattttttgattaacagaatatatttttgtttcattgaatcaattattttatttagtatcagcattaattgtctacagacaaaatatctttggttctttgttaaacatttcaaaatgtgctttttattgtataaaactctacaactattatttccctagaagttcaatgcatacattgataatttattatgataaattgatgcagaatattgcatgatgtaatatgagtttcatgttgaattaagccatcacccctaaatatgaatctcaaagagctgtggctatttggtttctttatccaaagaaaaaatgattcataaccattgttgatgcaaatattactacttaagatgcaatgggtttctagtttcctctttgctgtgtaaaatgtatgcttggttgaccagaattcagtgaaacctctcattagggcactacggttcattaaggtttaaagaggcatcactgaaatttgaattggccatgctgtgattgccaagtctctctgagtggtaattgggctgtgttatgttgtgtgctttactgctgcaatggtttttagagttgttaaaaaataataataatagtgattaagctctgtgctatgtaaaactggcaagtttcttagtgatggcatctttttgtttataaattgagatttaaaaaatcatattcttacaaaaaacattcaaacaccaaatttgaatatcatactgagtttgttttttacttattggaaagagtatgttaacataattttgtttctatttcattttctcaaactggaagaaatatctggatgtgcacatagcactagaaaaatcaataagtaatctagatattgatttactgaatacccaacatgcagattgagagaaaccatattcaaaatgtgacaattcagttaaaagtgaactgaaacaagggtgcggttactaataggcagggaattactaggcagatgcatatcagagccagatccccaagggaagggcttatttcacctacgtgatagcacagtttgtactcaggcacttgagaaacaataatttaccataattgaaccagccacaaatatttattttgttaaatcagacccacaataccagcctgtctgtgctttgctggctagaaaatgtcctcatgagtcttaaatttatccttaaaatatatttaaaaaaataatcttaactggctttacctgtacctagttcaaatcgttttctctttatgcacggtgaaatctcaatgttggttactgtttctgcacatttccctcgggatggtggtttgtgagcatacctacctgtgctgctgtgttgcgagcctcactttgctcacctgggtttccccaagtgttgtgtttcaccactgggaggaactggccactgctgtcacctcaccacctaccataaggcctaatatatgacatatgtctaatatatatttgttgaataagttaattactctggattcctacctgtggcgcagtggctgacacacatatatctgcactgccttttgtgagtgactgaatgaacgtatgcatttgccatttgggaatattttcagttttatcgacgtgactgtttagaggcataatcacagacttataggaaaaaaacgtttaggaaataattctttgcagatatccttttggaatatccatgtaagatttgccttttgacagttactccccaatcctcctgcctaccttatccctcccattaaaaaaagagcaacaacagccgggtgctgtggctcagacctgtaatcccagcactttgggaggccgaggagggtggatcacctgaggtcgggagtttgagaccagcctggccaacatggcgaaaccccatctttactaaaaaatacaaacaatagccaggtgtggtggcgggcgcttgtaatcccggctactcaggaggctgaggcaggagaatcgcttgaaccgggaaggcggaggttgcagtgagctgagatcgcgccactgcactccagcctgggtgacaagagtgaaactccgtctcaaaaaaaaaaaaaaaaaaaaaaaaaaagcaacaacacaagatatctggcacacgttgtcctgccgagttgttgtgagtttgtcatcgttttcgtttgttgttgctgttgtgtaagcttcacgtttggtgattgttatgttcttggggatgcattctgactatattgggtccccttgagaccagtgttgcaaccaaaagaagcagagaagatgtagtccctaccctcccgcacctcgacttcatgcctttgcgagttttttttttttttttttttttttttgagagggagtctcgctctgtggcccaggctggagtgcagtggcacgatctcggctcactgcaagctctgcctcccgggttcacgccattctcctgcctcagcctcccgagtagctgggactgcaggtgcccgccaccatggccggctaattttttgtatttttttagttgaaacggggtttcactgtattagcctcgagttctttaactacttgatcttcactgaattgatcaggctgagaaagaaacagaacagtgtcagaagccaaccagtcaggtgaaaatattgtgttttgcaagtaaggggggttgaagaatgagagggatgggaaggagggaggtacagaggaggggagaagagcaggtgcgctaaggtatggaatggcagtttgaggaaggctgggtccacatcttctgttctgatgcaaccccctcactgctgcttcctagagggaccttcagaaagagccacatttgttttcaaggctttctggagttagacttctacctctttggggtgccccactggtctcaagggaatccaacacagtcaggatgcatccccaagagattgtaaatacatacaatttaattgttataattatctttttcctgtttgcatctcagttaaacattgtaaaaaatgttgagatgctacttctcttaatttcagttccctcacagagcagagcctgagtcaagatcttgagtgcaagcagtttacttgacttgtttatttgacttagcctgggaagtagaagtgaggtagagagtgagctaagaacaggggaaaacccagtgaaggatgtgctgtttagggggttaccactgtgggcaactgagttttggtcctgctgggaaccctctgaagaaccatgtagtaaatgtaacctcaaacctgcctatctaagtagcactgttcaatagaactttctgtaatgatggaaacattgtgtgtccacactgtcttctgccatagccacatgtagctgtttagcatctgaaatgtgactagtgtgactgaggaattacatttttagcattagttaattttagttaacgtaagtgtaaatagccatatatagctagtcactgctggattgcactgcacaggtccaaaggattggatgttcaggcgtttatcactaactctcattccatacgtggggcttatggggctgtgggtgttaactccctcatacttccaacctgccctgcaaggggctaagatagctgccatgacttaggagaaatccctgaggaagaaaaaattgagagaatcaaagtccttaagaggagacactgccttgatacaagaaaactgtccctgacagctgcagaagaaatcacaggctgagaggacacacaggaggcacaaagtacccgtgtgatgccaccttatgaggcattgaaaaagtgacagtttggtatattcatatctgtttttacgattctgaagtatcaaagttcacatcataagaaacgtaattctggtaataatcctgaagttttcagttaatttaatgcttggaaacttttaatgttttctaaatagctttttttcctctcttttaaaacttcaattatttcgattttactctaatgtaggtactaggacaaaacggtcacctcattagtatgtagtattttctgtgttttcaattattacattttgaaatgctagtggaaaatgctgtctgccttacttttttattttcatagaagtgtatttgaattggtttcaaccaccataaagactatttcaacttatttgttactaatgatgccatagcttagtaaattgcataagctgaataaaaatagtataacaaaaaatgtggcaactctagtgattcaaaatgtgaaaaatgatgaggctctattttcttaaagttagatttaaactattctatgaatatttacattttaaaaaattaaattttctgagaaaatcttgcttatccctaaagatacccatcaagctgtaaaaatgtagagtttatatagataaatgaaactacataatatattagagtgttgctatgtagatatgaaaacaaaatttactcttgctttttgcatttctatgaaataactgtttaaaggttaggaataaaggccaaaatttgcatttaaatggatatattttaagaagaaatgccaatttgtgacctttacccttgccgctagtatggttttttttttttaggattaacaatcaaacttcagaggaaacactagaaatataagcaaattgatagaaaatgtttagtttaaacagcttcccagaaaactgtttttatagcctgtagggagggctaattgggccttgtcatgaatcagtttaatcatgtaaaatatatttgatgactgcaatgatagtgaaagattgatccgtagtggtataaatcaggggtcccaatcactgcagactcagtggaaatgaatagttaaaattcgaagggacccattaagtgtatgatggcaatcacagatttaaggcttcattctatatatttatgtatgcattttaaaatcttaagaagatacttcaaaatatattagagaatttttaaatttgtaaaatctacaatgggtactacaatatatctacctgtgaaccaccacagttgctggttgaaattactttattctattatcttccaagttgtattagccattgttagatttcagtgttatcagggtaatagaaattaggtagtgattcaaagtgtgttttaaattattcctctcttttcattgactagttgcatgtctatgagaatatgtgtgtatatatatttatatgtgtgtatatatgtatatgtatagtctatacagattgactatgtataatatgtgtgtatatttatatatagactatacatatatagactctctatatatacatacatatgtatatatgtttgagtgagtgaatgattgagaaacagatagattcatcaaagctgactctcccctttatgtggtatagtagaactgaatggaacatgtttttagtttagtttttgctgatgtgtgcatgtaaagtcctctataacaacctttttttccaaaactgtgccatttccggcactgctttttcctccattgttactttttgtttattacttgcaccttggacacatgggggaaaagtcaacctccctggacaggttcaggaatcagaggatgaaggaaagaggatacatgaagacatatatgaagtaggagttctatttagaaatgaaagaacatgtgaaatatcagttaacatcggttcatatggagtccaggattctatttaatatatcagatagtcagtaaggtctaagagaggcaactgaagtaccctatttagaggaaagttggcatcatggaagtttgttagccattgcctgggctcagccattaggaaattgatattaagttgggacattcagtccttggtctactagagaaaaagacttagaaatctaggctcttaaagtctgagtgaagctaagggcaagtacagaggggatgacccaggagcacagtgcctatgggactgactctacctaattgtagttgcttgaggtcaatgtatcattgaatccacttgctcagatactggaccagagcaatttctactaccattgctctggaacagggcattgcaccattctcttagaaactggaccttaagaaactgtggccatttcaattccattttgatatttattacagatttcttagtagatgccagacagtgtgttaggtcccatcactcatattgccttagtatccattagggctaagtaccattttcttagctacactcttccgcatgtagcttatttaggaaaagtcgggcaagtgggttacagacatagtagaaaacattatgtcaaataacaacctgcccagcaatgaaagattttaccacgtcctttttgattcctatttttgctaaacaggtttaaatccttaaatggttacagaattcccccaaagagtagattatttgtaggtattagacaaaaacaatcaaacaaacaaaaaaaaccacaacaccataaaactaataaacacacacaaaaagtgaggggtccgtactcaaaaaaaattttggaaaagagtgggttaagcaagttattttacttctactgcagaggaggctttcagtttgctgttacgctgtaatacccaagagagactaatgtatgcagagtttcccaaaatcatttgatctgggaatagtttgtattgaagcatctttagtgactggtgtcctgtagcacaaattcgttaaaattccaatgctccagttttatccatcactaggaggagctaacctcagagaaactcagggaaggatgctgggaatggacctgctggttgtacttcaaaagaagcaaaggcaaaggggtccacacagaagccccaaagagaatcaaggttaatgaagggctctgcatatgatgactgtctttaaagtaggaatcctccaatctgaaatggcacagacactgaagagatagaattaaaatgtctaaaattatgaatgttatccataggttgcctatactagtcaatcaaattctggaagatggaaatgactagataaatccttccccttgctcccatcttgaggattaatttatgggtaagaggtccatagaggcttgttaataggaaatcagacttttacagctatatgctaacttttggcaatgatagacagttaaacagaatacttacctgaatgaatcagtttggcagaaacatgcacaggatttgaaaattttatgattccaaaagcatatctgaacatatgccaattgataacaaatattagatgatccaagaactatttggtgaaataatgaaggtagtttgtatagaaagcacctgtgcttatagagttcataaaagtttttcaaaatgataagaggaaataaaactcttgtaattaactagaaagatataatgtattgatctgtaaattaaagaattttaaataatgagtgttttctctcttcactcttgagcctgtttctttcctcaagaaaattttgattcctaaagactaaagtggaagtgtttattatgtatgcataataaatatctagaaaataataaatatctaaaaaaagacaaatcaacatctgacatgaactttgtctttccaaagaccatagaatgggctatgagtgaatatctttacaaagacaaacttatcattagaacatttttggttgtctaacaggcaggaaattgttaaaaaaaaatcttgttgcagtaatggagaaaaattagatgttcataggagctcccagtgaggataatcacatctgaatgcatccttgaaaataaacacaactcaacattttagtgttctattatttaaccaattggagtatgaatggatatgtaacaaagcttcaataatgtgtttcctcccagtaattgcgtttctttgtaaatgtctgtcctttgagctaactgtgtcttgaaatctcctgacttcataattctcaaaatcaggtgtctgagatggtactacaacaggctacttgagataagagtgaccatatttaatgatattgaccagtcaactaaacaaaataattattttgatcaatctttaccaactaactagcaaaatttaccttactatgacaaattctaatgttttacataggaaacaaaatactaatggctttacctatatcatgcccaaccaggaaatttaatttgattagtgttttgcatatactaaaatatttctatctggatacatgcaaggctccacagggtggggttagatttttttttttcaatgatacattccacattccccctgagggaaatgtcaactattatcaggcacagccaaaaaacaaaacaaaacaaaacaaaacaaaacaaacacatggaaacaaatgaaaagaacaaactgaaaaagtgttaagtccatactattgggcaaaaatagtagttaacatatgtaaaacaaggagaattgttcaaagcttttttttcttcttgatatgaatttgttgtaaggcaaatatcttgtttgagtcatttgtttattgtgtgtaagtgtatgtgggtgtgtaatcattttgcccatctcttttgtcaggaaccattaaattcagtgcccagaaagatgttgcaaatcagctactataaaattagaatatgctagaaacttgtaattaatagtataaaattcttttacaagaccagacgatggttctacattttatgttatattaaaaaatgagaaaacgtcatttgtgaaatttaataaggcagaacattattatgttcatattgaaagtcagactaatctgagtggattaagggtgccttgtggaatatcttgtgttagttgactaattcttgtcctcattattaatgttctgcagcaactgtaatacctacaagtaaacatcaattgaaaataacttcataaacatttcttaatcaccacagatagaatattgtttgctgtgttaatgcagattaaatagcataaatttacttttatctctttttaaaaaaataaattttgaaaagcagattagtgaatggcagagctgtcacccttgataaagctgtttcacatctttggagagcttaaacatgatacactgaagtgtgttcactgtcccttatgagcattaagtggtttgtaagataaaagagagaaaccagaagtgagaaggtttctattacaaacttagtcatatcatataaagggatggcgtagattaaatccctactcccaccctttgccacctccccttcactccccagaacttcaactgtcctttatgacacacaactgagcaggagacatagaatcacatttttcacagggatttgaaatgtctttgtggtcatggtctggcagtaatagaagccatatgctgtgggtcaggaagaaagctatctcgaaacagaagaacccatctcctggcctaatgaccttgggaacgtttagtcatttcaaggcatttatcgttgaagcagcgtaggggtcgtttgggctatgttttcctccatgtgactccaagttgtgagggggagaagtgcatattatccataaagaagacagcatcagtgataagtaagtggctaatgtcagtagcaataaaattctcttccagggcacctgttagctgatttgttgtagattgatttgcatttccctttgtgattttgaactccttttagcttcttaatactttaaaacacaagtctgatggaatgagagatcgcatgaaagaatttgatttaagctgagtactttgtggacattggaaaagcagcttttgtcttaaattacattgcctttggaataccagcatgtaagacaaagaaacatgatctttgtaatggctgttggcccatctccagttgacacacacatgcaagttatatgggctgggtcacttgaggtttcccatttcccataaaataatgtttatcatggcatggtggggcttaaaattggttcctaagtaatttttgctccagtctcttatagttgtctctgagtatgtccccagaactgacagtgatttggaggcattgaccatttaacatgatactggtggacattgatcagatggccagtatttgggtaaaacttatatttggaagaggagaactgatttttggatattaggaaaaagagagccccctccccaacttcaccaacactgctgaattccgattataggtataagcaggaattttctaaaattttagattaggttttaccagaaattctcaatattctactgctgaatctttaaactaccagacaccttttgctctccattttctcaaattggaaaggggtgatgaaaatggtaaaatgtctcttccctcttcctttgttctcagggatgtttgttactcatccttctacttgcagctagtatataaaacatcttttagagtctccatgtcttttttttttttttcttttttgagatggagtttcactcttgttgcccaggctggagtgcagtggtactatctccgctcactgcaacctctgcctcccaggttcaagcaattctcctgcctcagcctcccaagtagctgggactacaggtgcctgccaccatggctggctaatttttgtatttttactagagacggggtttcgccatgttggccaggctggtcttgagctcctggcctctagtgatctgtccatctcagactcccaaagtgctgggattacaagcgtgagccatcacgcctggccagaatctccatcttaaactggcttcctgaaagagtaaattgatcaagcttaaaataattttctgctgttctttttttccagtagggacaaggtcttgccatgttgcccaggctggtcttgggctcttggactcaagcaatcctcccacctcagcctctcaaagtgctaggattacaggcctgagcccccatgcccagtctcctggtgttcttggagggttttcctctgtaggtacttgttcatttgtgtccagagagacttgggagactataatcaatactcttatcagccagaacaacatacattaaaactaaaagaaaaagaggaaggttgagttaaactggccctaaaaatattgatgttctctcattggaaaggttgacaggttctttcaaggaaaggtcatttcaggaacataagaagtctttttcactttactctttgctcttatctgaaagctcatcacagtgttctataatattttatcatgattctgataggtttcaggatgaaaaatggaatttggcttaaagagtgcagggctagtatgaggacactgcactctgaaataagtcagagtgatttgtcttcatcagatgttccataataatacttaacttttactgtatgacgtgaaacgagtgttattatttcaaaaaatgtatttgtaaatttcaggtcaaaactaagaataactctaagagtgtaaaaaataacatattttaatgttaaatttttttattgcttacactctaaatattttcctttgaccaatatgagaaatattcccattgatatctctgtgcatttaaacaattgtgaaaatagagaactcagttatagttaaatgactgatgttctataagataactttatcacatagataaaataatgaagaaaagaaattaaataggcattcctctgagagtttctctgacaatcaaatcagaggttttgattgaaaaattccctcattaatgtagattgagtgaatgaactaattactttgtaatttgttctaatagaaactttccactgaggtgaggggcaaggggaaaccccaccgtcttcactgtcatggaaaagataaagaagtaatggatctttgaaatatttcccctaactttcaaaaccttagcttacagtgttggagactacctgagattacctttcaagtagatgttttcaggaaaaaaaaaagaatatagaaaggcagcccttgccacatacaatgtatttgaatgacactacaatgcagcttttgtaggtgatcagatagaagtgtcttgctgttctattgtatttcagcttgaatatccttcatcaaggcagttactgcaaaacaatgttgtaaatgaaagttaaaatgacattattataagtaaacttgagttttcttttattacctgtcatttataaggtggtaatgcaccacgaaaggaattgcatattttgggtaataaagaaatattctatgaccttggtattacttatactaagattggttttaagacttttattttgggtactatagagtagagaccatgtcattccccctttcctaccccatttagacattaagacattcttagtgatttttttataagtacctgtcttcatccattttctgctgctgtataacagaataccaccaactaggtaacttacaaagaaaagaggttttttgtttgtttgtttgtttgtttattcacgagtctagaggctgggaagtccaaaattaaagggctgcatctggtgagtgccttcttgctgcatcatggcatgattgaaggcatcgcatggcgagaccgaccgttctctagagagaggaaatgtggcctaactcccttcttttataactgtcccacttctgcaataataaacccactctcatgataacagccttcatccattcaggagggtgctgccccctgacctaatcacctcttagaggtcccacctctcaagatcacaatggcaattaaatttcaacatgaattttggaggggacattcaaaccatagcagtaccttttttctgaagtctccccagagcagtaatctttagtcctgaatatttcactgaaacacttacatgtagaggtattttcttaaaattgagacctgtctttattaaaaattatttatagtgatactcttttctgttctgtttacagtatatctgaggaaatataaagtgtatgctattaggctttgtaatgtcttattattaaggcagatataatagctttaaagagaacactgatggatagctttttagactcaaagcagatatttgtgtgcgattaaagtagaaaatgataccctacaattgttgagacatttttgatgttctttggctttccacactgatctttttctatctctacagttagtttggttttggattaatgtttttcattcagatataggaaatcagtagcacttgaaatgccatccatagtacactgaagtcttcagtgaaacaacagagtccaatattcaatcagaaaagaaaatgaactctaggagtcatttccaggagacatgtctgaagtcaaacttgggctttatttcctgtcttcagagggtgcactttcatagttgttttctataaggttcaaatcccagagtgtatgtgccactctctctccatttataccataaacaaaaattcaggtctttatcatttcacaccctggctgtcaatgtggctgtctctccagcttctggtctgctagctccccttctaccatccccaactcttattccctggcttaatttttataaaacaactatctgatcatctcatttcatgttcattaactttttttttttttttttttgctgcctctaggatataatgtctaggctctttgtgttatgactggggctaggaaagaaagccattatctaactgaatggcctctgaaggaaatattagagcttttctataaatttatttttctcatccttctaaatctgcatgtttgtatatattttattatatatatatactttacccatacagtagtatatgcatataattgatgaataaaaatacatatcttgggatatgctcaaaatacattttactaagagaatgcatacatgtggcagttatagattattaatgtcactttatttttctcttcttacttttccactaggtgagcaaggcaggtaaattaaatctgtcctgttgatggactgaaaactaacctcaatacattctctcaaatatgctacaggagttttgatttgttcatgaatttatttttattttcctacaaaggcaactggtaaacactgcctcgcttttgtttacctcctttctttttgacttttctttctgagaacttttgttttcttgggcatatttcaaagagctactaactttatttcttacatttggcccaaactggcttctatttgcccactcttgttaactcctttgccatgagactgtacttttaatgtatactctttgtttgtacaagttcttttcttttcagtagttgtttctctttcagccttaacttatggccctatgttctgatgcttgcaacctgccaagtactttccaagccctacacccctgtggtcatctggtacaattggtactgccattagcaccacttccaccatcaccaagctgtcctgcctccattagttcactttgcctcttatgcttcttctctcacatagatatctcagtgcatatctgagactatcctggccttccacctcatggttcactcacactgattatgagtttttcttgttctaggagctaaaaatatctctcctgccatggcctgagggtctcaacattccatattctcttcatagtaagataattttttttcccccaaaatcccagtagtctgggtggcaaagtactggttcaaaaaagttgatagtcccagcactttgggaggctgaggagggtggatcacttgaggttaggagttcgagaccagcctggctaacatgatgaaacctcatctctactaaaagtacaaaaaaaattagccaggcttggtggcagatgcctataatcccagctactcgggaggctgagacgggagaatcgcttgaacccaggagatggatgttgcggtgagccaagatggcgccactgcactccagccttggtgacagagcaagactccatctcaaaaaaataaaaaataaaaataaaaacgctgatagaagggcatctcttcataacactaactgtcccctgactacctcaacctaaatactccttcttgttttctttttcctactttagtataaactcagatactttaagacaaaaggggtacttctttctctcaaaaagaaaggcataaacatagtgtcctaggcaaactggtccttatgcttactataaatcaatccaagacaactaactatcaaaaggaacagtagaatattctttctggaattttaacagaagaagaagagccttccctgtggattttctgagtgatatatggattcaagctctttacattctggccctgtctgccttcttaaacgtatctcccttcttctttttctaatattcctgtcacattgagctattctctatttcttagacacagtctacctctctgcctttgtccatggccttaaatgccttcccagccacaatctagctgttgaaatctcatccatccttgaatatctagctcatgtaatggtaatggccatagaacagcttctactaaccacccccagcaaaagcaacctctttctctctcatgtgatgccttatgacatttatttcataatcttgtcacatcctcactttatgatttctcgtatgtaatttaaaaaattacataatatctaacctgctagtttgtaagttctttgaggacaggttctatgtcaaattcatctttgtatattcctgacagcctagttacaatgatattaatatattggagtcacagttgtatttctagagaggattatatggctgaacaaaatgtttcacaatgatatgttcttctgatggaattttttaacctaagattactgagaatttcttggtcagcaaaaagacaggagtatatcattctgacactcttttgaggcacatgtttattcaatgtccaccctctcacaagcagatatttaataattaaaaaaagaaaatctgcagcttgattatatgcttagccaagaaattcttttgcagttctaaggaaaatctccagcaaacccaattactctcccagcaatgcacttcaaaggagagcagaatgcatttcttgtacagaattcctggatatgtttgatcattagttagggcaagtagtttgacttgaggctatttactcagcaggaataaaaagtacagcattgcttcaaccaagaggagtgccccataccttccccaagcagaatttaataatttgatctgtcagaggaggtacagaggttggctatagaaatgagtcacgaccagtcagatttggctgacttgtgggccattaaaaatgttccttcccccaaacggcattttttaggaataataataacagaaacagttggcaccatgtaattgaccaagaacctgagaatttcacagcagtacttatcactgaaacagtttttgtttttttgagtctaagccaaatccacacttgagtatttttttaatttatccaggtgttctatggctaatatttatttcatctagcaagtgccacaaagtatttttgatgtagtcaaaaaaagtatttctgatgtagtttaaaaaagtatttttggtgtagtcaagaatataacatgatattattagactcctaattacaaatatttggtagagactatcagtttaagaaaaaattgcattaaaatgtcaacttttttctttttttgagacggagtctcgcactgcacactgtcacctgggctggagtgcagtgacgatctcggctcactgcaacctccacctcctgcattcaagtgattctcatgcctcagcctcctgagtagctggagttacaggcgcacgccaccatgcctggctaattttttgtatttttagtaaagatggggtttcaccatgttggtcaggctggaagttttttcgaaaactaaatatatatttcattatataaggtagactttacactttttgggaggaaaatgcacatcaccttttaattttttttttgagacggagtctccctctctcacccaggctggagtacagtggcacgatctcagctcaatgcaagctctgcctcccgggttcacgccactctcctgcctcagcctcctgagtagctgggaccacaggcgcccgccaccacgcctggctaattttttatatttttagtagagacagggttttgccgtgttagccaggatggtcttgatctcctgaccttgtgatccgcctgtctcggcctcccaaagtgctgggattacaggcgtgagccaccgcatccggccttaatatgtaatttttaagcactttaggttttaattaaattttatttcagttataaaaatgttcattaccatttggcatattcctcagctaaaataattaacaataattaaaattacccatgcttgattttcttatttcaatttttataaaagttatgccttcagtttatagaaaataaagaaacttatgtacacatcgatgctttagacaatatctatttttcaccatgaatatcactgaaagaaacaagtatcttttcatctttagacaaaagaaaaaaaagtactagtgtatcttttattattggttactttaaaaaaagagtaaaactacttctgtaacattaatttttaaaagttaattctcatattctaatgggagtgtaatgagtttttctcacagtgaactctaatgagtttaggaacgtgctgccatatttatggtagagactatgcaaattggactgatgtttatttatgcatttatttcatttgggaatctagttttcgaccttaagtttgctggagaatttgttacaggaaagaaagtgtatgaagaagtcttcttgtcccaggtgtggaattaaggtaaaattaacaaggaattgaagttatctttgatcatgatttttgattccatttttattcactttgaggaagtgttgcctgttttttttttttttttttttgatgttcagcagagcagtacaatgcaacacacagaagcataatgttgaattttcataataatgtttgtgatgcaaatgaggcacacttcaaaaagtagaatgattagcatttcttggtaagatgacagtccccccttttaaaaaaaaattgttcattagttttatcaatagattacatatccagatttcaattttgagtgcatactttttgcttataattataatgtgaatttaaatagttttagattgtgcatttaaaacaattcttctgtcactgtattatactctgaattaatgagctgtttgccacctcagagccctttgctttgaaattcagtccagtttaaagtgaactccaaccatttcaggccagcagctcacagaaggttgcaggattaatgagctccaggggctctgtggcttccttagaagcatttatcactaaattctattcttagggaatatcatccttatgcaagaagatggggagctgaatgtggaaaaatgctattcaaacaaataatttgataattgccaatgaagagtgttctttcttctcactacagatgaaatacaagagatgcagctaagaccagagcttttagtttctctaactggagtgaaattaaaattgatggatattttgataagattactaatgtaggtgaaacaatgcttccctatagcttgttctacaacactgtactcattcacttactggacttcctagggcttacttaaagaacttgtacacatccactgtcaaatatacttctgcatacatatactcttggatatcatagcctatttataaaactgtatctgtctccctagttatcctgtaggaatagctagtgttttctctccttttagatcttctcaaggcatcctctgagtttataaaacagagagtaatatgggtgagaaagttggcccttgctctttttttttctttgagtatgctgtttttatttaattctcacaatatctggagatagtaatttttaacataatgaaacagatttagagcaagtgcatgacaagtaaaaagcagggccggaatttgaatccacattcatttgactctaagcctgtactgtctgatatagcaagcacctgtagttattgaccacttgaaatgtggtgattgctgcttgttaaaatcataataatttcgatatattcatgcaaataaatatattactaaaattctacctagagaggcatttcctgggagctgacaatcccctttttaaaataatgattattaattttatgagtagattatataatcggattttcatcttgaaggcaaactgtttacctcttgggagagtttgtgtacctgaggttgtgccgtctaattagggcagcctgggccaaggatggtaaattcatggcaatcacatggatactccacatcctccggcagacatcacttatcggtcgtggcatttttctcacaggaacagcattctgtctcactgagacacagccttggaattcttctcagtactgttcattgatccaggcagcccccacctcttgactggagttggcaagtgagataaacatgttagctgactctcttctggtcagggctctttggcacagttaggtgctctgaccttttgaatagacctgcaaaatgcaagcctatcttcagctttcaattagatgttaggatatgaaaacatgggcatctttaaattgatgaaatattcagccacttcaggtctgtttcttcccagctaatcatgcttgtcatctacattttattccaccaactttattcaggttttacccctcacctcatgattgctttattgctagaatgtgaaaatatcttctatgcctaaattgatatccttgaattaaaggtgtgttgatgttgcgactctaacttcggtgtgctggggctgtcttgcagcagtagggagtgaagtctaggcctaccaagcattacgtgatgtccttcctcaagccctctctcagccaggcacagtggctcatgcctgtaatcctagcactttgggaggccgagacaggtgatcacttgaggtcaggagttcaaaaccagcctggccaacacggtgaaaccccgtctctactaaaaatacaaaaaattagccgagtgtggtggagggcgcctgtaatcccagccactcgggaggctaaggcaggagaatcgcttgaacctgggaggtggaggttgcagtgaactgagattgcgccagtgcactccaacctgggtggcagggcaagactttgtctcaaaataaatacatagataagtagtaactctcacatctaaagagcaagagcagactgtagcagataaatgtcccaataaaaataggctcctaacccttactctggcatttgtgtttcatcgtagcaaatttggatgcaagaaagctattgaaactgaatcttctcctacacctgaagagatctattacttcaatcactccaccgaaaaatctaccaaagattaagtatgtttctctattgtattcctgcaggttaggattgttacagatcacaatgacttaatgaaatctcaatacttgtggccaaaataacgtaggatggagagccatagtttaaaagtttgaaagctttgggggtcatctaggacactgaaattctgcttgcaacttgtttagctggaaaacaaaaagcatgaagataagactggaagatgaacatctcataccatcaatatatgggtgattagaagctctacaacaattctaaaacccagcctaataaagtatgaaacattctgaggaatgttcataaagatatgcaaatggactttgaaatggaaaaaatgcaaatcagttgaggtggcacaggcctaatttacccattctctctcagggaatatcagagcttcacacatttaacaggaaatgtacacatgctgacttccttcaggtgaaaaaaagattccacctgcaactagtattaaatatttgagatttgtttgccactgttgtatcacagatgcttcaactagagtgtttaattttcacacatataccatttaggagctgtttagtcctctccctaatgaaagagagatgggaaatccaggacaccccacacttactggtaggtttccaaatgttccgctcttagatgccactggtacctctaaataattcaaaatatcgaagagctgactccacacagcagaatgtgttttcttagttggaattaggtctataatcagacagagatgtcttattagtcagaatggaagacaacggactggtaaatattataatttgaaaatgttgatataaaagaagcctcaacataggaaaaggtgacatgaatgtcaatggcaattataatatataaaaaagataatagtgttttagagagtgatgaatagctgtgggaggaagagttgaggccagattttgcaacttctaattttttttttaaacctagcattgacagtacagtcctgaattgttgtgttgtgataggacataccttttgctattaaaaaataaggcctcatattattattaattttttttggccttctgcctaggaaaagaagtatgtctttggaaataaaaatacacaaagtaagttgtcattgagggaaagagttaaaaagaatcacttaccttttatgaattattttttaagactacacaggtgagttttttggttttggaaattcttgaacattttgatttcattcttcctggagagccaccgatactggaggctggacaccacataacaaattaaccgtcctctttcatttgtaacctccagggagataagatcagtttagttgctaatgaattttggtccccagcacagaacaattacaatggaatatgaggacggtttcaagagcatcaggaagattttaccaaattctatttaatctcctctcaccctgtttacaggtcagcttattaaagttgaaaattcctggtagatggtttccatggagagagaaaattatctctttagataaactattctagggttaatttgattcaaccaacatttatttagagtttcacatgtgaaacacaatactgtcttaggagctacagggatactaagatgaacgtggaaaaaaatgattgcccttaattaagttggcatgaagttcatgtacacaaagatgtacacggatctaggataaaatgtggcaagtactatcatgtaagtataaataaataaaaaattgtactcttcatacaaagtcttgtttgcccctcataacaaccctatttgaagagataattattcccatttcacagaaaacaaaacagtgtcataaagcagcacatctggtaagtaaagccaggacttgagcccacgctgtataccagccatcccacagagctttcttgatgctagggagaagccagtaataaagcatttcatagagaaggtggcatggtaatggaccttgaaagacaggtgtcatctcaaaaggtggccagaggggacatgtcagagagtcatgcatgaaagaggaaatttaagctttaaggacaggacagatgagacttccaaggggagagcagagattgggaagagcatctgaaagtgagccctctggaacactccatgagggatgggagcaggcgggaggaggaagcgcaggagccagctaaggagacagggaaagagcagtctggccgatgtgagatcatcttggacagcgaggtggccaagaaaccaaggtacaacagtgcagaaaatcaaagaggcccccacagtagtccgtttcagagagaaagatacacagagctaaaaggaccccaagagtcttcttgatctgggggtcactggtgactatagaaagaatagttttattagagtgatgataagccatagatcatgggaaaaattgcagtgggcaaaggatgaagtaaaaggggaagagggtgacatgaaagttgatcactgtttcaagaagtttagtagtggaggaaagagggaatagtggtattagttttgcacactcacaagcccaggtaggatcctcattttggagagcctctggtaacatctgataagcgagcaggccccttaggtggctctgtgacagagcttttgttctgaggatgccagcatgaggccacactttagtatcaagtcacaggacccctgcacctttgtgtgtcagcctgacctggggcataggactagagggcaatgggaaatcatacttgtccagttggaagcaaattttttgcagaaatttgctttcatggcttaacattcataatgccttaggttgggaaaccacccatgcccatttatgggccatggttaattctgttttattctgttcaacaaacttatccctaggtactctgtgtgaagccccactgtggctcggagtctacagcatgtttcaaagacgttgctgtcctcaagaaacataatctctttggggaagcaagaagcaaaagtagccctttactgtagtctgatgaatgttgccgtgtaggaatgggtgaagggcctggtcatagaaggacttacatatcacgcttggcactcagatcttactctgtagataatggggaaattctatagtgttttaataggaagcagcttcactgttttcatttattctcactgaggtgtgaacagtgtgtgtgtgtgtgtctgtgtgtgtgtgtgtgtgtgtgtgtgtataaatggggatagagaagcaagtttgtgacatataaagcaacagtctagataagaaaccttgaccttaattaggccagaggaagtgggtttggagagggcaggtgacacttgcttttgttagtgactgaattcactaacaaaaggggtgcggaagagttaggttgcataggtgcttcctgggttttttctggttgactggaaatgctttcatggcccgtcttcctgtctaaattaagatgttcatagatgttttaaaaatagggtggagtctggaggtagaagacaaagctgtataaagtcaaagtagggagaaaaaaaatgaagaaaggcaataaagagaaatagagacagccagtaattatttgctgtcacaacccattcttaggtcacctttcggtttcagttttccagcaatacttttctttttttctcctcttttcattattaaatgccttaagaaatgagtatgctgcatcgatagagttatgatggcttacatgagaagagcttctgagaagtgagttcctggaagcactgtggtggtggccaagtatttgcttataagattttatttgacatctataaggagaaatatacacaaacttttttgttttgttttgttttgttttgttttggtgctggaagtgggaaaagtaacaagaatttaatgagtaataaggaaatgtaagaggaaccattaaacataactatagttacatggaccctacttactccaagtgtattttagttagatttgggtgtattttgtgtctgttaaggcaggtgggcagtttgttcatttggctggaatcctggggcaattaggtcagcattaggggcttagtatttctgcaggccatttagttttaacctgctccatgaccccaggacactttctacctcatcattaccctgatttttgtccgtgagttcagggaggcaccaatcagagaatgtcgatagctttctagcacatccatcttcaccaggagaaagctgtggtcagataagtaggattcccctttacataaaaagaacagcctgttccatcgttagaaaaattagaaactgcggtgagaagtgcaataattagtgactactgaatgcttgttcttgaatttgctttataaaaaatgggatctgggagccttgttaattatatagctttgtaagaatagtttttctataactgtattagtatacttaatcaatgactcatagaatactggtaactaatagacctggacttaacgcctggaatgtcctactaagcatggtttggtgagctgtctactttgattctaggatagtttatgtttaattatgccacaacttgggcttatgctatgtcttgatgtaatgcaaataaaatagattatattttacactacaaagttcattaaaaaacaaaaacaaaatccttaagcttgtcactcaaaagtaaacatctgtatccaatgcaggaaagaatgcaggtttcgtggggactaaaacaacactaaggtgagctctctttaagaaaaagacaaatgggccgggcacgatggctcacgcctataatcctagcactttgggaggccgaggcgggtggatcacaaggccaggagatcgagaccatcctggctaacacggtgaaaccccatctctactaaaattacagaaaattagccgggtgtggtggtggacgcctgtagtcccagctactcgggaggctgaggcaggagaatggcgtgaacccggcagacggagcttgcagtgagccgagatcgcaccactgcactccagcctgggcgacagaatgagactccgtctcaaaaaaaaagacaaatgtacaatataaaattaagtataaagtggttatttaaattcagtctttcctgtaaggtgatggaattttcaaaaagtattaatagttgagaaaggtttttctccattttataactctcgattgataataacgtgtacatttttagaattgtggttaaacttgggaagacttctttaggcttctttcccgatgaactgcaagattttacagcatctcaaaatttctggtgcagggactaatcttaaatactttggaactggctgtcttcattaactagcttgttaccatagatttctcacatttgctaattaaaaaaatatgaccatatgaacacattgccaggaccccatccaagtccttaaaagggacctggcgggggaaggtccctgaagcttaagctccattgtttcatggtaaatttatctctgatctgacagcatcataattttccactgaatctgtccaaacagtattatactcaatagtccaacaaaacaacataacctttcatacttaatacaataagtcaattggggaagaattcagaattttagtgatcctaccaagttttttttttttttttttttttttttttttaataaggcacagctcaattcttatctcttggtttgactggcatacaatggcttattgtaagactattacgttaatatctttgtatcttttacaagctttaatttacccctgatagcatgaaacgagactaaattctcatataagaacatgaaaacatttttaaagatgttatctcttatggtatgtcttatagtccactgactagattagttgtaggcatctaaaataacaagtaatctcaacagatagtatatagttaaatagaaatatcgtatttctaagcaattaccttgtaaagagaacccttaacattttaaaatgttgttatttctaagcctaaaataaaatgcagcttgttatttaaaagatttcagaagagatataaagatcccattgcactttacatggctttgtgttaaatttatcaagatccattatattacatgaaacatacttagtttcattaaagatgcttgagcctctctcttttttatgcttcctgccccctctatgtacacaaattcagcaacctaatcatgttgcctttgatcaaattttatttgtatttttccccagtaatgctgtctggtggcagttaaatagaatttaattaaaataaatattcacatgctttaatagagattaatgatctgatttgacttagtaaaatttggcaaaaagtctagacgctgtaagatatacctatattacttgacttggataaaggtttaataaaacacagccagcattcaaaaaaagggagaaatggggaaatccagttataaaagctatctgagcatttagctagaactatgcatacacaaacacgccctattgaatttgtgtccacaataaaaattgggctgtttcttgtttttctattttattacaaccataaaatgaaagtgtgaataacaaggcaatccacttgttaagtggcaatttggattgacaagctattttcccaaatttaatttctggatctgtacttctcagcctttaatgtgaacatgaataacccaggggtggtgtgaaaatacagattcagattcagcaggttttggacaaagcccaagatactgtgttctaacaagatcccaggtagtgtccatgctgctggtgtgaggactgcaccttgagcagcaaggtcctagacagtgaagtgaagagactagatttgggatggttgccgccaccatcatcaccacaattgtatggataataatatgtaaatgaccccacctctcaaatatacagtcctttcacatatttccatcatctcattttggtcttcacaatatataatgtcacatgcgtatctcagcctgagtgccactgcttgtaaagccaattaattacataagaatattaaatttcagagtcttaacccatatagtccagcataaacaaagcatagctaggtttatctttccaaagggtattctccaaatcttgttattttctcactcaagattcatccagtggaatatctcctctgctccccaatcccataaaccgttatccctattctctctctgttctccaaggctgatcatctcactgtcctccacacagattagttttatttatgaatccaaattctgcacatgcagttgcctgaccaagaatgctcccacttatatctcctgctcttcatgaaatctggtaaactacttcctgcacacacaggcgttgaggggcctggccccttatcatctgacagacctgaacaaggtgaagacactctagagctgttggaattgttctcatgtatgctgggagatattttttagcttccttatgtgctgcattttaaaacaccctaacatttgtgcccattaactcccaagccctgtttcttttagataatgtatcaagcaaatttctatagttgaagttctgaagtgtgacaagggagccctgccttagcacacatgtccagatgttgacactacaagttataagcagccttcatttacaaaattcagacttaaaagccacgaagtgaataggtaattaatgcggaaagtggcaagatttgatttaaacagaaggagccattagacaattaaatactaatttaaaggaattctcacattaagttcaataaaattaaacattaataatgaacaattaatacctttgtggagttatttagtcaatagggaactgtgctttttttgtttgttttgttttgttttgttttgtttgagacaaagtctcactcttgtcgcccaggctggagtacagtggtgcgatctcggctctctgcaacctccgcctcccgggttcaagcgattctcctgcctcagcctcccgagtagctgggattacaggcgcctgccaccacgcatggctaatttttgtatttttagtagagactgggtttcaccatgttggccaggctggtctcatactcctgatctcaggtgatccgcctgcctccgccctccaaagtgctgggattacaggcgtgagccacagtgcctggccgaggaatgttttatataatagtcccacttgtaggatatttgttagaaagagagtcacatgatacatttttatcactcttatctgctacttagagatttggcacctatagcaaggtgataaatacgccccaagggtgcaactggaaaatgtggttaacccgatgcaggagtctgagtggaactctgaacaggatgagacaagccggcagtgacctgttgagcccttggaccccagaatttctcgggttattgtttctccgaacagccactcagaagagattctttgagttgatgcaaaaatctcaaaacttactgtgtgactttgtggtagaaaagaaaaaatgcaatttggatccagattacaaacttgattgtgaaaaacaaaaacaaaaacagatagtccttatgattttggaatgatacagttaagggtggtgtaggagatcaaataaattatcctttaacatccagactataagattttgacttctacctacccaaagcacttgggtcagtatacgttttagtgcactgatgcatccacttgcccgtgtgaatgcattaaggacaggatatcgtattcttctaagcaaaaagattgcagcatactctacgcacagcactgggtagaaatcccactattccacttcgtagcaatgcgactttaaacatgttttcaaacctgtgtgagccttagttcatctgtctgtaaaatggtgataatagtagtactcacctcaaaggttgttgtaaggattacatgagtaaagtgaaagttttgatttaggggaaaagaggcagaacatgaagtactaatttaaagaaatattcaggtaaagcctatgagattaagtagtcacgaatggttaatacttccatgcagtgccatctaatagggcttcactatgatgatgcaaaggcatgagaatgatataatggactctggggactcaaggggaaggttgggaggggggtgagcggtaaaagactacatattaggtgtagtatatcctgcttaggtgatggctgtggtgcactaaaatctcagaaattaccactaaagaacctatccgtgtaaccaaaaccacctgtaccccaaaaactattgaaattaaataaataaataaatagggttcactgccaagcaaatagaaagcattctataaatgttaattatagaaagtgttctatttaagtgttaattattataataatcatgattgctggtgtggaattaagaaaaaggcaagggctgcatctttagaaatgctttaattcatgtaaagtgcttaaaacagtgcctgtgtgcatgtgtgcttcataaatgctagtcgttgttattataagagttactatgatcatgctagtgctcatccttacctgacttctggagtacccatcatattcaatattccaaaagataaacacaatactatttgttggatatttatcttttaaggcaactattaaaccattggaatggtgattttctgagagattcttcttttttaaaccattgacaactttattctgctattgagattttttttcagagccaacatttctttcatttataattctactttggaaatgcaaatgttatccatttttccaatgcatagtttcaacttactagttagctctgtaaatatcatttatgagactgacccatgttagatctttgctatggtctgtggtttgcaataattgtcattctcagttcccttaagtactaaataggagaaaagacagtagaatgttaaatcaggacaggggtctttggaggtcactctgtccagcatcctgattttttagataaggagacatgacttgtccagtgtcacctagcagctcagaggcaaatccaggacaacattcttaaaggtcatacattgaccctctgttaaataagtgaacacataagtatatccattaatttcagattgttttaagaataaaaatcaaagttatataaggttcctgaataaatctcatagcaggagggagaccatgtgataaaaccttcaaaaaaatggaatatattgtctggttgcttcctgaattgtacaggttactatttcatttctgaatatggcctcaaataaattgaaaagtacatcccttaaatccttgtcaagtgcaaggtctgtgtcataaatgctttcaatattgagggggaacaggacaaaaatttaaggaaaagaatttatgcaaaagattgaatcaatgctttttttggataagcaaagcaatctgtgtgataattctactttcctcctcccctttgtgaagctgggtgggggtgggaggattagcaagaagggaggggcctaatttatggcgagagtgagaactcttttcaagcctgtgggcagaaaacaccgctgcacctccctcccggctggaacctgctctctgtgatctgggactcctccgggtctctgtttgcctaattgcaacttgtgcttatgccctccagttctcactggcccctttgatgcttttcagcaagtcctctgaaagcagcaggacaaaatgggaaggtaagcaatcctttcacataaaagagggcagcaaaacccaggtggaggtccctgctgagatgctcccttccaaggctgtgaccacacagcctaagcaaacactgtgactagtgccagcaaatgaaatttacagccctcttaacctgcaagccacagccagcatctcactccactctccaaaataaattcaacgtggctattttagaaaacatacttatcccaggttttccttttgggcatctaaggactgaattagatggtctccatctctaactacatccccattctggagactttaaaaaaaaaaaattgctttgtttatttatgtgttcatctcatgtttatcagttcagcagttcacagtttttattctgttatataacaaaggagcctaacaaaggatcacaataggaaaaataatttaccccacatggttacaatgaagagaatttaattaaaggaattgttacaaagtgtgggcagcattgagggaactgacacaagatgttgagccactcaaagactagcaactggtggaagccgttactacccacttaggcctacctaaatgggcaatgggaagataatgttaatggagcccagtgagctctagagcctcggaggaagggcatcctgcagagatgttgttctcagtcttgtctactcattggaatatcagggaaacatactaacagctgggttccacgtcctagagattttgacgtaatgacttttttttgtggtcatcaagacacagtcatagaaagacacagtcactgactaagagacagtggcaaagctaggaacaaacaggaaagaaataccctgaccttcctctcctactctctgatatcctgctgatgcctccaattagaagccagactatgagggagctgggggaatgcactctgcatggatcaacctcctgtagtctatgtagtggggaaaatgggtgaataaccagcacagagctcacaataaaccccacaaacagcctctgtccctcccacacacaaccccaggaattagaaggaagggcagactggcactttctcattaaggtaactcactcatgccatcttggcattgagctgggcacttttaggtggaatgacctcccgaagggctaaccccatctggcacctcttgacaacgttccttcttaatatcagtggctctcctgctgctggccaagcaggaccccaaggtccactgggatgtacatacttatggtattatgctctgcaatacttgtgggggctgtggaatgcacacttccaaagtgaaataggacattggaggttttatatataaatatatatatatatatttatatatatatttatatatatatatttatatatatttatatatatttatatatatatttatatatatataaatatatataaatatataaatatatataaatatatatttatacataaatatataaatatataatatatataaatatatattatacataaatatataaatatatataaatatatataaatatatatttatacataaatatataaatatatatatatataaatatatataaatatatatttatatattaatatatataaatatattactatgtatatttatatatatttatataaatatatataaatatatgtaaatatatatataaaaatatatattaatatataaaaatatatatataaatatatataaatatatatataaatatatataaatatatatatataaatatatataaatatatatataaatatatataaatatatatataaatatatataaatatatatatataaatatatataaatatatatataaatatatataaatatatatataaatataaatatatataaatatataaaaatatatatataaatataaatatatataaatatatatgtataaatatatatataaatataaatatatataaatatatatatataaatatatatataaatatatatatataaatatatatataaatatatataaatatatatataaatatatataaatatatatatatatatttttttttaatagagaggatgaagaccaaagcagtgagttccacctaagctggcccttgccttttgtctaacaggaaacccagtccttcctaatgggcacagaattttcagagaagagagcagaagttgagttggcatacctactgtagtgagggattttgaacaatgagctgtacattcctatatgggagccaaacttttagttaaatagtaatacaaaaatgctgatgtggatgccacggcttcctcctttcacacagaagatgggcagtgactacacatttaggttcaccttgcatgaagccacgctatagtttctaataaggtattattagtattcactagccattctccaagggttggcttcaaatgagatcagtaaagcagaagcaaatcacccacgggttctttcacagtttctttcaccctaagcctctcatttcactagacaactgtaggaagaaaaacgagatccctgaagggcagcaacttttcataaactgcacttgcagttttgccaatgcacatatctgtgggctcattgcacaggcagcgcttatatctatgggcacatttcacattgtagatttcttgtcctttctgattttctccccgatcacactgatacaggccacttccagtgcctctgtaaagctccaaggggtaaaggagggcaggggtgaggagtaaaggaacgattcttacaggtgttgtgaacacgactattttatatcaaatgcttctaattgaatagtttaacttaaaaacatgtatcacaaatacagtttgaccaactgtaacaatatcaaagcatattgaacaggaagtgaaagtctttgggtgtggatagagatttccagaaaaatatagttacataaatgtgagtttccaaattgtaaagaagaaaaaagacatatctggcttaatatatataacattaatatcatgcatagagattctattaataacatttgtcagccactattgctaagagctttacatccattttatcctcacatcaatactattaaagaggaactattattatcttcatacgatagatgaaaaaacaaaggctgtaagagtttaagaaacttgtccaaaatcatgtagctagaaagcggccaagccaggattcagaccttggttaacccacttacaaactctaaactcacttctccattgttaaacttgactagtgcattggcttacaatgaagtttgccatattcttccctcaaatctgtatttttaataagttgctaggtgatttttatggtcaggagaagtggggccatactacatgatgtaggctatttcctgagtatagataatttctttcttttcccttaggtgtccattttctaaaatgtggatgagaacactctctatgtgtcctgcaaaatttaaaaagtttccattttaaaatatgttttataaatactaaataacatgtccttttcttgctgcctaagacatgattattggtatgaaaatgctatgagaagtcctatagtaaagacatttttgtccagagaatctgacttttgtctttctccagagaaagcaacctgacttttgtcttttaccaaataatatctgtttgtgtatccttcagttgtgccctttggagagggctatttctccatgtaacttcatgcagttacaagtcctatgatagctttatatggatttataaatcagtaaatttttttatactgtaaaactttaattttaagatttcaatgtttttattcattttgaacatatagggtaataatatcttctgaagccaggcaaatctactattaaattttgctttctataaaaacatagttgttagataactaatactgtgcgaacaaatttcttttccctatagagaaatagtgagtgttgaaccgacggaccttgtctttagaataaaaagacttataaacacttgtaggccagctccatgagaatatgccagctggaggaattttagtgcttctaaagataactgagaaagcagtggctctgaaggttacctttttctgctaatggatgtttagatctaaaatcccagtttgctttaaaaaaaacagtagtatgttaagaaggtttctagacctgtgctatcagtgtcaatgtaagtcttataagttccctatgagaatgttaaatcacaagggcttagggtatataggagttaagtgatgctttcagttgatgttgaatttcatggtgactccagagtcacataatataggagcttccaagcttgacaaattgctcatatatacgtaggcagaagtggctgatcactacagtgctggtcctgggcctgtttggtttgtgtccattcttgtctttcccctactatgctgtatcacaggggaacatacctcccacaggctgcatttcccagcctcccatgtctgactgctaacagttgggtcaatggtaggcattgtcaggagattagagggcagaagaaaggagaagccagggaatttctgccttggcaacgtctctgcctccatgatgctatctcctgccagagaagcctaccaaggttccagcttactccatgtaaccctggtccctgtgctctggtgatgctacctcttctgtgtgccctttgtggtttcctgcctttggtaatccctaggttgactcactgctacttatttggcttttttttttctctcctattacctataaaccaacaccctgtgttaaattcccttaagttactcattggtttgtgttctcctggttgaaccctgattaatgaaatttccatttaaataccaaacgtttcctggagttcgttattctagtggaataacaaacaaccagctccatgaattgatggcttttcagaatttattgtctccacaatatttgtttcaaatcctcttttaataatcactattttaaaacttaattactactactattgataataataaatgtacccttaaatgtattatataccagatttggatttgcatctgtgtgtcatatgctcttagttcaactctttctttattgctcacctgaaataaagcttcttttgccagttctatttaattaaagattatcctgtgatgagaatgcaagcctaggttctgccttgatttatatggcactgctttttcttcaaacactaagtgatttgtagcaagttctcaaaaagatgtgcttgcaactttcattttctaaggaactggaaggcagccataattttctctttgaaagttccacctctgttagagtatgtatagaggtcaagttccaaaaatagcttcataatgtctgactcccctttaatgcagtttgattaatctttgtgtaggattcctggcaaatgataggcacaaaatgactatatatgaaatgaataaatgaatgaacaaataagtgaatatagcaactgtctctccatagttatgcatacaattagctattttttgactcaaaattaaccaggaaaaacttaagttatccttccacaaggtgaacttaactggatgtgtcttggtttgaaataccagcaaccagctgcatactgtaggagctatcagagcaaaactcaggtgttgacactaaagattaatgaaccacctttagttaattgatcacatccaaagtgcactcccttcagccttttgtctgtcagttggcagagggtccagcaggtagacacactccattgctcactgaaattaaaatttaggtaatttaaccttctcaatgctatagatgatgatttttttaagttgcagtggaaacaacagagcaatttctgggtgagtaggtcttcttggtgattcataatttagtagatgacatgttcaaatttattaagttggcctgagcataaaattgtccaggagaacaacagttaatctacaatgctgcagaggtatctttcaggaacaatacaatccccactactattacatattgggctttttaattttaggcttgcaggtaaagagtgagcttttcagtgtttgcttttcaatgatatacacgtgcaggagtaacaattctagtttttgaatgtgggtaggaaggcatgcctgagtgtttatccggggagtaagcaattttgtacatagaatgtaagttggataaatatgcatttgctttaggttaaggtgttaatgcaaccttgtcaagaagaataaatctgaaaagtggttaaatcaaagctatttgattttaaagaataaaagtaccatctttcaaacgatattatctttgtctaacagtaattttcccccctgcctgtaatttcagagctctgtgatgtggaagctgtcaatgttacgtaactgagagcaatctgacttctgtcattgtgtgcattcctcaaggatcgtgtttaggtggccctacttgatgcttttctaaaaagccccattctacttctaagtaaatactgagttcctggagaaacctgatgaaagaaggcataattttgatagctgctttgtaaatagtaggaataagtatgtggcattattttctttgagggagaagaaactttttatttgggtgcgattcatatgagaacatacttactgtagattttgaaccttgatactggcagtgtggattggcctgtaaattgatgcttttgtttctggctgaggaactgcaaatatgccaggtgacattctctttgaagtgtaaatgttgtttcagttgaattttttttctagtacacttggaaagtgagtttcatgcctatgaaagagtctggattctaataaacattattcctagacacaggaaagttgctataagcgatgggattttgaattctacatggattcctgtttaacaggtgacttcacaccttaaccttgaccagccttctatctacatctgccatgttgatttcttttgtatattcatttcttgttacttccagcggtaattacatttctaggatatattggtgtattttggttgtctccaagtccccttggattctgaggccaccattgtcctttctagacaaatggaatggcttaagcctccacacagtgcactttgggaggtcctggattgtacttgacatttccaaggtgtctaaaaagtctgatattgtggtgtcacctctttctccaaattcctgctcccagtttcatctttaatgaccgatggtcactttctgccctatcttgcaccatctgcctttaagacacccctaaggcttatacctcaatcacaactgatttttcctcaaagttcagtgaaggagagggcaatagagtgaagaatttgttgctgtcatccaaatataaaacaggaaacacattatattttaatataaaagcattattcctagaaacatattagccattctctgccaaaaggacattatcactgaccttatactttattaggcccccaaacccaaccatcttgagagggttccatctctctcccatatctttttcttttttctttctttctttttttttttaagagacaagttctctctttattgcccaggctggaatacagtggtgcaatcatggttcactgcagccttgaactccttggttcaagggatcctcctgcctcagccttttgagtagctgggactgcaggtgtgtgccaccacacctggctaatgtttcttattttttgtggagacagaatctcaaactctggagctcaaatgattctctcaccttggcctcccaaagtgctgggattacagacatgagccaccatgcctggcctcccatgtctcctgttccagattctagttccatactattggccactacaataagaaaatccttgttattttattaagcagatgacttgagctttcaaattctattccagcctagagtctagggcccaactttgcatactggactagaatcattaaggtgttttcccttttcccaaatgcaaatgtctttactttcacaaatggatcctcagtaccatcagaaaatttgaaattgctgtgttttcctttcaacatattacagatcacattctgatagctcctcctcaactcaataaagtaaacatcatggttacaggcagtgtgtgggtggtattggtatgtcgaaagtgggtgcagaatgagactgtatgtattgccatattgaactggagaagcaaaatatgttaaagcacctggatatctttctttgcatatctctcctgtggttcttggtcaaggactatcgttgatacaggaccagctatgtaagccggagggcacagtgcaaaattaaaatgtggggcccttgttcacaaattatcaggaactccaaaagatcacaacagagcactaaaaggtcacaacagagcaccaaaccttgagtggccctttctaagcacaggtcctgtgcaatagcacaggtcacatacccgtgaagccagtcctgtgttgatggttgttgttgagtgagattttaatacatgtatatttatagtctgagatgcatttgactgccacctttggagaaaatatgtgctagagtagaaaaaataatttgaatggcagtaacaaaagattggttgccttgagaagaacattcttttgtatccgttagagtttcatcagagaaacagaaacttctctagagtttaagttggaaggggttttatatatcaatgaagtatttctaaaactgttggaagtgttagaggatcaaagctcaaggaaagccgtcattagctttcagagaccctggaaagtgtaggaaacccacaaaatcattagtgatgtccaggcttcctgcagtgctgtgaaaggtgattttcaccaaagccgtggcgctgcctattcctgcacaggagcaatgggttgctgtcaacctctctccctctttctttatcttgcataaatcttcttgttgatgaaatttaaaatggtaaataagcatttaaggggatctgactgctacagctagatgggaaagccaaaccccttttctcaacaaggaataatttgaagaaattggattcttcattgttggtaaagtagtatctgccatttgcataaatatctaaattgtagagagcagccattattagttaaagtaaatgctacatgctataatagataaacactaaaatctcaatagcttaatacaatgagattttatgtctcgttcacctcaaatttaaagagcagctgggaagacggcagtaactgcaccatacaaccattcaggaaccagggctcatggaggctctgctattttttaagcttttattttagttcaggggtacatgtgcaagtttgtcatataggtagacttgtatcatgggagtttgctgtacagattattttgtcacccaggtattaagcctagtgcccattggtgatttttcctgatctctttctcttctcacactctaccctccgatatgccacagtgtgtgttgtttctctctttgtgtccatgtattctcatcatttagctcccacttataagtgagaatatgtggtatttattttctgttcctgtgttagtttgctaaggataatggcctccagctccatccatgtctctgcaaagaaaatggtctcatttctttatggctgcatagtattccatggtgtatatatgacacattatccagtctatcattgatgggtatctaggttgattctgtatctttgctatcatgaatagtgctacaatgaacatatgcatgcatgtgtctttatgatagaatgatttgtattcctttgggtatataaccagtaatagcactgctgagtcaaagggaatttctgtctttaagtcttcgaggaatccccactctgtcttccacagtggttgaactaatttacacttccactaacagtgtacaagtcttcctttttctcctcaacctcaccaggacctattattttttttttgactttttaataatgtccatcctgactggcatgagatgtatcttattgtggttttaatttgcatttccataatgatcagtgatgttgaggtttttttcatatgattgctggccatgtgtatgctttcttttgaaaagtgtctgttcatgtccttgcccactttttaatggggttgtttcgtttatttcttgtaaatgtatttaagttccttatagatgctggatattagacctttgtgagatgcatagttagcaaaaatgtcctcccatactgtaggttgtctgttcactttgttgatagattcctttgctgtgcagaagctctttagtttaattagatcacatttgtcaatttttgcttttgttgcaattgcttttagtgtcttcatcatgaaatctttgcccattcctatgtcctgaatggtactggtatacttgaaagagatagggggaatggaaccaacttggaaaacatatttcaatagatcaaccatgagaatttccccaacctagctaggaaggccaacaaattcaggaaatgtagagaaccccagtaagatacttcacaagaacatcatctccaaaacacataatcatcagcttctccaaggcagaaatgaaagaaaaaaatgttaaaggcagctaaagagaaaggttaggtcacctataaagggaagcccattagactaacagtggaccgctcggctgaaactcagcatacaagccagaagagattgagggccaatatttaacgttcttgaataaaagaaattccaacccaggatttcatatatggccaaactcaacttcataattgaaggagaaataagatccttttcagacaagtaaatgctaagggaattcagtgtcaccagacctaccttacaggagctcctgaaggaagcactaaatatggaaaggaaagactattattagccattacaaaaacacactgaagtacacaggccagtgacataataaaatgaccacataaacaagtctgaaaaataaccagctaacaacataatgacaggatcaaatatatacatgtgaatactaaccttgaatataagtgggctaaataccccaaatgaaaagccacagagtgtcaatctggataaagaaagaagatcatagatatgctatcttcaagagacccatctcacatgcagtgacacaaacgggttcaaaataaaaggatggagaaaaatctaccaagcaaatggaaaacagaaaaaagctggagttataatcccagtttctgacaaaatggactttaaaccaacaaagattaaaaaagaccaagaagggcattacataatggtaaagggttcaattcaggaagaagatctaactatgctaaatatatatgcacccgacacagtagcacccagattcataaagcaagttcttagagaccacagagatacttagagtcccacgcagtaatattgtgagactttagcactccactgacaatattcgacagatcactgagacaaaattaacaaagatattcagatctgaactcattactggatcaaatgaacctgatagacatctacagaactctccactctgccattttcaactcatggtttctgcagttgttgtgagcattgacactagttggcagaaagggaaagagggagagtggaggattttatggcaaatttttatgggctaaacctcagagtggcacttgtcactttttcccacattgctattgccaagttctggtcatatgaccccttctaattgcagaggaggctaggaaaattagctacgtgctcaggagggaaaaaaagggtaaacagctagacagtttctctcacatgatgtctgacagggatccaggttgcccttctaccatttcagtaatcagagagtcatcattcacgaggggaaaatggctagtggtatgaatagcttttggtattttattaaacctctttgcttctaagtttctagatctgtaaaatgagggtaagtgcatcttataggataattttgaggattttagatttgacacaagtaaaatggtttagtgtaatacctgaaaattagcaaaaaatataggaatattacccattatcattattattttcatcactaagtgacttagtttgttttcacactgtggtaaagaactgtccgagaactgggtaatttataaaggaaaggggtttaactgactcacagttcagtatggctggggaggcctcagggaacttacaatcatggctgaaggggaaggggaagcaaggtaccttctttacaaggcagcaggaaggagaatgaatgcaggaggaactaccaaacacttatgaagctatcagatctcctgagaactcactcactatcatgagaacagcataggggaaactgcccccaagattcagttacctcaacctggtctcccccttgacacatgaagaatatggagattacaattcaagatgagatttaggtgggaacacaaagcctgacaatatcacaaaaactctaagaaagggtagcatatttggaaataagttaatatatcaaatgtgctcaacgcatgcacagaatgtagtaaaagttcaatacatgtttttatcatctaaacttattgagtcttcctggtattatacttacatttattattatgactttctactcataagaacccctcagataaatttcattttcttttattaggtttctttttagaatattgtctgtctgcaactacagtcacttggatacatcactaggtttacatgtgttttaagtcgacttttgctagatgtagcttgatctttgaggctctgtgtaggcctttataaattgcccttcatttgtttattgagaattgaaatgaaaatggaatgctccagactcagatgatgggatttgaggtggaaaatctcattaatgcataaacatgtaaataaatcagttgtttctaaaaatttattcagggccgggtgcaatggctcacacctgtaatctcagcactttgggaagccgagacaggcagatcacctgaggtcaggagttcaagaccagcctggctaacataaaccctgtccctactaaaaatacaaaaattagccaggtgtggtggcgggcctctctaatcccagctactcaggaggctgatgcaggagaatcgcttgaacccaggaggcaggggttgcagtgagctgagactgcgccattgcactccagcctgggcaccaagaacaaaactctgtctcaaaataaataagtaaataaaaataaaataataaaatacaaatttattcaggatagcatattaaacattgattgatgttggtactttaacagataagaactattttaattttgtgttcaattgagtcaaccctaatttgtttagaaacttctggaattgaatgcaatctgttaaaagtaaagacgtgttaggccagataataatattgctttaagcttgcctatctctaacacttattaggagaatatatttatatctgtctttttaaagtaagtattgaaacagctttgtttaattctcttttggtaagaaagatttctttcataacatttgcataatttttaaaaaaataattgtacaaaaatcacagaaccagtaaagaaatatctgtgacttgagggtctcaggaaggcagtatcaaatggagattcatttatttatttatttatttatttatttatttattgaggtgctgtccttttttaagagtgtatttgttcctctttttgtaaactgcagacaacttgaactgatggtgaggtctggtaagaaaaaaaaaaaaaaaaattcaaagctaccaagggagaaaaggtgaatttcattggattactaaattcacaaacaaactttataggtcatcattgaacattttatttatattagaataagcaagcattgagcaagatagaaataattttgcttcaggttatcatcattgtgaactatcacaaggtataagcacagaaatgacagaagttctggcacagaacaaggaatttgcacatggtccaataacatgaacaaaaaaggttgtatttatttatttatttatttatttatttatttatttatttatttatttttgagacagagtctcactctgtttcccaggctggagtgcagtggtgcaatcttggctcactgcagcctccacctcctgggttcagatgatcctcatgcctcagccttctgagtagctgggattacaggtgtgcgccacaacccctggctaatttttgtatttttagtagagacagggtttcaccatgttgaccaggctggtctcaaactcctggcctcatatgatctgcctgccttggcctcccaaagtgctgggattgcaggcatgagccgctgcacctggccaaagtttcatatttcttgtgatgacactgaatttttagacaaaagagatatattgactttgtgtgttgatggtttcaatttagaaaagactatttgggctgggcgcagtggctcatgcctgtaatcctagcactttgggaggctgaggtgggcggatcacgaggtcaggagttcgagaccagcctagccaacatagtgaaaccccatctctactaaaaatacaaaaattagccaggcgtggtggcacgtgcctgtagttccaactacttgggaggctgtggcaggagaatagctttaacccaggaggtagaagatgcagtgagcccagactgtgccattgcactccagccttctagtctgggggacagagtgagactctgtctcaaaaaagactatttgggaatttgttcatcaaaatttatgcatccactttattttctcaaagttcctcttactggaaagcatttaagtattttgattctttttaaaaataatttcaacttttattttagatttggggggttcgttacatgggcatattgtgtgatgctgaggtttggggtacatattatcccatcacccaagtagtgagcttagtacccaataggtagtttttcagcctttactcttctttttctcccctctctagtggtcccaatgtctattatttccatctttatgtccatgtgtgcccagtgtttggctcacacttataagttggaacatgcagtattttgttttctgttcttgtgttcattcacttaggataatgacctctagttgcatccatgttgctaaaaaggatataattttattctttttcatggaggtatagtattccatgatgtatatttaccacgttttgtttattcagtcatctattgatggccacgtagatggattccatgtctttgctattgtgaatagaactatggtgaactttttggtataacaattattgtcctctggttatatatccagtattgggattgctgggtcaaattgtagttctgttttaaattatttgagaaatttttaaactgctttctacagtttagaaattgatctaatttacactcccaccaacaaagtataagcattctcttttctccacagcctcaccaacttctgttctgttttgacattttagtaatagtcattctgactggtgtgaaatggtatctcactgtggttttgatttgcatttctgtaataattagtgagggtgatctttttttcatattttttggctgctttatgtcttcttttgagaaatgtctgttcatgtcctcgtttcactttttaatagggttgttttttgcctgttcagttgtttaagttacttatagattgtggatattaagtttttgtttaatgcatactttgtgaatattttctcccattctgtaggttgtctgtttactctgttgatagcctcttttgttgtgcagaggtctttagtttaattaggtcccacttgtcaatttttgttttagtagcaattgcttttgaggacttagtcatgaattctttgccaaagccaatattcagaatggtattaccaaggttttcttctaggacttatagtttgaggtcttacacttaaatctttaatccatcttgagttactttttgtatatgatgaaaggtgggagtctagtttcattcttgtgcatatggctagccacttatcccagcaccatttattcggtagggaatcctttctcttaatggtttttgtcaactttgttgtatgtcaaatggttgtaggtgtgtggctgtgtttctgggttgtctgttttgtttcactggcctatgcatctgtttttgtaccagtaccatgctgttttggttactgtggtcttacaatatacttaaaagtcaggtaatgtgatgcctctgactttgttctttttgcttaggattgctttggctattcaggctcctttttggttttgtaagaattttagaatcagtttttctaattctgtgaaaaatgatgttgataatttgttaggaatagcagtgactgtgtttgggcagaatggccattttaaggatatatactcttccaatccatgagcatggaatgtttttccatctgtttgtgtcatctgtgattactttcagcaggcttttgtagttctccttgtagggatctttcacattttggttagctattttcctaggtattttatttttcaggtggctattttaagtaggattacattcttgatttggctctcaggttgaatattattagtgtgtagaaatgctactgatttttgtgcattgattttatatcctgaaactttgctaaagtcattgttcaattctaggagacttttggtggtgtttttagtgttttctaggtatagaatcttacatcagtgaagagagacattttgacttttttttcctatttggatgccttttatttctttctcttccctgatagctctggctaggactttcaatactatgttgaataggagtggtgagagagggcatccttgtcttgttcctcttcttaaggggaatgcttccagcttttgcccatttagtgtgacattggctgtgggtttgtcatagatggctcttgttattttggggtatgttccttcaatgcctagtttcttgaggtttttttgttttgttttgttttgttttatcgtgaagggatgttggattctattgaaagctatttttgcatctattgagaggatcatatggtttttgtttttagttctgtttgtgtggtgaatcacatttattcatttgcatatgttgtaccaccctttcctccctggaataaagcccatttgatcatggtgaattaacttttctgtatgctgctggattcagtttgctagcattttgatgaggatttttgtgtctacgttcatcagggatattggcttgtcgttttcttttctcactgtgtctttgccagaatttggtatcagagtgatgctggctccatagaaggagttagggaagagtcccttttcctcaagtttttagaatagttacactggctcttcttttgtacacaactttataaacatacctgtaagcgtaattttgcaaagatctttcattcatcaaagagaattcctttgtgaagtaaaatggtaaatagtctaagcatcttgctttcaacttgactcagagccaaatgtgtgtaagcattgagagggtttgccattttacattccttagtctgaagaagggaagaaagagaacatccttaaaccctaaaaatattacttggcctgtatggcatttgtacgcaaaggtagaatctgagaccttgcataagatttactggaaatgctacatctccatgaaagactacatcaagagtgtcaaagcatgattagttggggcacattcatatttttttgttagggagtctatgtcctctcttttatgtattgtttgacgtcagatgcctttaaagtaaaactataagaattattagtcatttgatgagaagtaataaatgttatatagagaaacattacaaaatagagatagactcaggataggggaccatagagcatacaaccatgaacacatatcatttgcttaaattagttaaaacacaaaagcaaaatatttgaaatagtcaaaagaacattttcaattctacctaataatttattggatgaattcttttatttttttaaatagtttactggccgagttgataatatgatctatcctagttattaaccagcagaattttaatttagttttcaaggttctccatggtctaaactcaacatgcccttccaggctcaaattacactcttccagttcaaaggcccatctgaaatgggctgcttctattatgttgcccaggctttcttatctctagctctttgccctgatacctttgtctttctacttggagtacctattctttccatctttaataccccaccttcattaaatgaccctttctaattacttcctgcatgcttcagccagatgtaatctcttctctctgattatcacataacactattttgtgcttctgtggttttcaccttactcatctctgttgtactgacaaatggactgtgagctccgtattttttatcttcacccttatgcattgcgtaattaaaaccttgtacacagtacaggttcagcaaacacacactgaataaattaataagtaggtgaatagttttgttgtttacattcactaacaacccattctgattcatgtttacatggacagaaaaagaatgagttgattattaactaaatttaatgtatgtcatctgtatacctaaattctttgggttaatattaaaaaagtattcttccaagttagcatgaatttgacctatcttttagagtgttcagattggttcactcatgttgacattagtcagttttgaaattcagacataaaggtatacacatatagatttgacatttgagattaacttacttttttccagttagattatggaagagataaacaatgactcagaggaaaatggagaggctatagaggtgaaatactgtaataatgtggctaaacttgcttgagagaagatgagacataagcctgctttgttagtcctttcatagagaaatgactcagcactgttagagaatatgatgaggttacattgttctttcatcacaaactgttgagttaatggtggcatatatagagtatagctctgattcataagacaattggtcattgtgcttctctctttttattttttaaagcaaattagtgctttaaaagagcatagtaatctggttcttttcatgaaaactgatgattaaaaacaaactacgaaaataattttaaatacacctgggtttccaaatggacagaggttgttgaaagtcatttttaagttccttcaaagctacaaagtctatgtgtttctcaaattatcttttgcaaatcttagtaggaattaaacttgtgcaaatccaacccctggctctttttagcctcgtgagagcagagtatgcatcgtgctttcgttttggatgagaaatatacaaactgtgtgttgactggtggaaagcagaacaatggatctcagcaaattgtatcatgcccagctctgacttgagacgcagaatcaattcattttcagtgtcatgacaggatctgagatagaagtgagtctcttgttgccatcatgagaaaagatacgtatgtccacagttttggggagagggagcatgggagctgggtgcttcactgccaacacagcctctgatcacctgatatgttacaaaatcaattttatcttctgctgcatttcatgtgacaattcaaagagcaacatttgtttttctactctttacattctcaacttccatggaggcataattgccatgagttaaagctaggaggagagtgatcactgcacactgatttggatataaaatctatggccatttgaaagggaaaccttcaagagcccacgtaataaatccccgaggaacttaagagagatgaactgtacctaattgcatctgacatggctaaaacacagggacctctctaaagagtgtgagggcaggtccccaaatcctctgctcagcactattcaaggttcagaagaattcatgcatttagcttatctacagctatgtggcaaaacacccttcagctgcagtcagcctccctctaatgaccaatgaggagaggccaaaaattaaagttgtataatcagagattttaaagacaaactgaaaagaactggtggaaccgtctaacttatgccttggaatggcatgcattattttgtatatgattttgggcctcagaacacaaacacaactccctccacaaaggggatgagtttgctgggccagagtggcctcttgttgctgggagctactgccgcccagcgtgggcagctgcaatcacagtgcccctatccctgcctgagtggtcctggagggttggagagctgcgtgactcctcaagacctttgtcactagcctgtgtaatgcctgtgcatgagtccttgaaagcaaatcccccaattagggcctacatggcctaccctgaggagggaagaggtgcaatacatgttgcttttaacaattcttcatcaggaatgagaggatgttgcaatggaaaggaaaatattaattcctgctaggcccttgtcagtgggatcttctcccattctcttcctgctggaattacagatccataggttttggagccagtcagcctgggttctttcatgcattcccttcttctggtgggcttgaccatactagatatcaaatactgtgactcaaagttctaccacctctgttgacttaaaggtcaaacctagaacaagccttggtctctaggtctaagaggcaaaataaaagctggtgaaccttcttactgacaaggcacttgacttccctgtgcctcagacttcaaatctataaaacgagactcactgttcttatctctgaggtttattgcttggaattgaatggggtaattcataaattccctagcctggcaccccacacacggcctcttcaagaagtttcggggtagctctcttgccagtcagctgagaaaaccaagcagtgagaagagggtcatatattgacttggttttcatgctgacaggctttggcatctcctcaagcttgtccatactctacagtggcattaagagagtagtgtcctgcacttgtgtttgagcactgtggaacattcctcaggagttctggctgagatgcatgtgccccaccttttcccagaaccagggccctctaagtctaagtcaataaagggaccaggggaagttcctggaaattctgatccaattcaagtccctgctacctaggtttacctcttgcctggcctgtctccccctaatttctcaggagtagacttctatttgtatagtgtttatatgggccaacatttgcatatgttcacgcatgttatcttcacagcaattctaaaaagacaattaactcttgttatgtctgtttataaaagaggaaattgaggcacagaaatgtcaagtcacatgaacaaatccctacaggaaccatctttaataagtgtcaaagtaaggagtcaagctcaggcagtcatgcccttatcccacaaattttgagattctgccatagccaggtttatgccttgcttctcacttgtgatggactttccagagcttggcccagtcactgaaacatggcaaacattgtcaatatttgatgagtaaagacatgaatgaatgatgcttttgcaactatcccattccctgtgcactcactgaatttttcttcccctttttatcatcgcagtgtttgaaaattttacttccttattttactagatatatctttgtctttacatgtgtcatctctcaaccagatgtaaaaggtacttccctgaagggaagaagcatgttttatacctgttatgtaacctccgtaagaatagctgaatactcagtttgtgacacacaaaaaccctaaaataactatctaaatagattgggaagttgggttgttgagatacagaagatttactcttcttcccaactcatcccttctctttgctccttccaataaaatgctatttggttgaatagtttaaagatggaaaaccatttaaggttaaaacagatgaataagatcattctaaagaagcagaaaggcgttcagaccgttaagttgaatagatcagagtacggcattgattctggctgtaagatttcaggtcaccaaaggaaatatgttggattgcattatctccattttttttaaaaataaagtttagatcgctccctgaagataaaattactcttggaactatattcaagaaggacttaagtatgtagaccttatgtaacagatgtaagaaacaattccaccaatgctgatattatggagacaccaacatgccctcttacataagccataaaagtggtgagaatggccacatttttgtgatggggtgtttggaattaattcatcttcatgaaacagaggccacatcatattcttggtcatgagtaatgatggtaatactgtttctctttcctttgaatcacttacctatccattgacctaacatgttttaaataccacaaaggagtaagattctctctcatgtctttgggtagagaaatatgcaacaacccatttcctaaaaagtctgtaattacatgtgggaaatgctggtaattaatagcctgaatgggtgattctaagttagattcatgaaaaaccaagagacatatctaacctttcttaagctccagggcacatgcataatttgaacattatgtctacaatgtgggtgtattttcttccttttcaatgaagacagtgattaggatgataatagaaataatacttgggtttatagagcctttagctgaagtctacctacatggtttctggctctgtggtaagcatgtcggactaatgtcagcttttgaagtgaatttttcatgcctttttccctctgggcttcccctttctctaataaaactactttaatcccattcacattccagttctgaatactagcacttgaaatgaactgtctatatctgactcacttaaaaaaaaaagtagtttaaataaaaacaaagagttgtttactttcctttcctacctggctgcatctgtcacatgcatatagtgtcccctgacatgaagctctgatattgatctggagccttattgatctccaacttaatatagggacaatgtctaccaataacttaggcacttccagagaggctcactctgtcttcttttgttcacttacaaaatgaaaagaatgtctttactagagtacctattaaagggttccagtacaccctaccacaagctcaactttggaatctgataaaatattttttaagcaagcttctggttttgttatattaatttgggattggattccctccagtggttcaaacaaaatgaaagtatgatctttaagtatgtaatatattctgtcagttctctggttagtttggatcagaattaactcctttcaggatcatcccaaaataacagtgtaaccccatagtaaagcacactctcttctttcctgtgatatcccatggagtaggaataattaggcaaccacaactgcttaaccctgtgtggtttcacacagaaaaatcatgacaatttctcttcttgttgactctttctcatttttctggttatccatagcttttaacaacaaaccaccctaaaagttattggcttaaaacaattgcaattatttatttggttcacaaatctgcagtttgggcagggctcagcagaaaaggcttgactgtgctccaggtggtgtgagctgtggtggctcaagtgggctgaagtatctattttcaagatatcttaccaacatggctggtgctggctgtttcctgggaactctactgggtctgttgtatggggtcattgattctttggatccaagataccacagctagaaactgccactctttttcagtctggtacagcatcacttctgcgatattttgttggacaaagaagtcacaaattctgcccaaatttaagaggaagggacataggacctgtaaagcaaaataaaatgttaagcccccaaccaactaaatggatccccctcacaaccaagagcattccaaagttaacctgaaacatgagttcaggccatgatgggaatggatagtcagacatgcctcattataccatcctccctttggaattgaggcacaactgaccagcgttaatattgaaacagaaacgttaaaacaatctgttctctctgaagcctggaggcttcatctgtgtaataaaaaccttggtctccacaaccctttactttaacccagacactcccttctattcattccaggtatttatcaagagcccatctaattgccagtcagaaaatctttgaatccacctatgacctgaaagcactgatcccctactgacccaacttccatttgtcctgcctttccaggacatggaacatacatcttaatgtcaaaggcatgtccttaaccttggcaaagcaaacttctaaactgattgagaactgtctcagatactttttggtttacaaaccctacctgtcattgagaggagtgtcaaaaaattgggccatgtttatactacatgctctttaattaatatctgtctgatactactaatatctgatactatagttacccaagccagaaactcagtcatcacctttgaccctttcttctctcttatctttctcttcttgacccaccctagaaatacatgtaatctttattgcatataattaataattctgtgacttaatcagatattattgtatcatatacataaataccaattacaaagtcttctaattgaccctagaatcttctgcttctcttgagtgccatcacctctactctggtacacacatcatccctcctctacctactagccagtctctctgcctccagccttacccctttttactctagtcatgatgattttatttttagttagaaagaataactgtcctctgattataatttctcaaacatcctctattgctgtaagagtaaagtgcaaatttgtttgcctggcttccaaggccctgcaggatggggtcccagcctccttcactagccacaccttgttatctcctattgaacctttggcccttagccttcagctttaccaaaatcttgatgtactccaaatctcttcctttgaaatgctctttcctgttcctcttccttcttaccatcctccattccctttgctgggataattcagtcgcattctttagatttcaagttagttttcaattgctcacttcctctgggaagaattttatgacccttcattcatttattcattcacagagtattcattgagtatctacaatgtgccaggcactgttccaggccctggagatactacagtgagcaaaataaataaaagagccttttgtcatgggatttatccttctcatggaaaagtcaggcaataaacaagaaaataggtaaattacatagtatgttagataatgataacagctgagcacaaataaatgtgaagcaggatgggcaatataaaatgttggagggtggggatgttgcagttttggcaaaatccaggtaaggccccactgggcaggtgtcataaagtcaaggcttgattgaagtgaggggtctagctatgaggctgtctgggagaatactattccagatagaggaaacagcaagtgcaaaggccctgagataggtatgggccactgtgtttaaggcgtggaagggccagagtggctggagtgaactaagaggaaagcagaagaagagaagatgaggtcagataggtgatggagccctgctcgcagaaagtcctgttggttgctgtaaggactttggctttggtcataagtaaggtgggaaggaagcattgggaaagtttgagaagaggagtgacctgctctggtttatcatttaagggatccccttcacatcccaaatcctcccacattagccccttctcccatcatttagctttttacctgtgctataacttggttctatcccttactagtatctcatttctgggaggagaggactctgtccaacttgttagtgttttattccctccatctagcccaatgtccaggaaccatagggtatcaataagtatgattgcattgaaataatgagtaaatgaaagccagctcccgtgctaatctttaactttttaattactacaacttctttatattggttgtagtaaacccaaaatacaaatgaggaaatgaagtaagaacagaaagtgacagagagagaaaatgggaagagaagaaataaaattcttggagccatcatggcagccttctttaagctaagaaacccaggttctcattccgacattggcgtctctagtggggaattttagggctgtctgtgggaccacaagatgatcatacacttctctgaaaataaatgttcatagtgaatgcttttttgatttttggcagaggatgggaggcacttccattttggcccattatgagaataacaagacaaaatagccatatcatagtatatttattacaaaaattcatgtcctacctggctgtatgtgtgcatacatgtgtgcatgtgtgtctgcaaaggcttcatactagtccacatgtatttatcagtgtggactctatgctgaactaatgctagggatggagatgtcctgccctcaatggactcaacaggggctacacaaatcaagagcggtatagtgagtaatatggtgaggaaataaatacctcttctaagaagcaaatagacttgaatatattagatagaaaaatatactaatgcctgcactgaatatgtgattagctttttttgtttttttttttttttgactgtctcactctgtaacccaggctcaagtgcagtggcatgatgtcggctcagtgcaacctctgcctctaagggtcaagtgatcctcctgcctcagcctcctgggtagctgggagtacaggcacacccagctaattcttgtattttattttttgtggagacggcgtttcaccatgttgcccaggctggtctcaaactcctgtgttcaagcaatccatccacctcagcctcccagagtgctgagattacagatgtgagccaccgtggctggccatgttgagcatttcttgaaaaatagcagaaacaattgcttccttaccaaaatggtatttttcatttttggtttaatgggtaagactggagaaggagacacttggccactatttggagtatcacaattggacttgtctcgtgatgtcacaaaatattcaaactggaagaaaagcattaaaaaaaaaaaaaaacctgtgttcagctcttttgtttaaactataaagaaaaatgtggcccaaagagactgggtgttgccaaaaattgcacataggaagaacagagagggaaaaccaggcctctgagcctgggaccagtcacatgatgacattttgttacctaagtcaaaaagagaatgacagtcttctccacaggagtactttgggattagttagtgggtggtctcattacccataagcccctgcctttattggttggttttttctcactccatctagacacgctgttatcagtcctggagcctgagtacactgtgatggcttcatgttgtcagctgcgttttctcatgccctacactgcagactgaaaaaggatgctccacagccagctttaacaccatgcaccaagcctgccacagccatcctctcttctgctccaagctgctgagagacaggaaatggaggttctgagttttgaggcttgcagggtttgtctgcactgcattcagcttgccagtccccaggagagctggcatgctgcttcagatccagaaagaaaaggagagtgccaatcagatatatacacttctgtaaatctccagttagttccagagctgtcatttgcctgtagaaattttaccacgtttacatgactgacccagacagcaagagctagtgatgcccctctgttgtaactacatggccagagggacatgcaacccaattaaataaaattaattttaagcacacatcctgatttggagaagcatttggacaataacatagtgtcagtgtgagtcacttatcctaaacagttttattgttgtgaccctgatttggacatcgctatggttgctgtgcatgataaacttgaaccatgttttgcgcttaagttttaaagaactgtaatttaaaacatgtataacaaaacaatctatgaataaatgagatctttccaaattagatatctcctttggtagcatgatgagtaattctttccagtatcataacattgagggtctctgagagtctccttattaaataataatccttcttcatagagggttttgcatgaattttgggagaaaagctatttacctacttaatcttaaacaaaaggcatcacttccctgctttctgtgtgatcactgctgcatgtgtttgcatgtgtaaactgtggtggctttacatcatcttatactatggatttttttccatatacagcagtatgaatagaaacaatttttgcagaatttcatgaattataactaaggctaaaagcatggatactgttttccatctcatgctgttatgttccttgccttattttgtttatgtaataaacatttattcagtgtatactactggccaaaggttgttgtaggcactgaggatatatcggtaaacaaaacaggagaagatctctgccctcatgaaacttatattttagcagggaggtaggggcaggtgatgcatgcaataagcaattatcataaatatttacataattaaaattacatagaatgcttgaaactaactacagctgtaaatggagaaaaaaaggagagcaaactaaaggggaagtggttaaatctaggattcaataagaaatagaggggtcaggaaagcccttattgagaagaagagattttagcaatgacttaaaagagataaaggaatgaaacaagcagatatgctggggaaagatcctatccggcataggaatcagctaaagtgaggaccgtaaggaggtaatcttcagccagggaagtcccaggagataattgtggataaatcaaatgagcagagggaagataaatgcagctagaaaaggtagctgtttagggtcagagaaagggctatgggcagattatgtagggccttggaggcagctgtaagacatctgggtttaattcgaagtgaattgggaagccagtgcagttgtttgagaaaaggaatggtgtgattcaatttaagtttctaaaagattaagctagtgaatcttttagccagagtaatctgtatggggaggatgacatggcatagcaaggaaagaaacagtagcctactgcaataatctgggagacagctggttgcctcagtcaagatggcagcttgcagtagaagtgataaaaggagtacagactttgtatatattttgaagatagaaccaacagggagaatttaagaatgactccaagggtttctgtctgagcaactggaaggatgtaatcgcttccagctgttatggaaatggaagcaggttttgttggggagaatgaagaatttaagtttgaacgtgtcaagtggaagatatataagtcaggagagagatctgggcaagagatacaacttgagagttgttggtaagtaggaggtatttcaagtcatgaggatagatgcaaactccaaaggagtgagtatagatagaaaagaggatggaggtctgagccttggtccattcccccagtaagaggtaagggatatggacaggaaccagagaaagaggctaagaagatatgaccagtgatggaggaagaaaaccaagagaagatgctatcttggtgaagaaagtactttgatgagggggagagcttcatggtgtcgaggtctgttgaaaggggctgggtgcagtggctcatgcctgtaattccagcaatttggaagaacaagataggagaatctcttgaggccagtagtttgtgaccagcctgggcaacatagtgagacccccatctctatttaaaaaatagccaggcatggtggcacattcctgtcatcccaattactcaggaggctgagataggaggattacgtgagcccagaagtttgaggttgccatgagctagggccactgcactccaggctacaaaataaggccctgtccaaaaacagaaaaaaaaaaataataaaaattaaaaaaaaaagaaagaaggaaagaaattctgttgaaaggtaaaaagctgaggactgagaatgacaaccagatttagcaacatggaggtcatgggtggattgctggcagcaatttgaatgtcatgatggaaatcaaatcctgactggacaaatagggatcttctttctctttttccttccttccttccttccttccttccttccttccttcctccctccctccctcccttcctaccttccttccttcctaccttccttttcctcctttccttcttcttcctcttccccttccttttctccttccttctttcctttttgtgccattgaactaaaaacccatacttggatattgttgacagtatgattttaatgaatccctttgggaatttttttaaactcttggaagattttcacttatttgatctgtccctaacattccaaaactggcatgaattttaattatcctgagatttcacttgggaataaaatggccaagataacagataagcactttagaaaatcattagcttattttaggccattacattatatcttcttacactgaatatgaggaaaaaagtattagtaacttattttatcatgtcttggtaattgaaagtaagtcacatattcttctcaaagtacatccagggtttacattgtctgttatgtatgcatggcttccctaacaagataataaattcttggaagataacaaccagaccttctatttttaataatatcttttgtgcccagccatgtcttgtacatagtcggtatgcaataaatatgtgttggtttcattttctatgctcattctgtctgatcctgccttcttatatacaagcctcattcagtaatgggaggatagtaatagaaaacagagggaacagtgctaatactgctagaacttgtaggctttgaagactttacaattttgttaggaagagaatagagatgtatttgagaaattcagtagcaaaaaaagaaccatatatagcaacaataaaagatgggctcatgattagtgaccaaatgaaatctgtaggtaatatatttttaaagggtcctgtgctggttggagaaacagacactgagaaaattattcttaaaatactctcctgtcctcccctctctcctcatcaataagatgaatatatgtttatagaaaaattagttaacattatattatgaaaaactttgactattcaatgattttaaacataatttccaatggatttagagtattctatcatgtgactgtatcataatctatttactctcctggattgaaggtttcgatagttgtcctttctttttcatgacataccaaactaagatgaacatcatttattgccatgtctttttgcatattcaatagttatttctttatattaaatttctaaatgtgggctggcatggtggctcacgcctataatcccagcactttgggaggccgaggcagatggatcacttgaggtcaggagttcgagaccagtctggccaacatggtgaaaccacatctctactaaaaattcaaaaaaaattagccgggcttggtggtgcacgcctgtaatcccagctactcaggaggctgagacacgagaatcacttaaacccaggaggtggaggtggcagtgacattgcactccagcctcggcaatagagtgagactccatctcaaaaaaacaaaaaatctaatgtagaattataatattaaaagattgacatacctggagaattgtttttaattgtggtgaaaacatacaatgtaacatttagcatcttaaccattttaaatggaagtttagtgatattaactatattcacgttgttatgcaatagatctctagaactttttcatatgtgaaactgaaactctgtctccattgaacaacaacttgccatttcccttccccttagctcctggtaaccacaattctttctggagtgcaatggcataatctcagctcactgcagcctctgcctcctgggctcaagtaattctcctgcctcagcctcgtgagtagctgggactacaggtgtatgccaccactccccgctaatttttgtatttttagtagagacgggattagaacatgttgccaaggctggtctggaactcttaggctcaagcaatcctcctgccttggcttcccaaagtgctgggattagagttttgagccaccacgcccagcccatgattctactttctgtttgtatgagtttgattactttagataccatttatgaggggaattatacaatagttaccttttgtgactggcttatttctcttagcataatgtcttcaaggtttagccatattatagagtgtgataggaattcttcttttttaaggctgaataatatatctctttgtatgtatataccacatattgtttatccatttatcttttgatgaacatttgggttacttccaccccttggttcttgtgaataatgctgtagtgaacatggatgtgcagatatctcttggagaccctgctatcaattcttttcattatacgcccagaagtggaattgctgggtcatatggtgattccatgtttaatttttttgaggaaatttaatactgtttttgatagtggctaacactattttacattcccaataacaatgtacatcttcactaacacttgttactttccgttttttgataatagccatcctaatgaatgtgatatgcatacacggctttaaaaaaacttgtttcttcagaatatttgcatatggagattagcatatattatttacctttaatattatatattttgtccttgcttatttgatagataaaaaataatttgtatttatttgactactagtaaaatttaatatttttaatacttggttactagccagtttatatttttcttttgtgatttgtaagttcataatctatacctcattttgtattgggttttctccacccttcttatttatttataagagctattaatataatacattatccttttatcttttatttatttatttttaagacagagcctcgctctgttgcccaggctggaatgcagtggcacaaacacagctctctatagccttgacctcctggactcaagcaatcctcttgcctcagcctcccaagtagctggtaccacaggcttgtaccaccatttctggcaaattattaaatttttatgtagagatagggactcaccatctcgcccaggctggtctcaaactcctcagctcaagcaatcctcttgccttgacttcctaaagtgctgaggttacaagcatgagccaccatgtctggctgttatttcatgtttttttacaaacattattttcatgtttcagatacatttcaactttgtttattgcaatttttgcttctataatactgatagaatcaaactgaaacttaagactattttatttctcatttacccctactttttttttgtttgttttgttttttgagatggagtctcactctgccgcccaggctggagtgcagtgacgtgatctcggctcactgcaagctctgcctcctgggttcacaccattctcctgcctcagcctcccgagtagctaggactacaggtgcccaccaccacgtccggctaatgtttttatatttttagtagagatggggtttcaccatgttagccaggatggtctcgatctcatgatccacccgcctcagcctcccaaagtgctgggattacaggcatgagccactgtgcctggcttttacctctacttttatatgaagaaaatccatgctcatgtaatagccaaatacagtcaaattcatttttctctagtgttaatatttcagtcaaattctaatgcattaggaatttgttaatattgcatttaatattatttttccccaatctttttttatttgaaaaatattataatccagtcaaatagcaaataacataacaaaatgagaatttcttaccaaggattaattcatattaacattttatcatattgatttcagatcttgtgtgtgtgtgatgtttactgataaattttgtgtccttgtacagcttttgtggatcagggacaaggggagcatgttgccgaacaaaaatatattaacatgtttgggactaatgcacactgattttcacagaaagtaactgattgattgcaatcaagtatgggagactagagggtggcaagagttttgataaaattcagttcaataaacttgtgaatttaagagcatagagattctattaacgagaatgaatagaagaagatttagacatggtgatttaaaggggatatcaagttagtgttgaagagtaaccatctcaggaaaacagtaggaattagagccagttctgagaatattctgtgtgagatctatggaaataaaaaagctaggaagggaaaagcttaaaggaatgtgtgttgggaagtgcttatagaagagagcaagcaaagtgccttcctgttgtcgtttagacttttccttaatctgcattcctgcagttaggtttactgagctctatggcctgagttattgctcttctatgtagttccagattaagggttaagaattctagtagagcaggagtatttctggaaaagatggttggggggcaagtatagggatggggagaagcggagggcttactctccacctcccaaaattttcatggaaatgacattcagtaaaagtaaatatccatataacaatggtggtggaaaggaaaatgtaggggtagatggcttttgcggatcaggaacaaagggtatcataatgctaaataaaaatatgttaacatgtattggactaaggcacactgatttccagatggtgtttacatctgaggaagaggaaatggggaaaaggtggggaggtagcctctttataagaatcttcaatgttttattaattaatatttctaaaagataactctttttgaaaagagaaaagataaaaatattatcatccattaaatgtgggtagtgattaacttattatctcaggttaggttcctttctagttgagatttttataattaaatttttagataagagtcagaaaatttaggataataaccttggatgacaaaggaagaaagttttaggatattttaaatattagtgaaattccaaataaatttaagctgagagctcactggttaccatatatgtttctctttaacacaagaaattggaaatgcgttaggtcaattcaacaagtaacatttggaaataggccgggtgctgtggctcacgcctataatcccagcactttgggaggccgaggcgggcagatcacgaggccaggagttcgagaccagcctggccaacatggtgaaaccccatttctactaaaaatacaaaaattagctgggcgtggtggtgggcgcctgtaataccagctactcaggaggctgaggcaggacaattgcttgaactttggaggcagaggttgcagtgagcagagattgcaccactgcacttcagcctgggcgacagagcgcaactctatctcaaaaaaataaataaataaaattaaaaaaaattggaaataacatatttgctattaatatcttaaaggaggtatttgtgttgaattctttgtcttagtcattatccttgcttttaaaaaaaatgttagaattcctttttctcaaaattctgaatgtgctgtgtttaacagcgtagttacagttctgaaagggtagtagatttctccccttgtctatttgtttgcagcaggtcatgaactcagaccttttctcttcagtgctttgcttctgaactacttattctgataccctcctcacctgaggaaacagagcctaagaaggttctccttatatggattcaggtagatgagtttccataaaaaaaaaaaaatgacatcaagcattgatctgcctgaataaagcaattctaccagttatatggcatttggtgcttcctgtgaattgatacaaacttcattaaagaaaatgacagatggcatatggctgcaggcaaaatgccagtccacatgatgaatcctaccatactctagtccagtataaacaatgtttttaatcaccttcaaaaaactgttgcattaatttgtctacagtaaccaggtaattataaatgtgtagctagttccttattatcttaaaaaaataaaaataaaagttagcaactaataggcatttagcttgagtttatattatagatggccaaaggagattttatggcccaaaatggacatggtgaggtctgcatgtgaacgatgttacagtagactaaccacagagcctggagttcctgcacttttcttgatttgtttggaatattactttgagaattggaaggcctggggtacgaaaaatgattataagatttttctttgtttgacaagataagcaggtctgtgtgaggcagatactttctatggactgactgcagacaggtttcagtcacagactcaggttttatggcattctctttgaaggtgggtgtctaatgtaactgaattttagggggataattacagtcttatcaaattctgagatgaacttcatcacttatttaaaaaaaatttcctgtcaattagttcttataataatatacttttctggtcaattttacatgcagaatttggtgaaataaagaaacataaatagataaaaaataaatattttaatgatgcccaaataaaatttagatgtgtaaggactaaaaatgatttttaaaatagttgtataatagaactacatcttagtttcagcacatggaatttatatagttcattttagttagtgcttcatttcaggctgctttttttcaaacaacagaaattgactttggctcatttaaatggaagaatgttttagaaagttattcactgatggggcagaaaggcagaagaaccaagcatgaatcaggttccataaagtttcaagctgctgtaacagaataccatagactaggtggcatataaaaaacaaatttatttcccaccattctggaggctgggaagtccaagaacaaggtgctgacatatttagtgtcagtgagggtgctcttcttcatagatggccgtcttctcattgtaccctcacatgcccaaagtggccaacacctctcttaagcttctttttaaaggcactaatccctttcatgagaagtctgccctcatgaaccaatcatctcccagagaccatacctcttaatagcatcatcttgggaggtaggatttcaacatatgaattttgaggggaaacaaacattcaactcatagcagataacaaggcagtaaaacaattagccaacactttataaaaatcttcaatgttttattaattaatatttttaaaagataactctttttgaaaagagaaaagataaaaatattatcatccattaaatgtgggtagtgattaacttattacctcaggttaggttcctttctagttgagatttttataattaaacaaatttctagataagagtcagaaaatttaggataataaccttggatgacaaaggaagaaagttttaggatattttaaatattagtgaaattccaaataaatttaagcttagagctcactggttaccatatatgtttctctttaacacaagaaattggaaaaaatgagttaggtcaattcaactaataacatttggaaataggccaggtgccgtggctcacgcgtataatcccagcactttgggaggccgaggcgggcagatcacgaggccaggagttcgagaccagcctggccaacatggtgaaaccccgtctctacaaaaattacaaaattatgaaaattaaaaaatttcaaaaaaatacaaaaattagctgggctatagtctgggtagggcatttggtactggtcccaactccactgggcactcttgcctgtgctggaattatcctactgccacagataatgtctcaactgtcctcacatctttgtaccattctccagagattcaacgttctaagcagaaacctttagctggctgagtttaggtgatgtaccagttctctaactgcctaatccattggcttctgaatgagaggtgaggccctccctcccaacaaataggaagtagtatcattgttggacaaccaaaggcaacgaccagatgggaactaataaagctgtatgacactaaaaattcttcattaaatcatgcctttttttctagtatttttctctttgtttttgatagccaaaaacatatgtagcaaataatgccattgtcaacatgactaactccaacacttagttatagttgttacttttcagcccatggtgttttctgctgtgacaaaggcagagttgttgttcctgaactgcacatctgcctccttttcttgtacacacttctgatattttcaagtttaggagaaagcaggcatttgccttacgtctcaactcatattttaaaatcagtgtcactttcctctgcttattttgctatgcttttttagtgaataaatatttaccgaagacttctgcattagtttgcccgggttgccataacaaagcaccacacactgagtggattaaacatcagaaatatagcgtctcacagttctgaagggtagaggcctgagatcaaggtgctgggtttgcttttttctgtgggccgtaaggaagaatttgttccatagctatcccctaccttttggtgggtttctggcaactttggcattgcttggtttgtagaagcatcactctgatcactgctttcatcctcacatgggggtctctttgtatgtgcctctgtgtccaaaatctgccttttttagaatggcatcagtcatattggactagggtttgccctaatgacctctgttaacttgattacttctgtaaagatcatatctccaaacaaggtcacattctgaagtaccggtgttggagtttcaacatatcttttttagggggaacacgattcaacccatagcagcttcttaaaaggcaacctctttaatgtgaagaatttgaaatattgactcatttctggaagaaacaaaaacaataacaacaacaaaccaaactttaagagtaaggaatatctaactgggcagtgttggttgtcaaatgagtattatacacataactaaatttcagggctcaaattgacatgatttctttgaggaaacttaaggaattactaaataacttttatcagtttgaagaggttctcttctattcctaaaaatattcctggttgaatattttcattatgaaaggctgctgtattttgtcaaatactttttctgcatctattgagatgagcatatggtttatatctttgattcttttaataatatatattacatgattacttttcatatgttgaaccaactttgaatttctggaatagctcccacttggtcatgattataattctttttaaaagctgctgggtttggtttactaggaaattggtggaagatcttttcacctatattcataggggatattagcctgtaattttcttttcttctgaaatttttgtctagttttagtatccgaataatactggcttcatagaatgagctcggaagtgtttcttcgtactctttattagaagaatgtgaggattagttgcaattcttcaaagtatttaatagtagaattcaccagtagaaaccatttaggtctgggcttttctttgcaggaaatatttttattacaagtcaatctctttgcttgttacagttttatttagactttctgtttcttcttgagtgagttcagtagtttgcgtctttctgagattttttttaaatttcttcttgcttatctaatttattggtctacaattagttatagtattcttgtaaaatcttttttgtttctgcgaggtcagtagtaatgtcccctctttaattatgattttagtaattgagccctttttttttctttgccagtcagctaaaggtttgtcaattttgttggtcctttcaaataacccatgtttggtttcattggttttctcttttgttattctattctctatttcatttgtttctgcttaagtttttattatttctcttattttgcttgctttgcatttatgttgctctttttctggtttctttcagattttctttgtggatgtgctctgaaatactagaaaattgaaaccaattctatttcccttcagcaaagcattaattattgtgaaatactaatgtaaagtcaatgtaatagcaactatttatttaaatgagtagatatactgcaagaaaacattttactgcatatatgaacataaccaaagggcatctttaaagacagaaactttaaatgccaaatgcatttttcatattttgagtttcatttcaagacatctgatggaagatagtattattctataataaaatattttaacttttacttatagtagatgcagtaaacactattgcagctttaaaaatacttattatagtacttagcattagacaaattgtttgaagttttaaaaaaatctttacaaattaaaagctatagagtgcctataatcctttaattcaaaacagttgttttcattttccaataaattggtaaaagggaacttaatgacattgtctttccactaaacatcctagctgttttcaagaaaacagaattaacaagaaacttaaaaaataatattgtaaagcagacagtattctaagtcattacagttaatacaacaacaaaaattcagtgtgaaactcttgaaacgaactttaggatatattcggttaaattatggtctactatttgtaatttcatgaatttttttccaagtattggaaatgatctaaatggctgtgtttgtgtcacaataatgttcaggttacaatatgctgtatatttaaaattacctttgcattttaaaaataactatttaaaacactgccaaaatcggcatcataattattttggaagacttaaaataaatacaccaaaaacaaaaccagaatttgcatctaattgcctggaatagtttctctagcctcatttgccagacagaggaatgagtatcttgaaaatctaaggttctttagggctataggattgtatgcctatcagcttggattgctttttgctttatttgactgtggccaaaggtggaaaaggccttcttagatattcttactaggaaatgtaatcttgaagtctatgtcaaagctttcacacaaaattggtataaaatttatacagtggaacttactctaagcagtcaataatagctatatttctgaaaagatgattttaaagccaactgcaataaatggaataactaacatttacatgtgctaaatcttctaatttattggaaatattgaagggccattaaatttaaaaatgcttttgtaaatgcaaaacattaacctctaatttaatccttgtaggaatacaattttttttaaatcaaattttcctgaagcagccatagctgaattagttgttttacttttcaaaattcgcggtgaagggttacatttaaagcagagaggagccccctttttcctcttcatttattctaagtagtacctgaaagcaaaagttggcaggccgcaggcagagaataggtcagccacattgttccttgccttgctgatgcaaaagagagaacatttcaaagtaaaacaaggattggcatcagagaaattgagttctgtgctcttttaaaataatcttcctgaggcattctttcagaaaactagcatttaccctccccataccacacgagtgaaaaagtgacctttttcagagagctcaaagtcaaattagttctgtaagtcagtctagggggaagtgagagccaatttgtggtcagggttgccaaagagccaatgtccaagaaaagaagagaggcagggtggtcaggacgtgctgagaaagactgaaaaaaatagggaccttgcagctgttgaggccatagtagtgactctagggaacatgtagtctaaaaagcctatctaaaagcaaagttcagccttgagagcaagagctgggaaggactcaaggaatgccatgaactccacatgagggaaacagatcacaatacataaatgtaagttcaaaggcagaagaagagaaagagttatgagaggtaaatggagagggtaccatgtaggaagtcacagagaagcagtaatacaaggaaagattataggtcacttttttgctcttctgtcagcaaaacccatgtagtaaaagaagtacgtcagggagaggacatctaaaggtttcttttttttctttccctttttttttttttttttttgagacatagtttcgctcttgttgcccaggctggagtgcaatggtgtgatctcggctcactgcaacctgtgtctcccggattcaagcgattcgcctgcctcagcctcccgagtagctgggattacaggtgcctgccaccatgcccagctaaatttgtattcttagtagagacggggtttcaccatattggccaagctggtctcaaacttctgatcacagatgatccatccgcctcggcctcccaaagtgctgggattataggcgtgagccactgcacccggcccaggtttcttacatgacttatttgaagaagacaggaacagacaacagatgatcatatcaaagaccaaaaacaacctaacatgacagttaaccttggctgcagaattcttattaattcctaatgagagtagactgatgataacacaattatgcctgaaattaatttgaatacataatttaatgtatttatagtttatcagcactataattttgttagttttaaatttttatttaaaaattatttagatatatcaggagtaaaaattgctgaacctgggagcacttagaattttgacaggttgcagtattcattaggatactgttagatgctgtgacaaataatccccacatttcagcagcttaatacagtaaaggcttcttaacagactagcgtaggtaactgttcccggccagtaagagtgggcagatctgctgcatgtggtcatttaggaatacaggctgatggaggctttcccactatcagtgtatgacttctgttattattctgggcactgatgttcatctcactgaaggggttaaagaatgaagaagcgtgcatgaaaggtttttttatttttcttcacattctctcgctgagaatgtaaccacagggctacagtaaactgcagggcagactagaaagtatagtccaactgagtgcccagaaagaagggaaatagagattttagtgaacactaagaagtttctgcctggtacacataatcactggactcatgggagggactgtgataccatgtctacatctaccaaagactttaaacatactgggatcttagtaggctcctgaatgggttacaaagttggttcttggatatagttagtatgaatttgtagaactagcaacagtggaatgctgttggatagtcaaattttcctaaggcatagatttattctaaattttacttgtattctaatctctggggtttatgtgactcattcacataaaaatagaaaaatcagtgtatatctgataattggcagtattcactgattttatccatataaaatatcttttatgatagaactaaagatgtgacatgtctttgacaaatcactgtgcctaattagaatattatgtttcaaatataacttaaaaatatataggtgggtacatatatgcattatgcatatatgtacattagtgtgtatacatgtctgtgtaccaatgtatataactaaaaaaatttctgtgcaggagttgaactacaacagtggagataaactcataatttgtttgctatatcatggactttggaatcatctgttttcagattttagtaatgctatttaataccgcataacccttaagcaaattactcaacctcattaagcctcagttatttcatgtatacaatatgaataacaatagctgtttatcaaactggattattataagtaataaaatgagattatgtatgtaacacacttcttacagaatctggcacatagtaaatgctcaatggcatatattatgcatattatatgtatagtaggaagcttgacgtggcctccagggcccctgtaacacacaaaccgatggtgcagatagacatgaaaatagataggaaatagctggctgctgagatttaatagcttcatttattcgttcctttgttcctagcagtaaatactgctcggcccttaatatgtacaagctctgagtgatggtgggcacaaaaattactaaagcagctttattgttgttaaagagtttgccacctgattatgagaactctagcagtcatgatacaaggtgacatttacacaagagaaataccacagagtgatatatggcttggaaataaggaaaaatatttcttggaagggagagatttgaagaaaatgttttggacatttagaattctgagtcttaaactggctcttaaatccagaatttcaagaaatggatagaggaaagagagacattcaattcagaaagaatagcatgagctgggaatcagggaaaagcacagaatatttttaggcaaactgaaaaataagcaaagggattactatgaagtcaaactgcaaagtcaagccattgatgtcatactaaagagttggacttcattctgtaaacaaggagaaggaaaggcaaggtgagaaataagagtgaggaaggcaagttctgagcagcagaatgacatctatgcccttgaacattttacttggcctttttctccattcattttcctcccctacacagcaaatggatggaactaagatcccttcctgccctcacagtctgggagaccactacatcctccagagtcactgtcattctccgtctgctggaacatcccgattctcattggtgtaacctctccaatgctatttacctaggctctacccagtactgttgtcatatcctttagactctacatttttcttctctgtgggcctgcttttcatcctctgcaataggaacatgagctgtatctcattcattcatagagaggtgtcttccaagcccagatctccagctcctgaaccactccatcagctatggtgagattctttcctggacctcttccagccttcacctcaattagctgggcatgggcagctaattcattcttgcactttctccatattattgcttctctcctaggttttttattgtggttttgtttttgttttttgttctttgacttggtacttccactgttctggaagaatgcaagcagaaatatcaaagaggaacaaataagaaagaattactggggaaaagtgatgcctttataagagtaaaacgttattcttcactataaagtataataagagggaaattttcttcttttacttgttagaattataaagatagttatatatgtacttttttcaaaaatcaagctgtgcgtgttagctcatgcctataatcctagcactttgggaggccaaggagggtgtgtcacttgaggtcaggggttcaagaccagcctggccaatatggcaaaaccccgtctctactaaaaatacaaaaattagctgggcgtagtggcgcatgcctgtaatcccagctactggggaggctgaggcaggagaatcgcttgaacccgggaggcagaggttgcaatgagctgagatcgtgccactgcactccagcctgggcaacagagtgagactcagtcaccaaaagaaaagaaaagaaaaaaaaatcagcactagcaatgacctggtttttacgtagcacttcctaatagcttgcttctctttttgtgaataggatttagcacagatatcagccagtatactaagacaattaaattttttttcagagtaaataaatatcgaatataccaaaatatcattcagtaatgcgattctgaaactaacgtcacaaattaggttcaataaaagaacaggatctttttgtctccaagtataacatgttatttctttcgtaagtcttctcaggacttaaaactgcttctttgaagtattctttaaagctttcagcctctcttgtcttgtcatggctacagtatttgttaattaatttaacaaacatttttggggtgctgaggtaaagaaatagattaacatccagactttaccattgaaaagtccacagaagaaggctaacatgtaaatacagaattgtatggaatgcagtagtgaagtaggaggtgagactcagctctggaggtggaacttggacactggaccaaattgcggactagctaaaacaggaccagagtggaagagttttccataagacacacctaccagtgtgccatgtcagcttaccattgctatggcaacacctggaagttaccactcttttgcatggcaataacctgacaacccagaagttaccacccttttcctagaaatttctgcataatctgccccttaatttgcatacaattgaaagtaggtatgaatgagtgcaggactgcctctgggctgctactcagagcacactgactatgggatggccctgctctgcaaggagcagtgcctctgctgctgctgtacattgctgcttcaataaaagttgcagtctaacatcaccagcttgcccttgaattctttcctggatgaagccaagaacgctcctgaactaagccccaatttgggggcttgcctgcactgtgtcagtaagtgatagaatagagctcagtatgtggtccaggagggagtgatcagtctgtctgtgatgtcccggggggaatcaatgagaaggcaattcacaaaattcacaaaagaggctttgaaaagtaaattagaatttgctgggtcaaaaatggagaaagtatggcccaggcataaggaatagaaagcgcaaagacaaagaaggaagttaggatattgtgcagaattaagtatggcttgtaaatgggtgtgaagtgatgggtagtgagagaagaaatgggagaattggcggggactagatgataaagggcttttcatgtccaacgaaagagtttagatattgactattgattcccatttgtttattgttcatctgtttttggttttgccttgtattcattattttggggacacttccccttttaggcatttgttgaaagaaagctcaagaccttctcccaagagaaagatgcacacataattacttttgcatacaaacacatccatgaacttggaacccaagtttcaaaccactgcaaaaagtcactatgagtcattgacaattattgagcagggaaaccacatattcaaaagtgtattgtcagccaggcacggtggctcacgcctgtaatcccagcactttgggaggccgagacaggcggatcacccgatgtcaggaattcgagaccagtctggccaacacggtgaaatcttttctctactaacaatacaaaaattagctgggcgtggtgggtgcctccaatcccagctactcaggaggttgaggcaggagaatcacttgatcccaggaggcagcggttgcagtgagctgagatcgtgccactgcactccagcctgggtgaccgagcaagactctatctcaaaaaaaataaataaataaaaagtgtattgtcggccacgcatggtggctcatgcttataatcccagcactttgggaggccgaggtgggcagatcacctgaggccaggagtttgagaccagcctggccaacgtgacaattccctgtctctattaaaaatacaaaaattagccggacttgttgtcaaacacctgtagtcccagctactcgggaggctgaggcatgagaattgctgaatcacttgaacctgggaggcggaggttgcagtgagctgagaccatgccactgcactctagcctgggtgacagagcagactctgtctgccagaaaaaaaaaaaagtgtatcttcagagtgaacccctggaggaatgtggagaatctattagaaggcatgggactcatgttagggaaaataggaatttattgcaatatttcagccaagaaatgaaggtctacgataaggtggcagcaaatacttgtttttaatttggctcctgctttgtgttgtctatctgcttattgaggagacagtactacaagagttaaatgtgtaaatggtgttattactgaagtagtgatttcagatataagtgcagcttcatgaggaaggatgaagcattcagaaggcatgatgggtttgaagtgtctatgggttagaccactgcaggtatggattagcaggtcaaaagagatgtcaaaaatgattttaaaaatattctgtttcaccatatagagatgggagatttaatagtgtgaggggatgagatcttagtggtgaaagagcgtaaattaagaagagttagaggcatcagactggaagattggtggagcttgttccctaaatcaggaatttaagccttaactctcttgttaactactgctctgtgttggtaccaggtttgtgaatgatcaagccactggcagaagattactttctaagagtgagagccttcccagggcttcgaatctggttaagtgaaagaatggagaagacggtaaattttaagaaaccatctgatggatgttattaggtcacaaagttgacattcatcaagctaataggcctatcgtttattgcaaactacctgaggtcgggtaaattattacctggattaaaaacctgatgctgacactggttaacacttgttacttacctttctgaacctaaatttctccatctgtaaaataaagtatacacacctactcaagagccaagcagagggaacgagataacctatataagccacctgtatagctgctgtgcaaagaagctgttgaataaggagttggggctggaaactctgacctacctctttaagttttgtaataaaccttccagttctaactagtcaatgaatgacccattttgattctcagacctgccactgcttctacctatctgaaaaaaacaaaacaaaacaggaatttgaaaatctgttatagaagtacattttatgtttagctatttttttttccttcctctatgatctgtaggtatggggtgaaatgattatattgtggtcactttagaacgttcactctctttgggaattaagtaattacaatttcttgaactaactgccttatcctacagcctagtacagtgacagctccaatgtagattcttgggcatgcgttgttttcttgagaacctttggaattctagccatatcttgctaatgatactcacttagcctcatcaaagtctcactgatctcttttctgtacttgagatattaaatgaaactctcttttgagaatgtttgaactggaaggggagacttcagaattcatttagtctacttcattttataggccacaaactgttcattttaagtttggtgtgctcaagacctgatcatattttcctctctattcttatatcagagttaaaagaatgttggctatgcacttcgcgcttacacattaatatagagcccagactgtagggagaattggagacttgaagtggggaaagaagattggggagcagaattacagtgtgttatatagtactgcagcccctcaagggagctgtaattaatgtgtgcaaggaaaacactgcaaggaaactaatttaaagaacatactgaaacaattttctcccagcttttcaaaacaaataaagaaaaaaagaagtcaccatcaagttttgaggaagcatgaagaattccagcagaaaggaaatttgttgagagcccgagaaggggctgctggttagaatgtaaagcctcttttaaacttaggcttcctccaccatttgtcagagctctgtggtccctgatccattcattaagcatttcacatgtatgtcactctcattatgggtcagagtttggttacaacccattgactgctctttctttgcatcttggagactcagttctttataccagttgatatcccgctagcctttcctttctgctttcctgcttatccttttttatcctaagcttgttaggtaacttcagagtttagaatgccttgtgatggtatgtcacttgatattgatgctgttaattccctagagcgaagtcttctcaactttttgtctacaacccataataagaatttcattttcaatccaacccagtacacacatacgtatgttattgaaaattaaagtttcatgaaaaaatactatgtgtgatatgctttgatacttttgcttctcttcaactctatctcatttatttaggaacaaaaaagcatcaaaactcattgaagagggccatttgattctcagttctaatcactatgagtatgcttcacacattgaggtcttcagatcatctgcaacaagtcacttgaaggtgtctggtcccaaaccctcccccagacctattgaatgagagtccgtattggcaacttctaggaatacatagtttaaccagttccttggtgtggttttaaaggttaaaaactagccccagatgttaacatcttaacattatctactcacaaaaagctatctcctttgctagttgatttttttttcttttgtatagctatcaatggctagagcaagggctctgatcactttttttcccccttctagagatagggtcttgctctgttgcccaggctagagtgcggtggcatgatcttggctcactgcagcctcggcctcttgagctcaggtgatcctcctgcctcagcctcccatgtagctggaactagagtgcatgccactatgttgaggtaacttttaaactttttttttaaagacaaggtctcactatgatgcccaggctggtctcttggctgcaagtgatccttctacctcagcttcccaaaatgctgggattgcagatgtgagccaccagacctggccagggttctgatctctgaattcccccttcttcttgctgatagagatcagctcaaaaggtactggaaaccttgaacatctagtaataccttactatatgccagatgctattctaagtgtactatatgaattaaacctcacaacaaacaatgttttgtatgtggtactattaacccattttacagatggggaaactgaggcatgacgaagtctaatttttctgaaattacattgcaagcaaatgacagcactgggattcagatctaggcattctgactctagagcccataatcttgaccaacaccctgtctaattcttcacttagcatgaaacgggagatagtgattagcccaatttgtcactgagagtcttaggtgatttcactaacctacagcgtgctacaggaagataaattagggggtcacttggtcccatctctactgcgtacccatcctcaactctagggatctgatgattactcttcctgcacttgtctgtctgtcttaagaaggagggagagtagcagctttctgccgttatctctagctttgactcattgtcacctgtgaggctaacatcactcaagcctataataaaattcaaatacttcaaatacagcaaacttaatacttagtgattattatatcatataacaaatgctcttatggatcattaaattcattatatctaaatattcaaatgattctgaccatacaaatgattctgacaagacaaagggataatttatttaaagtatatatttagagcaaaatggccttcagaagtcattactaaggaaactttgtcaagtttcctgttggggcatgccagctagtcttcaagggaattttctagtatttctcctaacacgtgccacagtaagagaccaataaagaagagttgaattctgaagaatgacttcagacagtaatcattggaggtgaattgcgactgttgaacaggcagagaaataaggaacagatatctggtcagagggttcaacatatgtgaagactaaggcatgaaggattatgtcgtcttcaagagctggaactgagagaagggaaaaaaaatcacacaatgagacaaggaaagactgagttgagttgagaagtttcttacaagcttacaaacttgggtctactcttctctgcactcagctgtgtatgaaagagacctgtcaggatctcactgtgggggctcatctatgccccaagtttaagatgcttgccccagatatactccagagttttagatggctttgggcttgcagttggctcatacacataaagtatccagaagtacttgccaggatgagtacacaaattctgtctctcttctatagccctgttcagttaggaataaagatgaaaatgagggttgtgatagctgtgtgtgtgtgcacatgcgtgtatgtgtgtatggctgtgtgagtgtgttagtgtatgcatccttgtgtgcatgcacttaaatatacttatatgtacatgatagaaagatccatgtttcagacaggagactaagatagaaaattaagtagaaattttataattttgtttctattatttacctgccatgtgtttgtctcagtgtttgaactgagaaataggcttttagttactatggatatgataatgttaaaacaaacatcatttatggattgtactttatatctcaaagttttccgatatccttatttatgtattattttaattttttcttaacctatgaaaaaagctgggtgccatggttcacacctgtaatcccaacacattggaaagccaaggcaggaggacttattgaggccaggagttcaagaccagcctgggcaacatagcaagactccgtctcaacaaaaaattaaaaaattagccaggtgtggtgacacatgcctgtagtcccagcaactcatgaggctgaggcaagaggatcatttgaccccaggagtttgaggctgtagtgtgctatgatcacatcactgcattcttgcctggatgacagagtgagaccctgtatcaaaacattttttaattaaaaaaattccaaattccatataagactatccctcagtgtgccttcccagctgccctaccccgaccctatgtcagactgtgatttgtagtatgtttcttcatatttattttgagtattaataatgtaatcttatcatattcaccctgataggacactgtagagtttgtttaatgaaccatcttgggggaagaattaaccaacaaccaagatttgaatacagcttggtcctgggcctccttgggccatagcgcaaggcagctaagtggtgctggaataatttctctttgtttggctgcagataccgcatactctaagcaatttgcagccttccttatataagaactgtttctgaaaggaaattccccaagtccagctcttctggttatttccgtttcagctctgaagcgcttactctttgtagctgaaatatggagaactattgtattttttggttccctaactcagaggaaacatgtgaggaatttgctgtaataactgatctgagttggagtgtttgattcctgacacagagtggaggacagcattgtgaggggacatttcattcaagattgttctgttaagcgggagggaggtgagctgctcacagtctatgtcaatgagaatttccctcaggatatttagtgtgtggtggtaatgcatatttaagcttacgtacaacaatgtttgcaaaatcccaaacttggaatagaactctagatcatagtggccaaagaaactgactttgcttgtaagcaagttggatcaagatctatatgagagctttggggctaagggaaataaagcattgtcccaagaaggaagactttgccttgacaaaacattctcttacaatgtgattctcctaagaaaccataaaagagcagttagggatccatccatgcattttaatatttgaagagtttcagactgactgcatgtttgacagctataggaattttatttttataagaatttatctataaaaataaaagtatatctactatctctaaatctatatatctgagttttaaaaatatagcttctctttagcttttgctagcatatgctgtcaaactccttcatgctgccagactcatccaaaaattaattcttctaatgcatgccatatttcatgttgttttggctgcttttgtacattctgaagaaaacagggaagataatggtttccttttccaatttaacatatacatgcgacagagaaatgtaaggatgttgcactcccagaggatcaaacctaaaatgacaatagattcgactgatttttttaaaaaagaatcctactttatgtaatctggacaataaggcacacatggttggattaaaaatattgtgtttttaagatctctttctaattcttactttataaccataaagaaatgaggctatgtgttgttgcaagaagtcttattgcaaacacatgcatgtgcatgtttgtgtgtgatttgtaaatttagctctagaaaggtgtaacaataaaatggaattgaatttagccatggctcttacgagcgtgagtaaagtatgcatgtggaaacctaagatgttaatgaaatcagcatagactttaatggcattctggtgtcttcaaaagatcgccaccaaataaagcttaatgtgtcaaaatggaaaccccaagtaagagaaatgtgggaagaagttcaaggaacagaaactgtttggggaagatgatttgaatgtcttccaaaaccttcgagaagcattaagctcaagctcagccctttatctttgacaaataccacactgtgtatctgcttgttatttcgtggtcctgttgctcctgtcagcttgttaaatggaactctggtttcagtcagatgaaaatgtggtaatctctgtgctttgcttgcctcggcgtccgaggagcggctgtgcccgactgtgtgaggccgcccagtgccaagggtaactactggcacctgcactgacagcaagcagtctgcagcaacagattgaaaatgttcttttcagatctttagattggaacttcagctttacttttaaaagtttcatgtccacagcacggttgacaaaataaattactaaaccaattgctttgggagcttccaagctgtgacattaaggtagctgcgagtcatcattcttgatgaaggagcagcttcagaaattgtgtgcatctgatggaggtttggcaaagtgtgtaagtctgcagacctatggtaaacaggtctcatttctaagcatttattttcagaaagggaaaaaaagagctgtccattctcaatttcggacttattttaaattactcacagggaaatgggtgccccatttaatggcattgtttattctcacagagaaatgtttgcagtgaaaatgcaaaataccatttcttttctctgctgaggctcctcatcctatggtgcccactttactctcccagcagagaatgcagaaaagcaccaaaggcagcatcatgaaacgcagagctgttaattcccaactccgtcagagttctgccctccttcccatttggggagctgaactgagccattagaactttccttttacactccctctagaatacaagtcctgacaaaattaaagggctttatacccctaaagcctcagaaattctacagggtacggtgagggtaggggtggggttgaagggatgggaaattcataggttaaaaacaaaaacttgggcgaaaaatccaggctctgccagttactatcagtgggacctcagctagttacttagacatctggccctctgcttacttgtttgtgaaatagaaatgatcatatctgcctcatgtgcttgttggaaacatataaaacaagataacttcaggagcaaagtgatttatatctgcaatgttgaaatggataaaaaataaaatagatatgtgagtgcatagatgataaatatgtcataaaacaaaggcagcaaagtgttagcaattgtaaggagagatgtgggtgtatgcatgtttgttatataattctctcaacttttctgtgcatttgaaagcatcttaatcaggaggaagcgatttagaagggcaaatcttttccatgtaagtataattcccgtattccctgcctctagttaaattccagatgtaggcacacggccatactgaacctcagcggagaatggaaaaaaatatatctttttcatggaccactgtcagcccagcaaaaatttagaaattttatttccaaggaagagagataatgggggaaaaataggcaccttgattggtcatgcaaacttaactctctgtggcacatactacatgccaaataacaaatggtgccattcctattaaggaagggaagtaatgcctgccccttttcttcctcggggtggagtgtcctgccaagtctcctgtcctttcctgggtgacccagggggcttattgcttccatccctgctcagatggttttgcatttccgtggcagcattttactccaccctccattgtgcatcctagattctctccagaacccctcccagcggaggcctgaggttagcttttgtgtgacatcgggtctctattcttccatgtatttaagctcaaaatgtttccttatggggaattttcttaaaagtcttcaatattgttaactctttgaaaccactgctgtgtgaaggcagctgattgttccattgtgggtcccataggaagaagttctatggttcctccttattgccttcttggtgggcatcccctatgaagcaatgcagggaggactccatgatagtgcaggcacttggcctttgatttccatccagggaactccctccacctgtctatgagagaactgtgttgtggaagctcaccgggaagcctatggaagaccaacacatagaatgggcagaggaagacaaacctccaaaacacaccgactacaacaaatacaggacaacaaacagcaataacattgagaataggaagctcatcatggaggagaaccaggacagacatccacgaaacccaaaagaagaaaaaaattcaagaaagactggtcaattgcatctaaagctactcagtgactaaaaaagataagggctggttgttgtcctttagttggtgatttaatgaagagccattccagggaagcagtgggggcgaaagtcaaatttcactaggatgaagatgacagacaggtaaaggagggaagagagtaactgtgtaggaattcagcagcaaaaaggagaggtttgtggtcacaagggtaatgcggtatacggaaggattttgttttgtttttgtttttgagacaggctctcgctctgttgcccaggctggagtgcaatggtgcaatcttggctcactttagcctcgaccaccccaggttcaggtgatcctcccatctcagcctcacgagtaggtggaactacaggcacacaccaccatccccagttaatttttgtattatttttgtagggatgggtttttgctatgttgcccaggctggtctcaaactcctgggttcaagcaatccacctgcctcggcctcccaaagtgctgggattacaggcatgagcaactggactagaaaaggtttttcatgatgagaaagacttgagtgtgatcaaatgctgataagaagggaccagagaagaggcagaagttaatgatccagaagagataggaagtagctgctagagagaggttgcttagaaagaaggtaaggtaccatccaggcaaccggaggagggattggccttggctagaaggattcctctcacattggataggagagtaggcatatgccatggtttgcatgtaggtcagctggcacagggtagaattgttactgctttatttagtaaatgtattcctctaaagtcatctgcaatcatatcacattagccctttttgtgacactgtgttttttttgtttttttttttttttctggagtttattagcaaatgagatttcattaccagctcctgctaaacaatgtctcctctatcccacacttacgcatttctgaaaccaaattcaagtcctaacatttattttcactgaaggtcatactattagatttagatcatgtttccaatttgtcaaaatctttttatattttaattgaactcacaacatatcactgatgtgtttcagtcttgtgttacccatacattaaacaatcagctgtatgtatgtcttcatttaaagaactgtctttagctctattttacttttatttcatcaactactctctcccccaaccccctgagactcaagggaagaagaattaaactgaatgctttgatgataactgataaagccttttgtcctaaggagtcctcccaaattggattaagaggattcatttgtgttttgcggtgtttatatttgaggaagacaaggatgtgaaaactctcactctctctgtgttcattctcacaaatagatggataccgtcacttttcaaggcttgtccatctggaatgcatcacaaacacattgctgggaaagtaaaagttccagaaagagcttcgttttctcctggaactgtgaaattgagtggcctagttctctcctccatgttgttgtaaattcacaggagtgtaatataagctacatttttaaccatttgggatagcttatgattgaataatgcttcctgccagacatgttttccctttatttatcacttacttttctctctaatttcagcaacagcaattgctgattatgaaaatgactctaattgttcaacctttcataaccacatttaactaccaaaaacaatctatctgctactttgaaaagcagttaaacaagcaagcaatttattcctgccttcttgcaagcaaccaggaacagggccgtgttctctttgttccttgtactgctttggaaccatgagtgcctctttctaacttgaatcaaaatctgcttgttcctaactgctgcctttgcaatcagtaatttgactcagtgggcttaattcaaagcaggcactcacattctttagactctttgtcagtcttccaggaaatcaagttgaacaacaaaaacaaacaaacaccggccctaaattaaaccagatagggaggaagaaacgtcaatgaatgatgaagcaaaataacaagagtcaggagaaataaatagaaaccatttcaaggctccacctgccgtggccccattagcccctcctttacctccctttcctagaggaaatcaaagcaactcctatgagcaatcattctagtcagcttccagacttccagagcctgctgaatctagctcctcccaccctgcccccagcaggtgagcacacctgggatcgctgcaggctgacattgcatcgtgatttctctgcatctcaaacagccggcagccctgcagaaacctcttccccttgctgagataaagtatatgaattaattcccttttgagttaacccgcgcctggttcctctcagtaactactggtactgggatagagaaggagttggcagctctcttagaaaaccagatagttttccttctttgtgatgtgctcaactttcttttgccccaggcttgaaaatacatgccctgtctttaactttccttgtgtgaataaccagggctcaacaaggtaatagttgggtaaaattgttacagaggcattccaaatctaaaacagagatgttccctggtaaatctgatcttatctaatgtttcctaaatgtaaataggccagagggtgttcctttctgaataccctttaaccagatacgttggaaatctattatgtattgtttattttaatttcgttaaaaatgttctcaggtttgaagtgtgatttctttgcgctctcatttaattttttcttctttttagaataaattattgaagacagaactttttcaaggtatttatagatatatctgaggtattcatgatttatataaagtgtacaggtgaagagttaccttctagtatagaccttaagcatgttatcatagctatgtgcaataaaggtgatattaagtttatttaatattgctaccatttcttctaatccttgaattttctctggaataaagctgcagtgtaatgaatgagattaataaaaatagaagggttatgtgtaactggaaagtggggaaatcactttgttcatttatggtagaatatttaattgaggttcctccacacattcacattaggaaagtcacttggtctttaggtttaaaaataataatttaacttcaaacaatccttaactcttcaaaatgtttaaggaattaagggcaaaaaaacctagatatgttccacaactttggtgacaataaacatgaaatatggaatccaatttttgaagaatatagccagtcatccctttaaaccacaaccatttttacataatgtatagaattaaaaaacactggtgaatcaactctgtgctgtgatgtgtattaccagtctattggatctgtgtattgggtgtttggggagcatatcgacattatgggcaatgcagttatttcccatgacattttaaaaatccatttctgtattacatattccaatctagtgaaaattacatctactctatttagatttggcatccaacacttgttggccatggcatgtgatgtaatttaaactgctcatgtacatttaggaggagattgatttatagccgtctttgcctgagacaagcacaatttaaactaattcttattgatccagaaaaatttaagattggttttgaaaattctcaagaatagagagttttggatacatttgagccattttgctaagcataattgtcatgtatataaaagcatgaaactgttaacacttatccttctttgccttggcgtctttgttagtcattgcatacctaaaggctaatttctgctccagatgctgtgatgtctgcccagctggcccagctgttaggatatatgctatttgcaaatggcagcataaatagcatatccagaatattttgcaggctggggctttgccattaaaggctaagatatatttagtgtcagggataattgtttggtatattgtaaccagaatggagctgacagaatgccaataggtctagcagagtgactcataaaatagtccaatgaagaaattatttactcaaacatttccatattagcatgtaatgtgcactacaaattggatttcctgtgaatgtacaatcattgtgtgcagagtttgtaaaggtgtctgatattgcaaatgtatcatttaagaagaccaaattgcatcagattctctaaccaagtctcttttagcatctaaaggagtagttcttctaattattttctgattgcaggatagccttgttggaaatgctcaacttggagttgggaagaactgggttctaaattctagcaatttctatgatgacccggtgacattaaacaaatctcccatctttcctaatcttttctatttctggtttctcagtttataatattgaagatacctgcattttaactgtttttgtgttttgtcaaagaaaggtgctttatacatagtctaggtctatttgcttttcaacttttccccaagatcttctgtctttagatgtatagttttttcctgcttttttttgtatgtatctgtttttagctacctaggtattcataaggtgattagaatgcaacggttacatggcttcttaaccacccctaatttagacaagcatttctaagtaggacttctaatattcaaggcaaagaatattctagaactcagaaagtttgcttttatattccaaattattttattgttacatctaaaaaacagtggtgtctgcccttatctgattctggatgctgctaaaatatactgctggacagaaatttgattcattaacttttttggatcttaaccttttaaaggtgcagtatgtccattgaatctacagctttaccgaagcccttgacaaggcactggtatccacaaggaaaggcgaatgttgatatacagtgactggaactgatttttatcaatgtggatggtaccagactaagaaaattatccatctgggccatgcaatctgtctttccagaaaatcactgaactacatatctaataacacagtcagtgagataatttccttttattgagtaatttcctcatttggtagggattttaaaagcctaggggcattttgagcatatggttcaggaacattattttaaaatgtgaattatcaatagaatttcaatacaatcaaagtaaaataacttacttcctaagtgttacaaatataagcaggatatttctacaaaggctgttgcttttgagtcagagttaggagctggagattaaaagcttttcttcagcattgttagagcagggtgcatcattctcaattgccagcggtcaattctctccagacacagttgatcgctcctcccacatgaaacaatttcttcacttgaattcctccaacctcgctggctgtttcttcccaatctcttttgctggttcccagttgtgtcactccccactcattactgaagagccctaaagttcagtccttgaactccttacctatcaacaatcatccttgcttatctcagctagattccgggctttgtatactgatcaattacaaatttgtatctccagcccagacttgtctgctgaatttccaacttgtacattctgctgcctactcagtatctccacttggatttctagtaaacatctaaaatgtgtcatctccaaaactgactttctaatttatcacaacacttactttcaaaaaatacatgcacaccttctgtagtttcctgcctcttaggtcacagcaactctattcttccgcagttcaagccaaaattttcggtgatctccttgactaccctgtttctcttactttctctataaagtctcttagagaaaatcttgttagtgctaccttcaaaatatcatggtgtgagttcaagcaatgtactttttcttttccttgcatacttactccagtggtctaccttgttgaaatatctaagataggtgacggcacgggcctccagggccactcttaattataggccttgtgcctcagggtttcctaggctggcggtgcgttgggggaggggggggcggcggggcggggagggggtggagggttgggaaagagaagaacctccataaaggtagaaaatgattcatcttatatttctctgcaactttttcaccagtgctcagactgaaaaaagatgatgactggtggtcattaaaaagttaattttccgtttacgagcaaacctttttgggtctttgaggtcatatatagaccacgataagcaaattatcttatagattgtatctattttcagctgttataaaagtgttttaaattagaccaaggctatttttagtttttggaaagttagcttataacaaaaatcttgctttttcataaaaaagttaagcatattaaaaaacagaaaaataataccatatggaaatagagttggctgggtgtggtggcttgtgcctgtaattccagcactttgggaggctgaggcgggtgcatcacttgaggccaagcctggccaaacattgtctctactaaaaatacagaaattagcctggcgtggtggtacacgtctgtaatcccagctactgggaaggatgaggcataagaattgcttgaacctggaaggtggaggttgctgtgagccgaaatcatgccactgcactctagcctgggtgacagagcaatactctgcctcaaaaaataaaaataaaaaataaaaaataaaaaaaaagaaagaaagtagagttaaataccacagatataggaagtctagacaatatcaaaggaataagatgatgcgattttgaactaggaaagggtagatgagagcatttatttatctaagatcttttgtatagataagcagagtaaacaatcacccttatatatgtagctctttagtctgcaccaagacactgtccaagtgggaaacagggagactcaagcaaatatcctgttggtgttgtctctttatcctactttaaaaaacactaggatctggactgtgaaatctgagagcagtctctgaagagacacagatgaaagtgaaaatgctgctctattttctatcacccaatttcttgtcacagttactatcattaaaacatattaaaaacatggaaagggctgaaagggaaggtacaaatctaataagatttgtaatataaataaccctcagtatgtttttattcccgattgccttgcctccttaggttctgatatttaaagattgggttaaatatctccttttctgtgtataaggtattggcacaatttttttttttcttattcacttctcctcatcaggcaggtggttgaaactacgtaatgcttgtcttttatggccattttcagagagaatcattttcaccaggggacgatctcctgtgttttttgttttgttttgtttttttacccttttctctcaatctcatctcaaagataaatgggagttaacaactctggttaagattatgctcattttcaaatgctttctttatactttttagccttccataatataaataatattgtggtgctattgtaataacaaatccaggaaaaagaaacaccttactgtcccagactgatcttagtttcagaaaactctgccctcagatagtggttatacataatacttatccactgcacccaatcaccagggtgctattttgtaatgagaagtccagagaattttctgaaggcatgacttaatcatcaaattaccagattttaaaaggctgttacatgtttctatctctgttcattgattctgcatgagtcatcatccttggaaaggaaaatgacatttcccccattggaaattggcagaatacatacagaaggcttaacttctaaagttctctgcatatggggctcttgagctgttatatcctctagaaaccttggtcattcagatatttgtgatttgtatagcgtagaatgtacttcaccaatcttccttctccacagagtatgacaacatctctactgcgttcatatgacctttttatgtttattgtacaacagtatttgcattcgaattggtaccttaaattataatctctaaacaagatttcttggtgcgtttcattggaacagattcaaagaaagagatacaggataggattatcaatggcctggctcgcagggacttatatagtatgttcctgacctctctggtggagtttaatggaaatggctttggagacaggaaatactgggttccagccttgtctctgtggcatacttactccatgaatttaggcaagttatttgtctcttcacatggtcattgagaaaatgaaataacaaatctgtatcagtaaggcacctgggacaggtagcctcttgatggatattacttttctttttcccaggctgtcctgttgccatcttcacacttttgcctaaatgcagagtttgtttgtttgtttgtttgttttttaatagctagggcattatttaaacatttttgttaattgagaaatatctgaagcagtttttaaaaaaatagggagcactggccaggtgcggtggctcacacctgtaatcccagcactttaggaggctgaggcaggtggatcatgaggtcaagagatcaagaccatcctggccaacatggtgaatccccgtctctactaaaaaatacaaaaaattagctgggtatggtggtgcgtgcctgtagtcccagctactcaggagactgaggcaggagaatcacttgaaccctggaggcagaggttgcagtgagccgagattgcatcactgcactccagcctggtgacagagcaagactccgtcaaaaaaaaaaaaaggaagcattatgtttgagtgctcaagcagttttagtatatgaacaagtcaaactcaatatagtcatgccagagacattagctgcatgtgtgggaatgagagtggagtgtcacaggaggctgaaatcagagccaacccagagtgttgaacatgatttcaactcttccaattgacatgatattttttccctttttgaggaggaaaaaatgctctagcttgctatatcttgtgtttgccacctgtatagtgggctgcaaaagcagggggtgtgggagccaaaggcaatggctaattagaaaagtgtatttgaaatgtcttgaatgcttcaataaataaaattaactgacactatagccttaccaaattgatgataattatattgggtttcctgtgattccagtgaatgtgggttttaactaaatacatccaccttattgtcagttcatccttgcattattgtgggagaaaaacttccagtgttcaatttcttgtattgtcagtcatacaacttaaatttttaatttcagtataatcttgccttctcctgcctatttacaacttcctgaaaacatatcgagtgtggatcccgtacgtaagtgagattgtcttcgctaagagcttcttgcaatcacaggaaaaggggaaaaaatgttgttacagctgatcattgccagaaggtgaaagttcaagaagtagagaaaaagaagattgtagcatgtaatcagagttcttggttgcatgctacagaatccattctatgtagtttaatctgggaacaatgcagccagggatgacacctcaaaaatgcccagcctcaacactagactgtcctagcagaaacactactgctgctattacccacatattgtcacttacgacattaaagtccaggggccagaaactctggcacagctcctcaagagaaccagatactctgccgccatgctttctcccaaggagccattctttcatgcagctaatagtttgtgttgcttgctttcaccttcaacattcacacatttgggttggcttggtggctccacattcattacaggctagttcctggggaacctgggaaatgtagttttagctttttgtcttctatagtatagcaatcaaagtaagctagaagggtgttggaatagatgctggttgaactgcttgttagtatctgctcctgatggaattgaactgaaagatgttacaggtgtttactcctcagtggtccatgttggaatgtcactttctgttttcagaagcttattactatatgtaaaaaacaacaacgacaaaaactattgcttttttcttctgcacttgatcaaaattctgtttaggtatccacattttaccattatatgtattcaacagtgcagaatgctggtgaccagttttacttgttaaccaaggcatggctgagtcctcagagacttttaatttgactccattcttaggatgatgtgctgcatttctgcaatggcacccactggcgtgcaaaagaaaaactggattttccaggttaagcagaaacatggacgccatactaaactctgaacagacacattcatgcatcttcttgtccaccagctgcaggaactcaggggttttactacttcatccttttatgcccaacaccccatcagctccagaggcagcttggctgcatgccaatgtcagtgtagaattattctatcctcacgggttcatatcgtttgtcaagtcaccaaacactcagaaatattgatgagtcatctacctagatgtttttgttcatttgtaagactaacttgtacagagttttgagttttcttaagattttagagatataaataaaccatcaattaaggatttagaattcactaaaaataaaagctttaaaaggttgtgatttgaaagatatgcttagtgctggaaggtgtttaagggtcaactattctgacttagaggaagataaagcaagtagtaggtaagggatttgccaaaaaattacatagctggttaatatcaatgctgagattgaaactcaagtccactgcctgctggacggggaatgtttcaaaggtgcttgataccaaagcataggtcctaagtcctcatcatcctgtatgaagcatgcacatgatgccacatggtagctgaggccatgctctgaaggatgtctacatgaaacaaccatgaaaaatcatataatatgggttacattcccaacccacatcttctcaaattcactagaaggtgtccattttgttgacaaaactgaatttgaagtatatgcaataaatgacaccaacattatttttatggctaaaagtacttgaagagcacgcttcctgtttttaatcactagcgttcctttagctgcagtcagccatatttgttgcttacattataagcatatgtttgtttggtttgctctaattctttgccctcttaagggaaaagcaagggaggtttatgaagggccttaaaatgagagaaactaattaattgctgactttttatatttatcagcaaaggaaaacatttctctactctcataacgcttctgacaccaaatgtgcggattttctacacattacaattctcataccaactaggtgtcctataatttaattcagttctggctctggagttagcacagaccccacagtttaaggaatcagtcccacagactgctccacttcagatggtgatcataagcctgggctccctatacttcttactgacaggctataaatcagaggtttctcacgattccctcaagttcaataatttgttagaatggctcacaggactcaggaagacacttgactcaccattgtcagttgattataaagcacacaactcagaaacagccaaatgaaagaacggggtatgtgggaagggccgtggggaatccacgtcctcgctgggctcgccaccctccccgcacctccatgtgttcaccaacctagcagctcttggaacccctttatttggagtttttgtgggggttccattacataggtgtgattgatgacatcattggccactggtgactggactcatctccaacccctctccccatcctggaggagggagagtggagctgaaaattccaaccttttagtcacatggttggttcctctggcaaggggctcccatcctctgagtcaccttattaacgtaaactcgggtatgcttgaaaggggcttattaagagtaacagaagatgctcttctcacccctatcactcggataattccaagagtttcagaagctcttctgtcatgaacagaaaaattctcctgtcaccccatcacttagaaatttacatgagtttgctgggcgcggtatctcacgcctgtaatcccagcactttgggaggccgacacaggcggatcatgaggtcaggagatcgagaccatcctggctaacacggtgaaaccccgtctctactaaaaatacaaaaaaattagccgggcgtggtggcgggagcctgtagtcccagctactcatgaggctgaggcaggagaatggtgtgaacccgggaggcggagcttgcagtgagccgagattgcgccactgcactccagcctgggtgagagagtgagactccgtctcaaaaaaaaaaaaagaaatgtacatgagttttgtgtcaggaaccagggcagaggccaaatgtatattggtattaagtcacaatcaatacgtactttttaaaaatgtaaatttatgtataaatgaaaataactacatttcttgctttcacaaaccttgttgtcaatgtggaatgatttctcaccagtttaaacacagttgagttcttacataaggaaaaatgggaagcagaggttaaaacatgtatattaactgtggtgttctgagtgtagactctggagttcaactatccaggtttgacttcttccatttctgagctatgaggtctcaggcaagctacttgccttctctttactttagcatttcatctataaatttagtatgtcacaggcacctaacttttagcattgttgggagattgagatggtgcatgtcaaatgcctgccatgacaccttctcagagctggtactcaataacagtattaaacattttgtctgggcacagtggctcatgcctgtaatcccagcactttgccaggctgacgccagaggatcacttcaggccaggagttcaagccagcctgggaaacatagggagagcgtgtcttaaaaaaaaaaaaaaaaaaaaaaaagtctatctcctgttcccatgttttcattcattttttaagtaatttttttttaattatggcaatttttttaagtaaaaaaaaaaaaaaacaaaagccaggcacagtggctcacatctgtagtcctagcttcccaggaggctgaggcaggaggatcacttgagcctaggaattcaaggccagcctgggcaacatagtgagaccccatccttaaaaatatatttttttaatgtatggagtacctaccaagtcccaggcactactgtaggcactgaaggcacagaattgatagatgaggtccttattctagtagaactatgaaaattttcttattcagaataaaatttaggaagcaaccagaaaacacatatagacactgtcatgccaggcccctattgattccaacagggatggctcggtaagagacccggagccagtgaatgagacatagggtttatagaagacttatatacagagcattctcggaatgggaggctggataggaaaaccactaccatttgtaaaaagcatgcatattatatagcatgttcacttagcaatcttcaccaagcaaccttcctttaacccaaaacaaaaggcccctgatccctgtatagtctgcattccaaatgataggccaggggttcagatgttcttcatagatgaggagtgaatctccagcttgaccactcctggattcttctcagggtatgcttgagttattgctgttaggtgcatctgccatacagacccatagcatgattttctctaagaagctttgtgatgcatattggtaaacgttgtaaagttttaagtggacttcaattaatttttaaaaagtaaacatacatgaataaatatcatccctcccacatagctttaaattacttctgatatgtccccgatttaaaaaaacaaagggtcagtcaggtgtggtggcttacacctggcgtgtaatccagtgctttgggaggatgaggtgggaagatcgcttgaggctatgagttcaagactagtctgggcaacataacaagacccccatctcttaaaaaaaaaaaattagctgggtgtgatgacacatgcacatgcctgtaatcccagctacttgggaggctgagctgggaggatcacttcagcccaggagttcgagactgcagtgagctatgaatgtaccactgcactctagcctgagcaacagagtgagaccctgtttcttaaaaaaaaaaaaaaaaaaaaaatccaccaagcaaaccagcaaaaagttaataatctagggctttacctacctggtacgaaataaaggaagcataatagagaaagttctcagaactggctgtgcccctggttccgggtgggcaaactccctattacttatataaccttcctcacttgcttgagagaagggagttgctgggagttcttgttagaggttttgcagaaattgcccacagctgagagtttctaatttagagtcattgttccagtgaatggaaatgagctgaaggaacagccgtgacactcactttcagctaagcaaggagacctgccctgggaacaggcggagtgaaaagcccagtcctgagcattacccagctcctttgaccttttctctccagagctacatctctctttccttcccttctcctgcatcacaaaaaaacctgttaaaagttatccatctttcttctttgagcatgagagtccatacaaacacttccatttcatgtatacccaaattccaagtgatcctgaaggaacatttaaagttgaagttttttgttttgttttgtttttctgagatagagtctcaatctgttgcctaggctggagtgcagtcacacaatctcagctcaccacaacctccgcctcacaggttcaagtgattctcctgcctcagcctcccaagtagctgggactacaggtgcgtgtgccaccatgcctggctaatttttgtatttttagtagagatgaggtttcactatgttggccaggctagtctcaaactcctgacctcctgatctgcccgcctcggcctcccaaagtgctgggattacagggatgaaccacggcgcccagcaaactcatgtaaagttgaagtttaagtggcagagagaatgctgtgctgatgaaatttggataattatataactaatttctggcaacattgtaatatgatgccagggtgtcttcttttcttttatatagacaaaatatattgttgagatttttaaataagtattaacgaaatagaaagaatagtcttcagagaaaaactcttttaacgtaaccttttttttttaaccacttccatgagaaattgtcagggttgtcaacatcatgcttcatggcttttgaaatctggactttaacacaaaatccctttatacatactggaaattattgtgctttttggataagattgaggtcttattcaaaattcttacaatcatagaaacagataacacactatcattatctgtgacaagaggataggaatgggaaggataattaaaatgctagcattgggtctttcaaattatgttctctgaatcttagcacagaaataaaatattagaattttaacctctaagatatatttttaaagtttttggctgggtgttgtggctcaggcctataatcccagcactttgggaagccaaggtgggtagatcacttgagtccaagagtttgagaccagcctgggcaacatagagagaactcagctctagaaaagataagagatgagatgggaagatcgcttgaggccaggagattgaggctgcagtgagccatgatcatgccactgcactcccacctgggtgacagagtgagaccctgactcaaaaaaataaaaaaaaaaagtaaagtttctattggagtaagtcattcagtgtctcaaacttttgttttaatgccataattcaactttaatggctctttgtagactaaaattaatatctgcagaaaatagccatttaaaataacttactatttatagaaaaataacataaggcacttgtcatttattgaaggtaatggtttactctgaaatttgtacagtgaggattggaatttttatttgtatttatttaaaacatacttattttgttctagggatgctctttataggtgataactcattcaatcatcattacctatgagaaaggtattattattatttttttactttacagttaagaaagatcaggaactcagaaaggttaaataacttgtcaagttgcacaactgataagtaggtagaaccgggacttaattccaggccatctggccctcagagttcctgcttatgcccccatgcactggtgcctcttgcagcacgtcaaagagtttaccaagacgaatgagctcagaaatttgaacatctaaccagccatctgtctgcccttctggcccttccaggatatcaatgtttcttataaaatggacataaattcctgatgagacaagatttgtatggagagccatgggactatcacccctattctagacacataataaagcaacagaagaaggccacattctcgttaagtgagagcataatgagagcagcagcatagctgctcttttttacaagcagctatgaagctgtaatcctacgcaccttcaacccgtctccccatgagatcagaccatcaattgtggtctcagcaaaaacaacacatctaaatgagaaaaaaaatcagaaaaggtttaacaggctggatatggtgggtcatgcctataatcccagcactttgggaggctgaggcgggtcgatcacttgaggttaggagttcgagaccagcctggccaacatggtgaaaccttgtctctatcaaaaatacaaaaattagctgggtgtggtggcatgtgcctgtaatcccagctactcaggaggctgaggcaggtgaattgcttgaactcaggaggtggaggttgcagtgaccaagattgtaccactgcactctagcctgggcaacagagtgagcctctgtctccaaaaaacaagataataataaaataaaataataaaagaaaaggtttaacaaagggactctctggaggaggagatttatgtagagggactgtgacctttcagttgaagacagacctccaatagagagggctgagggaataagtacccagagtgctctcttttctcttcctccactctcctgaggggactcttccttggcctactggataccagagggtgagggacaccattgatgaaatccataaagatcagcctccagccatggagcagggtgaaaaatggggatcgaactgagtggaccaaagacagatatttgacacagttttacaaatcctatatttcacacacacacacacacacacacacgcacgcacaccttccttcagaacaagtgtttctattcttccactgaaaattttaaatctttgttcattaactcaggttcttcaataccttagaaagattctaaatgtatcttgtcttttttggcacattgctcaagcctgttaaggtcttcttgaattctggttccatcattcaacacagtggtcctcaagtctagtagtagcatctcagaatatgctggaaaggtctttagagtactaatttttcaggctaccccagagacttagtgaatctcaggtaaggctcaggaatgcctatgtgtttgttgttgtatttagtttcccaggcaaccctaatgtagccagtgaaaactcaggcatctgggatcccttgatataaccacttcaacacaaggcatgtgctggacacctttttagaatttatctttgtccagaaacgcagagatcttccactgggactagatttgggagtgtagactggaatgctggaattgcctagggaacttttctgaacttcatcacctcttcctgggtggccaagcctccttctggaatcctctcactaccacagtgaactgctatcattgaagggagcacgttaaatccttccagtcttctagtgcaaaaatgttctaagactcctagatttaccagtaatcttctttacaaatgattgtttgacttttgcattaattttactatttgtattttctctgtgttgtgctaagaatattataatagactctgaaaatattttactggatttgaatcatgtccatcaaacctattcacccatccttccttcttttcttttttccataagtactaattgttctaggagccaagcacattccaggccttaggaataccataaggtacaagacagctgaggtctttgccctcttgtgcttacatttcagtgggggatgcagactttcaaaaagtaaataaaacatctgcaaaaaaaatgttaatatgagtatgtggtataaagaaaacaaatggtactgagcatggagacaattgcagggagggcctctcgaagggtaacataggagttgaaaactgaaggtcaagaaggagccagccttgcagagatctgggagaagagcatttgaggcagaaggaacaagtgaaaatgccctgagataagaaagaaactttagaattcaagtaatacagtgaggtcatttcagagtgacttgtccttattgattgtgtgctgaccagcaaagagatatttccatctgctctaggtcccataaactacctcttcaaatacctgctgaaaatgtttctatgtccccacaagcttttagccagcccatctttatatatgcctataatggattagaataaaataaatacatgaaaactgctgataaaccaaagctttactagtaaatctttgtagctctctctcctccaggagctgatccaggttatatgggatctgaagcttttacaattttaaaggtcctttccaaaaaaaaaaaatgcaaataaaatgttgcaatggccccactcatgcatgtgaagggcccagaaacttcaggctaattggctccatggtaaattcacctgtgcctggcacttgtctttagataagagactgagaatgaccaaaaatcaaaatccacaaagttgtaagtaggaggcaatgaaaaagcatgtatttctgctaatagccagagaaaccatgctcttctccatgtcagctgatgaggagagggagaggaaaacttgtttagatttaactatgcagttattatggcaatcactaagttaggagcaggagaaaataaacaaaagaaaaagaaggagcttgttattttgtaaggaagctgctaaaggaagctttaggcaagtaaaggaaggtaggttaggtaaatacattggaaacaatgtggaatggagactgctgaaagaggtagaggtagaagaaggtggtcgggaccaagccagtgtgggaggtcaggagagtgtggaggttgttttggtggatgcagaggagtaggactctgacatggaaaggtggaggtaggggtggaggtagcgtaggccgagatgggaaggtctgggagtgtgagtggaggcagttggtgaaggcagtagaagaggtggtagggggtgagtgtgcaggcagaggaggaaaggtagtggtggtggtggttgtagggcagagtttggttccatttgggcctgtggagatccattcttcttgccttgtgtgaaaggttttttttcataattacttctgagtctcaaaaaatattcttgtgaataatggagaatcagtcatcttttacattatcaaaacaaagacttatcttatcacaaaatgctcagactgtggtccagtttgggtccagtattttgacatttgctttccaggcaataataatgaggtatatttatttttttgaggtaacatgtgataatgtaatacattcatgtaatttgtaaagaacaaatcagtgtaattgggatatatatatgtatatataatcttaaatatttgtctttttaatgctagaaacattcaaattattcttttaactattttgaaatatacaatagattattgtaaattatggtcaccctgttgatctatgaaacacaaggtcttatttcttctatgaaactgtatatttgtacccattaatcaggctctattcatcctcccacccccttacccttcctagcctctagtaaccaccaatctactctatctttatgcagtccactttttaggtcccatgtacgattgatgtgatatttgtctttctgtgcttggcttatttcacttaacacaataaccaccagttccatccatgttgctgcagataacaagtttttttttttttttttttcattcttttttattggatgactcatgttcaattgcatacatataccatattttctttatccagtcattcattgatggatactttggttgattccatattttggctcttgtgaatactgctgcaatgaacgtgggagtgcagatacctctttattttattgatttcctttcttttggatatatacccagtattggaattactgaatcacatagtggttctattgttagttttttcaggaacctccatattactttccagagtggctgtaccgatttacatttctgccaacaatgtataagggtttccctttctttagatccttgtcagcatctattatccttgtctttttgataacagccattttaactggggtgagaggatatctcattgtggttttgatttttatttctctgatgattagtcatattgaacatttgaaaagtgctcgattgtgaccttgaataaaacctaaaccaggctgggcacagtggctcacacctgtaattccagcattttgggaggccgagatgggccaatcacttgaggccaggagttcaagaccagcctggccaatatggtaaaacctcagctctactaaaaaaacaaaaattagccaggcttgatggcaggtgcctgtaatcccagctactaaggaggctggggcgggaggatcacctgagcccaagaggcggagtttgcagtgagccaagatcatgccactgcactccagcgtgggtgactgtctcaaaacaaaacaaaacaaaacaaaacctaaaccaaacagaatttgtggtcagggagagagatttcttctggaaaatattcttccttccatgatttgtaacaaatcaaatggccatttatgtgtcttcttttgagaagtgtctattcagatatttttttcattgttaaatcagattttttttttttttttttttttactattgagttgtttgagcttcttacatactctggttatcaatcccttgtcaaagggatactctgcacatatttctcccatgctatggactccaacttctctttggggttgtttcctttgctgtgcagaatctttagcttgacgtaatctcatttaccaagttttgcttttgctgcctctgcttttgaaatcttatgcaaaaagtctttgctttggcctggagcatctccccaaagttttcttctagtacttttatagtttcaggtcttatatttaagtctgtaatccatttgatttgatttttatatatggtgagagatagggatctagtttcatttttctacaaatggttacccaattttcctagcaccttcattgaagagactcctttcctcattgtatgttcttggtggctttgtcaaaaatgagttggctataaatgtgcagattcatatctgggctttctattctgttccattgtactatgtgtctctttttgtcccagcatcatgctgatttggttactatagctctgcagtatattttaaagttgggtagtgtgatgcttccagcattgttctttttgctcaggattactttggctatttggggtgttttgtggttccatatcaattttaggattgctttttctatatctgtgaaaatgccatggtattttgatagggattgcattgaatctgtaaaattgctttggataatattatcattttagctatattaattcttccaatccatgagcattaattatttttatatttaattctttcccttttttggtgttctctacaatttctttcatcagtgttttatagttttctttgtatagatctttcacttctttgattaaattgattcctaagtattttatattctttgtagctattatagatgggattacattcatgaattttttcagattattcactgctggtatatataaatgctgataatttttatgtgttgattttttatcctacaactttacggaatttgtttatcagttctaacagttttttggtagaatcttaaggttttcctaagtacaagatcatgtcgtctgtatataggaaatcctaaatcaaaaacctaaacctgaacaaggctaatttgacttttttctttccagtttggagcctgggcaacatatggaaaccctcatctctgcaaaaaaaaaaaaaaaaaaaaaaaaaaaattaaaaagttagctgggtgtggtggcacatgcctgtagtcccaactagtccagaagctaagttgggaggaacacctgagcccaggaggtgaaggctgcagcgagaggtgatcgcaccactgcactactgcctgagcaacagagtgacaccctgtctcaaaaacaaaacaaaacaatcatacacgcaaacacaaaccaatctggatgtcttttatttctttatcttgcccaagtgctttggccatgacttctagtattattttgaataaaagtagtaaaagtgagcatccttgtcttgttctagatcttagaggaaaggcattcaatttttccatgttcagtacaatggtagctgtgggttttgtcatatagcctttattattttgaggtatgttccttctgtatgcagtttttggagcattttatcataaaaggatgttgaattttctaaaatgctttttcagcatgtatcaaaatgatcatttttttcccttggtgctgttaatgtgatatatcatgtttattgatttttgtgtgttgaaccatacctgcatccctgggatgaattccacctgatcttggtgaattatcttttcaatgtgttgtaaaatttggtttgcttgtattctgttgagaatttttgtatctatgttaatcagtgacattggcctgtagttttctttgtttgttgtgtctttgcctggttttggtatcaagttaatgctatccttgtagaaggagtttggatatattccctcttctttaatttttttgaagaatttgagtagaattagtgttagttctttacatgtttgttagaattcagctgtgaagccatcagatcctgggcttttctttgataggagatttttattacagcttcagtctcattactcattattagtttgttgaggttttttatttcttcatagttcaattttagtagattgtatgtgtctagggatttatccatttcttctaggttttccaatttgttggggtatagtttgtagtaatccataataattctgtagtctcagttgctatgtctcctttttcctttatgattttatttattgggtcttctctctttttttcttagtacagagcagagtttcctggggaggggttggtagtcctgcctcacctctttttctctggctgccctctggggtatttcttcctccaggcactactgatgcttcctgtggcttgaaacagggacaggtctcctgctagggaacccaatatggtaaggaagttggttgtcctccttgatctcacttttcccagtgtagaaactgtgaattagtggaaaatttctgcacacttgatgccaggcagatggtgggaagaggtgtcacagatatgtaagtccaattctcttactgtcatcttggagttttttcacttctctgtagccctggaaactgtctcctcatattttagttctagggtattgctggtaaaaaactaggtgctatatatttggttttgtttttctattgggggaaatgaagccaccttgtttctaagccgcattttagaaccagatgtcaaagaactttttagttagcatcaagattctgaatttctttctctctctcttttttttttcttttttgtttgtcagggtctcactgtatcactcaggctggaatgtagtggtgcgaccatggctcactgcagcctcgactgcctgggtttcagcaatccttccatctcagcctccttagtatttgggaccactgacgtgtgccaccatgcccggctattttttttttttttctttttagtatttttgctacaggtggggtttcgccgtgttgttcaggctggtctcaaacacctgaactcaagcaaccaacctgcctcagcatcccgaagtgctgggattacaggtgcatgcccctgcacccagccaacattctgatcttctgtagacactctaacaatgtgttgctttttcttgcttttaaaacctgccaggtggtcacttattatctatcattaaatatctgatatcaatcattttgtgcttttaaaatatgttcctcatatatattaaatgtcatatatgaattaaagttacttttcttaaaagtcaacttgttaggacatatatgtaattctgaaatagaataataattgctgccctccttctcctcctccttcttttcttcctgttctttctccttatcctcctttttttttctccttctccttcttcttctcctcttcctcctttctcctcctcctcttcctcctttctcctcctcctttttcttcttcagatatttgggtgtgctccacggtgtatcaccttaataaaacctaaaccaaacagaatttgcggtcagcaagaaatttcttttagaaaatattctttctttcaggatacgtaacaaatcaagtggctgcaaagccattgtgtgggtcagcattggtgacagcttcatgaatgttaacgttgaatgtcacatgtcagctgaaaatcatcataagcccctgaacatgatttttaaaaggcttatggtatgctcaggcatgacttcggactgaatgtcacgtcttagatttatgcatatgagcctaaaagcctaaatttttaaaaagagcagaaaactattttatgtgtttgtttctgaatactcaagtgccttgctttatctttccactgtgccttctatcctgactactttaactgataaaataatttgcaaagacggacagccatttccttgccagggtacattccagtgtgggagatttctaaatgctaattaattccaacctcaactattttacctgctgtttcaaaggctggcagcttgtattcatcacctgaatgacagctgtttctaacctcttttccctgaaaagaaataagaaattaaataaaccttttgcatgctaatcactgatattctgaactgacagttgaaaagtgttcaagtgtgagtcaaaggcagacttgaattgaaagactttgtctgcaccaactagttgttgaattttgaccagatatttgcgaagtgtagagagacagggttgcaggcaactgatgagacagtgttatcataagtgagagaataattagaagagactttaagtatgttaaatgtctacatttaagcaagttgagcaacataccttttttatttaagttttatagtacagatttttttttttcattttttacctagtgaattttcttccaggtcaatggacagatagaaaaagcaaggctttttaattttttaaaattttgtttacatgctatttttactttaaagtttattaagtctaattaattgtctcataataatggttgatatattgcttcccaaccagagctatcctttgtcaagatgtattttatttctactgtagttttaatttctgctttttacaataatggttggagttaagagcatttgactgattccccctaaacaaagtaaattttatgttaggaccatcttcttatatagtaaacatgcacagacagttttggaaaggattatttaatcttcatggaggattaacatttaaataccaatagtagattatgcttcttgatttgtttaaaggtatctaccactgaatgttttctcctgcatgttcctgactttctataagaccccagatagtatcgttcagtcagaagttgtagatctctcagagttcatgtatttcattaattcaagttgctttgatgatgcctacttttgttacaagaggatatgtttctttttattgttgtcttaaggttatcaccattcagtaattttactatcatatggtaaaatctgaccttccggtgctcttccctatgaattttaacagtcgtatacatttctgtaattagtcactatcacaatcagaatatagaacagttttatcattccccaaaacacttttgtgctatccctttatttacacctgctctccttacccctaactcctgagaaggtatttttgtgatgttaaaatataaagaagaatgagaaagtggaagaggaagaagaagaaggagcaggaagaagaaaggaagggagaggagggctggggaaggcaaggagagtgaagaaaggaaaactgggcgtgcaacccagtgaaatgttcattgaattcttatcaaagattgtatgtgttacctgggacagtatcttcaacacattgcattctcctttcttcatgtaagaagatgaaattgttcaaatgctttctgcagtcattctctaaattggaaattgtatactgtgccttgaaagtggaattatccccaatgataacttttctcatccggtactgtcagtactaggcttgtctgctgtcaatttgacatcatcccatctctgggatgcaatgaaaaggagaaaccaagaagcacataccccagagtcctcttttcttaatagttctgattccagattcccagtgaagggaatgcgtacaggatctgggaggcagaagagaagtggagtctgttgcagctgaatgtgtgggcagatgtgggattcctggtggcttgagaaccactcacttcactgctgcagacagtaatcactggtgggatctttccagggaatttccaggacaccttgcccataagccactgagaaccaccagtctggtgttgctctaggatgaggtttctgggtctgccttctcacccttctgcctgcccgtcccacaacttccaccatgacttttctgtcctttatccactctggctcacctatcatttgtggaaacgccaattcctgcattcaacttgctatttctggtgtctcttcaagtgacttggttttcctgcacaaatccagcctactaaaccatgatttaaagaaaagtttagtatttgtggccagcgtttaaaaattggaagatttctctttgaagtcctaatggctacttttcttttctttctttcttttttttttcttttttttggagactgagtctcgctctactgcccaggctggagtgcagtgggcctgatcttggctcactgcaacctctgcctcccaggttcaagcgattctcctgcctcagcctcccaagtagctgggatttaatagagctgggttttcatcatatttgccaggctggtcctgaactcctgacctcaaataatctgcccgtcttggcctcccaaagtgctgctgggatttcaggtatgagccaccatgcctggccaacttttcctttgagaaatcaagtcaggaaacactggaccagcattctggactgaagacaggggcgtcaaggttacaagtggctgtcaccttagtaagggtgtgattgtccacttcaccagccagcccacttcattgtatcatcttcttggaccttgcagcctttacatttgggtaccttccttgctaaataacatcaccttagtcttatttattaaaggattaccaattgcaaagctgttttctaggaactcctgggtatatggagatgtgtaagaagaaccgaatgcttttaaagagcttgggggaatgaactgcgggagacaaaagcaagcatgtgactgtcctgtgatagcaaagtacttgcatggaatgatcccttaaaggagggtgagaaaataaaatgagaaaataaacttagtagctcactatttgggtatttttgtatactcacatagagttttatggtggcctcacttgttattgatactctaattattgttgatgaaatttatctgcattttagtaagaatttcatataatgcaggctgtgtgaagtggcttatgcctgtaatcctagcactttgggaggccgaggtgggtggatcacctgaggtcaagagttcgacaccagcctggccaacatggtgaaaccctgtctctactaaaattagccgggcatattggcgagtgcctgtaatcccagctactggggaggctgaggcacgagaactgcttgagcccaggaggtggaggttgcagcgagccaagattgtgccattgcactccagcctgggtgacaagaacaaaactctgtctcaaaaaaaaaaaaattgtataaactggaaactcagtgaatgttgtggaataaatgcaaattaatctttttccaagtaagcaaattctcaaagtatgtttctttagaatattttttgttgatcactatctatctagttctatcacatatctgtatctaaataccaataatatatggattttaaagaagatgatatatatcagaaaaaattacacttaaaatttttccaatatgttgtatttaaataaaatacaaggggcattatcaggttaattaattgcagataaaagtaaatatagatatatatgagcctttttctttcttttttttacttttactctgcttggtgttgcataaatatgatagcatataatttttgatgcaggattttttcactttatgttgagatgttttgtatgctgaaataaaaatatgagaataagcaataattattgtaaggtcagcatctgttgattttcttttcctccaggtaaaaatagacattagtttatcagtttagagaaaagaacacaggtgcttcctagtggcaggcacctagcacactccaagtaggaattcatagatatgcctttttaaagtttatttcttttaattcactttcattccacgtgatttattttttgtggagggaagaagtagattcaattttgtattctcccccaatggctgatgaaagtatggacaatgtgtattttgctatgcatgtgaggtgtatgtgtgcatgtacaacacatacacatatatattttggtggagacacaaaggacatttatttgggcaactccaaacctgtttaagtttgatcccttccagatggccggatacctggctgtcggatccttggctcagcccatttcttatctcccaaatatccctttgtgcttctctgagaatacggcatatcttagagctggatgagtttcctgttaggacagctcacagattcgccgagcaagctggggacagtcaaagttgtcttacagaaaaggctcacatcttttaacaaatgtacgtctttgaaaagtgcattttgctctataacaatgtttctggctttgttatagaggcagaacagcaaagtgaagtgattcagaacattgggaagaccagcatgattccatttctgactccggcattggccacaggcccttgtgtatgctctgcaaactagctgagcctcagtttaccttccatacacgggggcaccagcagtacctacctcacaagggtgttgtaaagaataaatgtgataattcaagtaaaggctttagcaagatgattggttcataataagtggtaaacacatggtaactaatagtaataatattggtgctaaggcatttgtgctaagacagtggggctcaaatttgagtgtgcatcagagtcacctagagggcttattaaaacacagatggcctaccccccaccctgcagagttctgactcaggaaatctggattttgcatttctagcaagctcccagggaatgctaatgctgctggccctaaaactgcagaatgaccactgacctaaggcattcagactccagactatttcttggggcaggtgaggactgcagtttggtcatggatcagagtgaaggatcagatgtgggattacatccttcaaccttgggcaatgcttctacagccacgatcctggtagctcaatgctggcccagtgtttatcaagtacaacaaaaataggaagtcctgtatttgcttacatctaccattcaacaactcacaaaaactttctatcttgtttttcacatccttaactttcaaggagcagctccctcgcctgctccagagcaagtatttcccctccaaggcatcagaggactgtcatcagctgcctcaattctgccttcctttggcacagagcaagtatcacatcctctgtgcccccaccagctgattgcagctcctttgaggagtggagattttatttcactctggctccttttcaggagagaatcctcttccctggattttgtcagaggagggttttgggtaagctaagcaggccatgcacaaatacttgatgggagtggggaatggctgtgaaccaaatattttcatttcttcacacttaactgaaacagctgccttcaccttggtgactcatattctaatcaaatccttaactagctgtggaccctcatcaaataccatttgcttattttggctttaacagtgggtggcatctatcacttactgattgtgacagaccactgctgagttcttcacctgcaacatttccttttatctttcctaggagtctatggcctgagaagtgaggtggcaaagatgctcatacagcaactctaactgtttccagccgttctaatgccaacacagacccatctgtcttctggtcttttgctggtgccctctgtctaccaaacctgtggtactgcaagctctaaaataggcctccctgggccaagagcagggtaaagaattacagagaatcagtggtggggcagaaacagggtaggtggcagacagaagacaatgagtaacgtacctaaggaaaattttaggagacaaaggctatgtcaagtgcctagcctaatacaggactttcgctaagtaacaaaactagggtttgaagcctggatcatctgaatcaaattataatcatgccaatggagcatccctgccttttaggagcctgcaaaacaggttgacattatcacaaagcaaattgtgtgtataatcagtattgtccttacacgtatatgagtagatagaactattcaggtggggaagtgttctctcctccattctgagatattctgaaatgaaaggttaatagtcagttatttttggaaaatatgtacacttttcacttcgatatccactcagcaataagtacaaccatcagaattatgctttagcgatttggcttttctctgcccccagccatacatttaaccaagaccaaaatgttcactttagtttcagaaagattttttttctttgtagaacaaaaatgcaagtgacctaaaaagggaattgacttttaaaaataatcttcgtatatctaagtttgaaatgtttaactctaaagttcagcataggaatgatacattatcatttagtgtaagaaattcatctttaaaataagtgtgttattttagcaattgcaaagctttatctttctgaagaacaaattctccccttcagaggcagggttttagtattaaattgcctataaatgttcaaatgtgacttgcaggtcaaaaatcacagtttaagtggatttgatggattttcagacatagtttataatgtgatttcaggtcactacttgttccaattgaaacatcaagctaacagttaataaaaagtaatgcagacgcttgtccaatctgattgcctggtgaattaggctccttttggaaaatattctcatactcatggaagcaaacatgaactggctcattgacgcattcatggttttctttccatatgtttgagtgcctgctatgtgacaagcattgtgcttcaaagatgtttatattttaattttgcactttggcacaagactgatataatgggcatcattgttgagagtgtctgtcatttgaccagcacttaatgtatcttatctctaagctgtacatcaaccctattatatttttattattatttccacttcatctttgtttaactgaagctcaaagaaaccaaaaaacttgatgaacatcaccgagttagtctgtggtcaagttgtgatttcagctcaagtgcatgtcagggcaaatacaatattttttttagactatgtgtgcacttattgtcccttcttgaccatctctagggttgtctatgctgtcacctcagctgatcacttggcagtaagagacatactggctgctagtgttttaacttctgaaaaatctaattcttgaaaacgtggggccaggttgaagagacagggtctgattaaggcagatggcttctaggatgtgtgccatactggctgagttatatcattctaggctactagaatggttcatcctggggttttcagactcatgctgtcttgcagacactggttgttcattagggaccacattatacatctcaggttcaagagagatgactcttccacagatctcttctattgtgggacgtggaagtcttgcctgggtctaagggaatgaccaaattagaatagcaggattgagaagaaacaattaaatctatggtgtcatgggacttggcaggacgtaaacataggaattctagaatattttatcaaagtaagaataacctctgtaaggacaaggacctggtctcaccaatgaaccggcaagaactagagacataggcaagcccacattaggtattattttgttttgttaggtttgttgcttcagagggagattcaagcttggtgcacagaaacttcagggaaataatatcctagtttcaagcttattcctggactgcatcttggacttcagggtctccattgaagagaatacatgaaactttgggagagtaggcctctgacattcttagagttatttcctgggcctctgagatgttgcagggcttgttttagggagaatgttttagtgaaaagacttgaggtcaggatgacctgctgtgacaatcttcaaacttaggagtcgttaaaaggcttctttgttgcttggttggttgaggacttactggcctatgggatctggctttttatgcaaaatcactagggaattgcaaatttagaattagaagggggagatacttcaagtgtatcttctttcagtactgagcttaatatgtagagaaccaaggcagcccactcactaccaacaaacatcagatttctctcttgcctcagtcagtcagttgggaatgagtcttgaggaaatggattgggggattgagggttagagccatggtttactgcagtggtgtgtagtgttcatgaataggccagccctgaatgtatggtttctgtttagaagtttgtgagtaggtatcagatccccatacataacactagtgaagctgaggaacaaaaaatccagttcttacagaactggggtatcaagtaggtaactggccatggatgtaaatgcaggaagctggttatgagtaagccaagtacacagcaagacttgtgttttactcaagcatggtgactagatcccatctcaagcacctcctttgatcaatgagtaatggcttctcagagcactctattgagaagtattctgaggctccgtatcagctaagtgagaaaggatgctgtgcttgattaataatgtctgtcatagtcatgaagtaagagaggagtggtggcacctgtaccacatatttgttatccctattaagctttggaggcactgctgtaggactccgagggcatcactggccccagagactggacaaaatgaacccagataatgtgaataaagtaacccagcaacccacttctccgttgcagctgtttcaaactattcctgtatttttcaagctcatgaaactctgacaatcctccatgcttaaaagataacccctttggctttcctgaaaggaaggaagccatgtgtcatgagttaccctgtgtccctgcctccatcactcagtgtctcttatcttcccccatctttcctcccgtgtttttccatgacagaggataaagtgtcctccctccccttcagggcagcttctccattttttttttttttttccagagcttattactcatcacttaaaatagctgttgtggggaaataaggtttgcttggaaatgcattcctgatcccaagaggcctctcccataccatcctgccctcccctgtgactgtaacttaccagtgggcatgattttcacaaattactatttttctttgtttcaagttaattttgctctgtcatcaagctatcagattacagctctaattctaactaattgtgcatggaatttgcatgattttgtaaaatacagacaaaggaaagtggaaattcggcttcctggttcccaccccttgctgagcatgtctcacataggcctgatgctgtttaattacatgagttggagttcatggtcaagtgtaaagaatgtgggtataatgttgccatctaatagttcaaaggaaatacagcttagatctgttattaaaattgtgttctgatgtatttgaagtgttaacatctatgctgagaacgaggtcttgaatattatattttcagtttatatttgaagttgagattttggattgtgtttacgttttctgaacttgctttcttccttagttgaccttatgcagggaacaacttattaatatttaagtactaatcccagtactgccttccatcaaaagcaacccacatatctcattagcaactcacattagtattgattaaaaaattttcttgcttacttttataatctttatttagctgagttgtacagtatttgtgatatttctatcatcatatatcatcagtggaaatatatttttttcatattttatatgtatacatgcattagtttttatactgtaagttgctcacctgaaagtggtttttaaaaatcataagtattcacaaagagggaagtaaaaggttcaatatctaaaatcatcctttttaaaggaacatgacattctcctaaaacaatagaaagtatactcattgcatatttctttaagacagggaaaaggaaacagttctgttttttaaagatgtggagagagacagggagcaagaaagaacagagccaaaaactacttctatttttaagaaaagagggagaaattgaatatgctttttacaaggagaagacacagtatacagtggtatgtgtcagactttcagtaaaagcaagcttctttactcatatctaataaataatagaccagaaaaaaaagggcctggtcatcttattttataatgaaatgataaaatgcagataaactgaacctctgagtcaaaaatgtattgggttcaaaggccatttttaggatagctttgacctttccataaagtgtgaaaggttcctgtctcccataaagttgtgaccttaaagagcaagatgtattcattgtgtttttaattttttatttatttatttatgtttgagacaggagtctctctctgtcgcccaggttggagtgcagtggtgtgatctcggctcactgcaaactccgcctcctgggttcacgccattctcctgtctcagcctaccgagtagctgggactacaggcgcctgccaccacgcccagctaattttttgtatttttggtagagatggggtttcacgtgttagccaggatggtctcgatctcctgacctcatggtccgcccacctcggcctcccaaagttcagggattacaggcgtaagccaccgtgcccggcctcattgtttaaaaaagttataaaagaaatagagagtgctctgacccatcagatgtgtagttgtggtgtctgtcacacagaattctgtcaagaaaatagctagcgagtcttgaacataaggcattctgaggccaacatccccttttgatttctaaaggacttattgttacttctggttttacaaattgcaaattagggtcttaaaaattttagtatttgatgttagttcactgaactctcttgtcagccaattcataaggagaatttactgcctaccatgtatctgacaatgaaatggagaaccggtagaaacagcccttagtctcagtgttgagatgagtgagtgttcatttagaatgcatttcaccagtacttcttcagtttgattgttaacccatttggtttctaagtcttaggagatatgcaaatgctgaagtcctcaatgttctaatgcggtaaatagatttttttttctttgttgttatgtgagacaccttaagtatagattggtgttaaaacaagtttataataatgctattgatgtgtaaaaacaagctttctaaatgaaaatcaatacctgggacagcttataaactattcttcataatccctttgggtggaattcacagagtggttgtttctttttggtttaaatgctaaatctggccatctttggttatcaaatggaatttgatgatccaaaatgtatttaccacatttgttggatctacttatgaatctttggaaaaactaattgtagtaaaatgggaaaaggctgggacttgtcatctgggtgaacctgaacacggtaaaacctccctgtagaaaacctaatatttgtaatctgtaaaatggaattgaaattatatatatatttaaatatataaattatatataattattattatataattaatattatataattatatataatataaattataaataaattataaatatataaatgtataaattataaattatatataataattatatagttattatatataatttatataaatacaaatatataatatatataatttaggtaaatatacatataatatatttatatttatataaaattataaataaattataaatatataaatgtataaatatataaattataaattataaatatataaataaattttatataacataaattataaatatataaatatataaataaattttatataatataaattataaatatattatatataatttatattatatgtaattaaatatattatataattatttaattatatattatatataatttatattttatataattaaatatattatatatttaattatataagtatattatatataatttatattttatataattaaatatattaaatatattatatatttatatttatattatatattatatatttatattatatataatttatattatatataattaaatatattaaatatttaatgtattaaatatattaaatataatttatattatatataacttatatattataatttataaattatattatatgtactttatataatttatataatataatatataatttatataatatatcatttacataatataatttatataatatataatttttattatatataatttatataatataatataatttttattatatatagtttatataatataatataatttttattatatataatttatataacatatactatataatttttattatatatatgctgtatataactatagttataatttccatcagttttgcccttctcttcttctccatgtttaatgttccatggtctacacacctcattgccctccacacaagttagtgttatcgtatattgcgatatgtctgccatcaagtgtgtattcatgatatatccaaggtagaaggcatgtttttctttttccaggcctgtgtggccaagaagcatttctgaatcatgtgaattcattctgcaacctcatctaccagtgttcacccttcccccactactgccctgaaatttcaccattttaagtttattgctttttgtcttgtagtttctaactctgcgaccagcgctcccccacccccagccctgcaactgcaatgcattatgatttcttttaaatttgtttcaatgcctgagcttggggccccaaaactatagactggactcttacagagctgaaggagagagggggaagcgaaggagttcatctgggataaataaaagaaaggaatgtcagggaaggagaaggacccacaatcactatctcacagatttacgtggatgttttacaatgagattaaccatatttagaatcctagacattttatttttgcaatcagtttttctgaaaagaaagaattcttactgtttagctgaaatacagcttttagctgttttttttttttgtaattcagtaacttatgtgatgtttttattgatttccattatctctcattgtttttaacctagtactaaatggaaaacctaggctagcatttatttgtacaacttagtgcatggtttaaggaaaaaggggaaaaaagccttgtttacttgccctataacctagtgcttacctctgaggtttatttaacatggcaggtggtgacgaactgcagcttatgacatctcttgcaatgtaattcaccactcaatgacgaatgcttctgacaaatggaaacctggtattattctaaaacagaaaaaagatcaatatcatttggatatgggatagtaaaaatggcttctctaaacacgtgaaataaattagccctttaaggtgagaccatattataagtggcaaagataaaatagagtggaatttttgttttccttagaatttttttcttgtcagttgtcagagtaaattaatactcttagaagcagtcctattaccatgccaccctgtgctgttgtttttttagtagtttgcattgttagtgctaattaaaaaactatcttggaagttaattgggggtgatactagttagttgtgactgaggacataaccatgttaattatcgattgtaggtcagacaaagggctaggcttttctacctcttgaatcttaactaaggtcatgagtaagttgtttttaaatcataaaattttagtgttagacaattgctagaggacaagcgtaacttcacatttaattagggggcagttggagatgttagtggtgtgttgttgggcagttgccacacgcttctgatgatgtagtaaatcagcagtgaaattaggtgagactcactacatgaatacacgtttatgtaacagtttttctcagacttcggtcacatgccaccttcaagatatttcctgcctgcaccattacttatttgatattttcctctaagctaattacagtgttactttatttgtacttatctttgacaataagcaataatactcataaattcagagactgattttttaaaattatacattaaaaacacattatcaatgattttttttagtatatgtgctgctgaagtgagcacacaatttttttttaatttagcttttttaatgtaaaaaagaacttggaccacttttaaatacctcacattttaggatacatttatatgatctatatatatgccattcattttcataatttcttagttttttttgtagttttagaaacattgattttccccacatttgtggaaattggaactgtgtttatgtatatgtaatactgaaaaggagacgaaaagaaaacacgtttcacagagttacttcttggtctgttctggaattataatagcgagtactaataagaacaggcacactttgggacattgtatggaagaggcttctagtggcaaagtgatgagaggcagagctgggagcaggaccagttcaccagccacagcccattccagagagtcatagatggcaaaatagcagctctaatcgattggtaatggctgatggctgtttctgttgagaactctgaggcttagtctgggctcagcagggaggagtgcagtgctgatagtgatgtctgacccaggctggaaataggcaggaatagcgagaatgccagggatttgccatgtctctactgtgggacagaaccagtgtgtagcacttctctgggtatcgttttacatagaaataaatgtattttaaattgttttgtttttggagcattggatttgtcatctacttaatatctccatccttgttattttttactttggtgtgtaattttattgtactatgcatctaatatcaatcatcataaaagttttatttttcaattacttttttataatagaagttatattggctcatcctttgcttttctctgaccatattctattaggttggtgcaaaaataattgcggtttttgccaacctaataatatccactcttgtctagtgctatttgcaaggcttatccagcctcaaactgaattccacaaagtggttttggactaactagacctctctggagtctcttgttgaagttgaagttgaattcactcacttatatttgtctgtttctaatgtgtatgtattaccttctgtatttccacactcacatcagtcagaatgcaaaggatgcaacaaatttatgtggtattaatcagtatttttctataaatgacatcagaaatgtaagcggatggtttataaataactaggactatcttttaagagtgggagcttcttgacattggctcaggacaatttccagaaaggtccagattttcaaacatacaaataagaatgtttcctttccgttcagatttcttcttcttgtcctgcttccagagatagatgagaagacaaagggttgaactggcagattctactctagtttaaatgggggcaccaagatttgcatttttaaaacaagtcctggcactcccatccaggcttattcctgtccaagggccaaggttgttttctttggcactgcattcacccttagagcttctggaagatccgctgattagcccggttctactcttgcatgttccccatgtccagattctatccctcaggtaccccaaatcagtatgtaacctattcctaatcagaaatctcaagctttgccctgtaggccatttctcctgatttttccatgctcattctaaacagcagtagttctcacatttaagcatgcatcagagtcacctatagggcttgttaaaacacagataactgggccccacccttagatttcagatcaggtaggcttggggtggggcttgaaaatttgcatttctaacacactcccaggttgttgatgctgctagtctggggaccatacctaagaacactgcaaaatgtttcttttcttcatttcaagccccaccaaactgagactgattatgtaggtgttggcctagttgccctctaaatgatctttatttatctaaatagctgcttgcaacatgtaaaaattcaaaaggtgaaaagtatataagaattttcagcagggattcttctggtgcccctgaattctttttgttgttgttgttggtttgtttgtttgtttgagacggagtttcgctcttgttgcccaggctggagtgcagtagcgcaatctcggctcactgcaacctccacctctagggttcaagagattctcctgcctcagcctcctgagtagctaggattacaggcatgtgccaccatgcctggccaattttgtatttttagtagagacgggtttcgccatgttggtcaggcttgtcttgaactcttgacctcaggtgatccacccacctcagccccacaaagtgctgggattacaggcatgagccgccgcacccaactgtccctgaattcttcccaccattcctgccagctcctctttcccatccagtcctctgtcccactacctttatttcttctttttccctccctccccaaatacaagcaaaccaaccaacaaaaacccagaacacacataggctggaacacaaggggataacatgccttgaattgcaatgccataaagatgtacaactctagggacgggatggcgtccacacagaagcaatgtgaacaatgccccctggagttgtacaacgtggggccttgttgagcagtactgtttcgcaacacatagtagcaagaatcctctttgtaagccctattccatctgcctggttggttttggcaggatggctgactaacccactagtgggaatccacagctaggatagaccctccagctctttggctggcttctaaaaggccacgactttagaaaacccatctgtaatacctgatttaccacaagaggtagccttaggcctagatcagtctagacacttgtcagcagccccaccttcagtgagaaggactcagaaaacactgtctcattggtttactcatggggaatcttcctggtcccacccaaggaaatgcctcctgtacaaattctcttcccaaagagactaacagcaagagaatcccagaaggggtcaaaactcaaggggtcatattcctgattccttatattcctgattcagtttaaatcaacccctcaatttacacatcaatctgtctaatccctctacagccctttggctcttctccacacccttggctgggaaactttcttcttccctcctcagccagttcacacccttcattattcagcacatgttgaaatgagcatcatcggagctaccactccctggatgcttcgtcatatcactgggagagaaggtggagaatgttcccccagcagaaagctcccacaccatcctgtgtgcagacttcccagggggaggtctgtgctgtatatcttgttttgaaatgtaatgacttagtattttccactgaattcccttgcctggtcagcttccacagcatatctgtgctatagacaataatgaaaagagggttttcgtatgttttttcttttattatatggaggattaatatgctgcaatgcatctaccatattgtgtgcctttttcacaaacatttttattagaaagatcaattctcagcctagatccaactatgatacttttaaaatcctgtcattatctcccctctgctaacgaattcaggggaagaacaggtttctggtttctcattatttctaggggtagaattccacatcaaatatagaaaagcatcttatacatggaacttttttttttcctttggaaggggggcttcttctgtgacactatccacacacttttttagtgacttctttttcatcaattaattcagattgtctgaagactagaaattggggctttggcaagggtgaacagcgattaaaatatatatctccgctcacatttctgcccacatggttctttttctgagagagtggttaggaacagtgctagtcttgctaaaactgctgagtttcatttcacactaataacacctggcatctttatgtgctaaggataaattaagcactcagtgaacacagggtagacatgggttttgctatgatgtagcttattctgcactcattatatagagagagaaatctgtgttgtgaaaatgtgtgtgtaggcatgtatgcaacattgcaaaaaatattaatagctctggccattttgctgattttagataaaggtagcactatcatatattccgattagttattaatagaaatactgagaatattagaggtgaaatggcccttaaaaatcatgtagtccaaaaatctcattttacagactgaagaaattgagaaccagggtgattattttcaggaattatagaatatattctgtgaatttaggcagaatcaaaatagaactcaaagatttaatacccattccagggcactttctaccataccacgctgttcctcaaataataaataaattattcaaatacacgaacattatgtcatttttacagaattctaagttgtgtgttttttgggttgttgttttgttttgtttttgagacagggttttgctctgccaccaaggctggagtgcagtggcgcaatcacagctcactgcagcctagacctcctgggctcaaacgatatcgcccacggcccctcaactccccatcccacttcggcctcccaaagtgcaaggattacaggtgtgagtcactgcgccagcctaagttaggtgtttaaatgattctaagacacacattctttcacattttgaaaatattttattttgaatttttagacttacagaaaagttgcaaaaataattcaaagagtttaaaaaatatacacctctctcatcccactccttctaatggtaatatcttagaaaaccatatgacaattatcaagaacaagaaattaacaattatacaatatcaataactaaacttcagaccttatttgaattttgccagtttttctactaacctttttgtttgtttgtttttgagacggagtctcactctcgctcagactggagtgcagtggtaccatctgggctcactgcaacctctgcttcccagtttcaagcaatcctcccacgttggcctcccgagtagccaggactacaggcgtgtgccaccacacccagctagtgacctttttgttgttgttgttctaggatctcacattacatttatttgttcttaatctcttccagcctataactggttctcagtcttttcttagcttttgtgacttggcacttttgaagagtactcctcagttatttctgtacaatgtccctcaatttgacatttttttctagagagagaatctcacgctgtcacccaggctggagtacattggctcaatcatagctcactgcatccttgacctcctgggctcaagtgatcctcccatctcagcctctcaagtacacacacatatatatagtatttatatatatatatagtatttatatatagttatgtttgttttgtttctgagacagaattttgctctctctctctctctttctctctctctctctttctctctgtctctatatatatgtgtatgaaaagttacgctataacaagtgtggaaataccaagcaaataaaagtctgtaaaaagaatacctcctcttcctcttttcttcctcctcctcttcttccttttcttcattacttcttccttcttatctttcttattctcttcttttttttctttttattctaacctttctttcttcttttccttttcctcctctccctcctcaccaatgctctttctctcgtctgtccactttcctctctccatatttcacctactaaaatagtatttatttggtccacattcccgtaaaattgctgttgtttggggaaaaaaaactctaaggaaactcagaaagctgtgttacccaaatcatttacaatttgagttggttggagaatatgccatggagaaagcctgttcggagatgattagcatgccagtccaatgtcttttcctacttaaatttttaagatagtttaggactccgataactattatgtcttagctagtggttattcagaaataaaataaaaaaactgtaccatactttttttcaccaagtagaattagctcagagcacagtgcattgggtgtctgggcttctggtaggtgaggctgggatgtgcaggtagagattattgagtaccgtagtagtacagcagcatccaagtttaaatttgagggtgggtgtcagcttagaaaatctgagtgcttgcaagggctgagaatttctccagcctttcctgcagctgtcagaagtgccctgttttgcccttccctcacacctcctcccaataattctattactcaggggaaggagacctgggagggtgaaatgactcattattctattagacaatgggacgcttgggttttgactaaggctgctcagactgccagagtcccgacctccatggcaatccagaggcacaggaaatctgagatttaaagttgtgaactcagtattgacatgaaaaatgccacttgtgttgtgctgaaacaggtatgctgattatgtaacagcttccaacacattccctgccggtggtgggttttgattgacattttatgagccttattactcttgaaaacaatactgaaaatgccatgacaagctcaggatggaaatatgaacacacgatcctcttcctgctgaactagaaaatagcttttcgaaattcttggaagaaagtggaaagttcttcatgtagattcataatgatcaatctctttttgtttcttgggaggagaaggatcctcaaatcttatagcaatttagcatggtctagtccccagaacttttctttgggcttcttacaacttacaaataaatgttgacttctaaagtagagagggaaatgcataggatatcaatggcttgataaatatttacagcaataaattacagttttttgcattcatagtaattccttggtagagggagtttattgtttaaacaatatagagatggaaatgcagcagaaattcagatttttttctgtgtttttttttcttctctgtataaggtgattttttttcttctctgtataacaaattttcaaagtagaatggaggttcaagaatgtcaatgaaatataaatggtatggtgcatttgctttcattgaattgttggctctccttaagtatattaggatagcaaactctctgaattaggatttcaacctcttcgatttccttctgattttgtgtaactaaaatatataaatgagactgcacacaggccgggcgcggtggctcacgcctgtaatcccagcactttgggaggccgaggagggcagatcacgaggtcaggagatcgagaccatcctggctaacacggtgaaaccccgtctctactaaaaatacaaaaaaattagccgggcgtggtggcgggcacctgtagtcctagctactcaggaggctgaggcagaagaatggcgtgaatctgggaggtggagcttgcagtgagccgagatcgcgccactgcacttcagcctgggcgacagagcaagactccatctcaaaaaaataaaaaaaataaaaaaaaaataaagagagactgcacgcacactagcatccctggattccaaatacctatctgctttgttataaaattaatagtaataatagcagcaacaatggaaatagtagctagatttattgagttcatattgtttttaacttgtgaacccaagcagtcccatagccactgtgctatactttagtgttatttttaaaaatcacgctcaactaaaaatgggaagcccaggcagctggtttggtgtcacttctctgctaagatgaatgccctctgcaccctcaagtggtgaagcaggtataggcggaatacatacagaatgaaaaactgtatttgtgaaacactttgaaggaaaggtgttgtgaaaattgtgttttgttaagtattgagggatatggaattagaaataatagtacagttgagacagaaagatcatttttctgaagcacatgtttagtgtcggcaaaggttaagctgtttttgatgaacctgttttcatgtgaaaattactataaatggtcagcagatacttgcttttaaggagcctacttctgattggtcagccagataagcgtgtatgtggtgattgttaagaagcagctggtgtcagtttaaaagaatgatgttctatcctcttccgtcttgaccagtctgagaacagtaacatcaatatttgaagttatatattcaatattcattacaatattctgaaactagttgttcatggaaatatatcggtaacttaacacaattccaaatgccattttttatagttatacttttttgctgtttcttaaaatgatattactagatccatattctaattgtttccaacctagggacggctaaaagttatttttttttctttttttttttttttttttttttttgagacggagtctctctcagtcccccaggctggagtgtagtggcccgatctcggctcactgcaagctccgcctcccgggttcacgccattctcctgactcagcctccctagtaactggggctataggcgcccgccactatgcccagctaattttttttttttttgtatttttagtagagacgcggtttcactgtgttagccaggatggtctcgatctcctgacctcgtgatccacccgtctcggccttccaaagtgctgggattacgggcgtgagccaccgcacctggccttaatatatatttttataacttcatcatagaggtgataaattttatccagtataaaacagtgcattttaaaaatctcattttgcttcaacaacatacagtaactggaagcatggctactgctatcttatttaaacaagtataaataaccaaaatctacagagcaaattatggtgcagttgaaaaatatgactacttttcagtggggtatgtttatatgaatattcaaggagatgacaaatatttacatttttcattcctcattattaagaacttgagaaaactaacgagtatttattactcctgaagtgaaagataatgagacaaaatcctgaagacatttctcttttggataactgtggttttaaactccataagcaataaagccactgtcaatggaattattttagatgttatcttttgacgatggattatgttttttcttgtctttttaatattaatttacatttagttatgtcatatagtaaagcatgctaatcttaagcatatgtacttgtgtaaccacctccgatgaagatatggaacatgcctataatcccagcactttgggaggctgaggcagggggagcgtttgagcccaggagtttgacaccagcctggacagcatagtgagactccatttctacgaagaataaaaaagtcattaaagcatggtggtgcatgcctgtagacccagctactcaggaggctgaggtgagaggattgcttgaggccaggttgtcaagggtgcagtgagctgtgattgtgtcactgcactccagcctgggcaacagagcaagaacctgtcttcagatgcttcttcatcacccttctcatttcatcctctcttcccgtacaaagcagccattcttctgagctctgtcatcatccattagttttgcctgttcttgaacttcatgtaaatagattcatactatatgttctcttttgcatctagactcttgctcaacaagacattttgaagtaatctatgttgttgcatatacaaacaattcattttttacactaccatgtagtatgccattgtatgtacaggcatttttttatcactgttgtgccaatgggtatttgaatttttcctattcataatttaacaattatgtataaagctgctatgaacattcttgaagctgtcttttcatgagcaattacattcacatttctctgaaatatatacaggaattgaattgtttaaacaaataatttatggtatgtgtgtaatagtggatatgtattgatgggtgtgtactgatatttcaatgtggttttaatttgcatttccttgaaaagaatgacattgaatactttttcatgttcttatcagccatttgaatctttttttgtaaatgcttcaagtctttgctgattttaaaatcaatttctttctaaatgatttttgttagttttgtttgtttgtttgttttgagacggagtctctctctgacacccaggctggagtgcaatggtgccatctctgctcactgcaacctccacctccctggatcaagcaattcacctgcctcagcctcctgagtagctgggattacaggtatttttagtagagacggggtctcaccatgttggccagactggtctcgaattcctgaactcaggcaatccgcccgcctcggcctcccaaagtgctaagattacaggcgtgagccaccgtgcctggccggtagttttgtttgtttgtttgtttttgttttttttgaatgctttggatttgagtccatcatcagatatagactgtgaatattatttctcagtctgtgtcttgccacttcactctcttagtgtcaacttttgatgaacagaaactctacaaattagacttaaatgtaattttttaaatgattaatgattgtttcctgtttaagtaaacttgcctattccatttcttattttcttatttatccaattctcttccatgctagtgcttttgagttctatgtgagaagtctgccaatttacttcatattttcttaagcaaaatattttgaacaaaacttagctttcctaatgactcagggtcctcatttttaatagtaattactactgtccaataaattttatataacctacccgatagtgttgttaccaggataaggaagatatgtatgaaaattcttgatacatgcaggctgttgtcctttttgttctactctaatacttcttattcttattaagggtataggacagttattaatatttttatgctcagtggttttcgacaactctaaattttaagttattatatcaaattctgggctggacaggtaaggtgtttgccatacatgattgcaattgtgaggtttctttgtgtataaagtctttaaatttatatggtaggtcaaaaaacatattagctgataataatacttactttcaaatatcacttaaaatttctcttcaaaagcatttttttaaatctctttttaacaccttgacccaatgaagtaaaataaacaagatgatactcccgttaaatgtgtgtacaatcattcagctgctgtggcagaatatacaacagttctcagccctgtgtggtcctttctcaatttgtcactcaattgattgtactcatacatgtgttagaccaacatcctcaataccgtttgttggttagcatcatctggggagactgtaaaagcataagaatattcagctaccaacccagggggttctttaaattagtgggactggggtggtgtccaggcatcagttgtaaaaaaaaagaaaaaaaatattttattgtgcaacctggacgtgattctcctgttggcttggggcagggttatgcaaacttcagcatgcattagaatcacctgaagggcttgttcaagcacagactggggggctccacccccagagtttctgattcagtaagtctggatggacccaagaatttgcaatactggaaagttttcagatgatgctgatgctgctggctggggaccacagttcgataacctctggattagatagccatcaccatccctaccacaagtaaaacttgctggtcattctcatctgttgctgtctcccatctgcctcttctagccctggggttcaagttctgtttgtttgttttgttttgttttcacgcacaatactaagctatttattttctcacttgctcagagagagctttaggattgactatgtattactttacctcttttcaaaagaactaagtatctccaatatgaactgtgagatgacttttgatagtaggtatttcatctcaaagagtgcaagtatgtcaaaagaggggaatttgagaataaaacttagaagcaaatagagatcaccttagaactactcattcagccagaaaatcaggtcacaaaattatagcacctatctccagtttatatatatatatatataaatctgtacaggaatagaaaaaaacctggacccaaacatcagagtgttggtaatggtagtatccaggtatttggggttatcaatgatctggtggccttttgttatctatatcttacgattattttttccataggaaaaactgaataaaagtaaagcaatttaaaagctatataaatgcttttacacacacacacacacacacacacacacacacacacacacatatataagcatttattcagcacagatttgatgaaactcctctacctatgaccatgccaagcataacagggtctcagaacacagaagcttacagacctgttgagcagataggaacccccagtttatattttcatgaaatctagtaaaatgttgagtctctttgtagtcgtaagaaaaatatataaagacattaatgatcattgactgtgggagacaatttcttaggatgtaagtgcctttgattttttttcctaaagaaaagttgaaaggacttggcctggtaaaagctgcttttaacttgaatctacaccttttatttttgaagtcttaaagagttttattcatttatattagattcagctggataaggatcagtttctttcactttgggtcatgggccctccaagaatgaaatgatactttattcactggaagcatagaattgctttaaacataaatgaattatggctctgttaataaccattaatgttcacatctccaaaaggtagcaagaccctatttataaactaaattcactggttggttgacatatgatccttgtcctcttccatcatcgtcatcatcatcattgtaatatatagttgtattagtccattctcacgctgctatgaaaaaataccttaaatttataaagaaaagaggtttaattaactcacagttccacatggccgaggaagcctcaggaaacttacaatcatagcagaaggcacctcttcacagggcagcaggagagagaaagagagccaagcaaagggggaaaagccccttatacaaccatcacccccatgattcaattgccttctaccaggtccctcccatgacacctggggattatgggaactacagttcaagatgagatttgggtgggaacacagtcaaactatatcaatagtatatatcgttattagattctaaagtcagcctataaaataaatcaaaattcatgttaagtcaaaattaacctcgtttaagtgttttttcaagctactttaaaaaaggaaaacaatcttgaaatttccttaagaggctttttattgcagacctacatttatcaatgagatcaacagagccattttttcctccagtgttgaagggatgtatttcttcagttcaccagaaaaagtgattggtttgtattcatattcatgttgtatgaaaactatgaataatgtctttatttttaatgcaatttatttatttgattaaattttttaaaaaatttatttagtcattcattgatttaagagagtatctcactcactctgttacccaggatggagtgctatggtacagtcatggctcactgcatccttaacctcttgggctcaaacgatcctcctgcctcagcctcttcagtagctggaacgacaggtgcacaccagtgaggtctcactatgttgtccaggctagtcttgaactcctatgctcaagcaatcctcccacctcagcctcccaaagcactaggattacaggcatgagccaccatgctcagcaaaaaaacagtgtctttaaacactctgaatcactcttagctatgatacttacactatgaaaggaacatgggaactgaatacaggcatccctttgtatcagtgagggattgcttccaggatgctcaagtcccttttataaaatgacgtagtatttgcatataacttacgcacattctcctgtagactttcaatcagtcagtatactccagattacttcaaatacctaacaaagtgtaaatactatacaaatagttgttgtactgtttagagaataatgacaagaacagatagtccatacatgttcagtacagacagaaccatgcatgttttttttctgaatatttttgatgggtaaccgtcaccttaagaggtgagtagttgcatgggtaaccatcaaaaatattggttgaatccatggatatgaaatccatggatatggagggctgattgtatgatggaaatggtttatccagacctctcagcccattcaaagagaggaatagcagattccatttgacattagtaggtaaagggaggggggggactctgaattacttattctctctaactctttttccttctgttctaagtatctattgatagttattaaatcaccgcagaatccaggggcttaaaataatgtatcattatatcttacattcctgtgggttgactgggttcactggggcaggtctcacttggggtccctcatgcaattgtagtttgtaggctgctggggcttgagtcatctgaagactcaacctggctggacatccaagatggtattttcacatagggcccaaagattggttggatcaggtgtgacatttacatagcgcatggggaagctggccaccccaccctaatcttataaaaataggttctttgcttggccggcggcatgttgcttgcttcttactacacaagttgatggcaaagagaagggaaaatggagccgccatgttggacatgcctagacccaggtagccttttcctattggcacaactgccggcattcacccgggcaagcttctagcttgcttgtctatgtctgcagctcagttttacgggctgctttttgttagaaaagaaaatgatttgggggcttcttttcattaaaaggaaaaccttaccaagtactcctctaccctcactatctgcctaaataatttcttcttaactcctatatcactggttttgcctgctgtaaacatgccaaggggcaggaagcagaaaatgccaggccattaggggctgtaggtagaactgccatagtgctctttctactcaattctattggtgtaagtagtcacagagcctgcccagactgaagagagtggagaaaggcttctcttgatgtgggaggggcaaggtcacattgcattaaaacatgtgggctgggagatattgctgtagccatctttggaaaatacaatcgattataccctcccttcctctttctcactctctttctctcatctcctctcttttctcaccttcctaagcatagggttgggtctgtctgtgtgatgtaaattcatgggtgactcagcagcactacaacactttctagtatatttagccctttacatatattttacatgctacataagtctttatttacattatactgaaggtctaatgcccagaaacaagtggaattcttttgtttaatggtttgatatgtcctataagggatctgaggtgactcagtaattatgatttcaaaataattaagaatattttgttgaaataatctctgagattctacttcaattccagggtatacagcagagcactttggattcatttaggaggagtgcttacaatttccatcttactctctgcacatgaagagaattctggaagcatagatgcttcactactttgagtgaatttagcttgacacagctgattagggaagacatcaccaatggttgtcattcatctgtgctttgctaagtggcgtgtcatctaaaacttaaacagccagaaactcgctgttatcctttcattcactgagacaagttgatatagaagctactggaataattaagtgatacttttacactatttgcagttaggaaaagttttatatacatttctttatttgtttctacatcctagcaagctgttattttcatcctcattatacagttgaagaaatgaggctgagaaatttatcataaatcatacagttaattaagggcatgtgatttggtcaaccatctgaagttccattatgccacactgacacagaaaacaaatattcttaggattagctagagtgcctaagaggtgagtagttgcttttttttttttttttttttttttgaggtagagtctcactctgtcacccagtctgaagtgcagtggtgcgatcttggttcactgcaacctgggttcaagtgattctcctacatcagcaccctgagtagctgggactgcaggagcgtgcctccacacctggctaatttttgtatttttagtatagacgagatttcaccatgttggccaggctggtctcaaactctcaacttgaagtgatctgcccacctcagcctcccaaagtggtgggattacaggcatgagccaccgcacctggccaagtatttgctttttatggagtggcagaggaagggtttgctttcatatctttttgcttagacaatgaccacttgattatgaaaattctgctggaagtgaaatcagggaaaggtttcagagagagattatttgggaacagtgtgaactaactcagtcttcacttactatgaaggaaggacagaaaagtcatttttccatttaataaatacttaatgtgtcccctctgtatggaagatagggctaggtactcttggagtaacatatataaaaagcacagctctgcagaacctcaaggaacttaagtttagtagaagtcaaagacatttttactattaaaatagaatagaaagtgtcagttactaccttatgaaaggtaaagtgaagtaagatgacatagaataatgtttccaaaaagaaagaacattcactttggctactggaaaattatggaagcctgcctgggatgaaagtattggtgttggaaggtggaaaatatagggaagaaattggacctggaagagtttggaaattgctgcatcactataggcaatatgaaataacagattgaactaatgcaatagccagttggaaagggtcaagtgaaagctgaagtaaggaatacgtggaagtagattctgtggcacttgccagttgattggatgtagcggatagcggagtaggggattgtctcagggacccgaccacctcttaaaggcccacctctcaatactgccactgtggggattaaatttcaacatgagctttggagggcaccgatgttcaaactatagcaggaatggaaaaagtttgaatatgggtcaccataaagttggtggtgctgtcatgaatgtcaggaaatgacaatgggtggagtatgtcacggcagaaaatgtatgacatacccagaattggatattcaagaagtgtctatttacaaaggagccatttcagaaggttttaggatgggggcaccacaaaggatagtgcagtatcctagtgcagtatctgggccttagtggctgattttatacttttgctatacgtgaattgacaagggaaataaataattacctggcctagaaagggagggtcatgtagtgacagccacattgcaggaagtgacctctagtgaagtaaaatggaccacctcaggcaacctttcagtaaaggagcaaagggaatacataccttgactttattattctctcctactgcagtttgcactgcaagtccaagggcaagagagtcctgttgacgtagtctgtataatcagcttcttggggcactgagcaaggtgggcaagcagatatggatatgtggatgccatgcagactgtgtgaactctagaactgagcctgggttgggtctagcagagctgtttgcacaaaggcacacacacaatgacagacaagctagacccttggataatggatttatttagatcagagttactttaccttggcactattgacattgtgggttagataattctttgttattggaggttgtcctatacattgtaggatgcttatttaggggcatccttggcctctacacactagatgccagtagcatgcacctccaacccctgacaaattttggtaatgaaaaatgtctctaggcatcgcaaatatccaccggggtgaggggcagggtgccaaagcaaaatcacccttagttgagaaccactgattagaggctggacaaaggaaggtgagccagagaaaaggaggccaagaaccagcaggctgagaggaggaacagacacttggggagtgtgacagtggttgacgtggttgcagcccacagtgcgtatccatagaaattcttaatagggactgggcctgtgaagtggagaggcagaaaggagtagatcagacggcagcaggctggggcgggcaggtgggaaagcagggcagccagcatgggcctagtttggcagcagagggaaggcgcagggaagcagggtaccttcgacaggtgggtttaagatttgcttgaggacagagagatttgaacatattggtcagatgaggggaggaaagcagtgaaaggggaggttggagatgggtagtgaaatccaccacctgcagagtgcatgtgatggccttgttctggggctttccatgtgttacagcattcgactctcacgacctctctaggaggttgtcagggtgggtgcccttatgatccccattagcaggtgaggtaattgaggcccccagtgtttactcactcatacctagtccacacagctagtagtggccaagttgtatttgaacctgagctgaagcggagtgagaacattccagtgagcaaaagaaggatgcgtgcaaacccttagaaataaggagggaaggtgaaagtaagcgaagttatggacgtatttgatgtttgacaggaggtggattacagttcccggctttcaacggaattaacaggctcaggaaggtaggcgttaacaccctctgcagaagtagtcttggcagaggccagcatagaggatattccccaagaggtggctccgacttcaaaatgtcaagagcatggttgttcccgttgtctgtgccccagtgcttctctgatcctttcaaaggattgttgtgcagttgtttttctcatttttgtgtataaatgttttctcttactcttgtaacaaattaccacagatttcatgctttaaaacaatgctaatttgccattctggaggttagtagtctaaagtcagtttccttgggctaaaggtgaggtgttggtggtgctggtttcttctgaagtctctgagggaacatttgtttctctgccttttctggcttctggtggctgcctctattccttagtatgtggacccttcttctatcttcaaagcacatcactccagcctctgcccccatccttgtcatcacattgctgtctcctctatgacttcctgggtcccttgtacaaggaccatgtgataacactgggcccacctgtgtaatcactgtcatctcagggtccccactgcaaggtctttagcttaacccaatctgcagtgtccctttcgcatataaggtgacattcacagagtctggggaacaggatgtggacatacttgggggctatttttagcctacctcggttggtttctatgtaatattctagatggatggaaagatggtttagcctagaggtgaaggacatgacctctgttgcttagaatcaaatcatcacttcccaactctgtggcttgagtcagtcatttacccttgctgtggtcccatttcctcgtgtgtaaaatggggatagtagcattcacctgtgttatttgggggattaagtcaaggcatgcacagtgtggcaaatacaatgcggggctcttactgagtattcagtcagtacagtcaattattattcctgcaattattttatataaacattttcttcaaagtattttaactagaagagtgctgcccatctgattagttaatagattaagctgtttctctaaaatcaatgatcacgtgatcgaaagatgtcacttcttggctgatagaagaaaatgcaaaaacagggtttgtgtcactatggttccccaaatcatagatgattaccttcaagttagcatgaagtcagaactgacattattgtcaggaaaaaatctgctttgttttcctcttaagaaaaaattgtaatcataataaccttccctgcccagggcaaagcaaacaactaaactttcagcaaatcttcaccagactcagcacatcagatcaagctctttttaacaccttgatttttttttttttttttttttaaatcactgtagcacccaacttagcttcttctttttatgctgttttcttctggcctctgagatgtcatgacctttttaggttcatgttagtaggtaatatttaagtacaagagttctgaaatttaaaaaataaaagaaaaagatacacacacacacacacacacacacacacacacacacacaattagggtttagggtgacctgaagattatcctggacaagctgaatgtgacttgggtaagtcacatatcctctctgcctcagtttcctcagctggaaattggtggtgatgatacccacattatagggtgttatgagagtcaaaagagataaccgttgtacaagtgtgtgcctgtgcctggcacactgtgaacaacaatgaacaagaatggcgatgatgatggcagcagtgaggatcatagtgggagtaaaagggaagatgaggaaggaccatcagaaaacgaaactgggaagcctaatgtggggagaaaaagacaaaacatgaggaaattattcttcttatggcttggtgtatggataatggctatctatgtattctgttgaatttttttttctaatagcacaaatgtaatgatattttagaaaacaaacaccattcaaaaatcctttgttttatttggaacaaactttcaaaactcatttctgcctaggttcatattgaagcttcagattcttccttaatatgtgcttggaagtaaacatgatatggagctgtaatccatgtgattaattcagtgaaaacaattaagctgaaactagaacctagaacccggtggtcttgacttttttcctcatgctgccatcattttaaataacataagatcaactgtttaagtgagaagctaatttacctgccagcatatttagctttgttgagattcttccatatcctacagataaaaaatgagattaaaccatgtatatgtatctattcagtactaaattattctgtatgaaaagacaagtactgtgaaacttctattaaagtggccacaagtatccctaacatagaagtagtccccctctccgcgccccgccccccccactttttttaagttggctaatttaatgagatatttacattgttatcagtaaccactaaggagttacaaaccattacttctacaggcaatggccagtgtaattaaaccttttaaccttgctagttttcccagtttgccattatcagtcattggtcacagtacatattttttcattattagccacaaactagctatgtgaccttaaaaggttatttaaagtctccagactttatttcccaacccccccaccccaccccatgaaaggaagaaggaggagacaatgatccctgtggtccatttcatctccaaaacccaagaccatggttctgcaacagtttaacaatctggttaacatttgaaagtaaatgaaaacgagagaaaacattgcagctctgccagcaattttctctctctctagttggataaaaactatccaagttgtccctgtttgcaaaggagggtattattatatatatatataatatattatataatatataaaatatatatattatataatatattatatataatatatatcataatatatatcataatatatataatcatatatatatatatttaagagacagggcctttgctctgtcacctaggctgaagtacagtggtgttatcatagctcactgcaacctcggactcctgggctcaagtgatccttcggcatcagcctcctgagtagctaggactacatgtacacaccaccatacccagctaattttttttttttttaattttttgtagagacagggtctcactgtgtttctcaggctagtctcaaattcctagcctcaaaagatcctcctacctcggccttctaaagtattgggatgacagatgtgagtgcctgagcccagctgtgatttatattttaatgaacaaaagattagaataaaatttgtaaaatttttatttctaactatttttcatggcttgacataaaataaatgtgcatttgggcaaatactgcatttcagtgaggcatgtacttccattgtgtgttgaaatgtaagttggcataaaagaaccaacaaaaaagtcattacagttttattatttgttgacagcaagagagaaagaaatattctctcaagatgaacaataatgtcctgttaactgacttaaaaagagcaaagtttaaattgcttattcagagaactctaccttctaatactttgagcttcctggaaaaagaaatgggttcttgataagttatgtgaattgtgcttcgacataaatgtcaatgtttgatcacaagttttttttaccaaatgccaatctgcgaggtcagctagttcaatgagtcattttgcttaataaggaaatttaagtagttgtttctatcctttgttgtcacgttggaaatgcttcaaagagaagctacttgttctgataaaatagaataatatgaactttggaactagacaaaactgaattgagttttgcctttgtcactaaattaactgtgtggtgttgatatgtccttaaaacccttgaagcttttacttcccaatctataaaatagggatgataataccttcttggtagaatgggttttgagatgacttatctactatgtttgttatcccctgccacttggtaataataatggctagcatttattgagtgtttaccatgtttcaggaaacttgtaagcactttgtaagtattaccatatttaattctcatgacaatcttgctgtcatttgaatatttgtcctcctaaaaacttattttgaaatttcatcctgaaggtggaagtattgagagatggggccttaaaaaggttaatgggtcatgagaactctatctcatgaatgaatcaatccattcttgaattaatggattaatgaattactaggttagtagattaatgagttatctcaggagtgacactggtgacttgaaagagagacctgagctagcaagctcagccccctccccacatgatgccttgtcccaccttggaactctgcagaaactccacaccagcaagacggccctcaccagatgcaacccctcaaccttctcagactctgtaactgtaagaaataaattccttgtctttgtaaatttctcagtttcaggtattccattacaaacaacagaaaacagactaagacacgccctacaggtggatataatcattattctcattttgtaaatgaagaaacagaaacaatgacaacttatgtaattggccaagtgaaatactactaatcattaaggccagcatttaagctctcatggtgttttgctctagtgaccctatttgtgacactacattattctttaccttggtggatactcagtaactggttgccatttttattgaccatggtagtataaagcatcaagtttagcacctagctaggaatccaggtgttttcttggttctctcacttacccaggataatcaggtcttcagcaaatcatgtctattgtacctcctaatccctcttcttctaattcactttttccttgctgcctttaatctaagccaccattctttctctcttccaggctagggcagaagcctcccagtaggcccctccttagctccttgagttcttctcctctctcatccagagtgcagccagaaggatcctttacaaaaagaagtgtgtgtgtgtgtgtgtgtgtgtgtgtgtgcatgtgtgtatgtgtgtgtgtgtgtcccacctaacttaagagtttgggggaatgcccccatttcttatagcttttaggaaaaaaacaaggatccccatcatcgcgttcaaggtcctacactgaggtgacatagctagtatattcagctaactctgaaaggtcctttattcacttccttagcaatattaaacaaacccttggacacattaaatccctgttcccagcttttgcaaatgccatccccactgcctggaatgttcttcctcttttccattcacctgggtaagtttcacttttccttcattttagcttaaacctcactcctttggaaaagccttactgtaattccaatcatacgtgtgtgtgtatatatgtatatgtatatatatatatatatatatgtgtgtgtgtgtctgtgtgtgtgtcggtgtgtgcatgttatatgatttggccgtgtccccactcaaatctcattttaaattcccacctgttgtgggagagacccagtgggaggtaattgaatcatgggggcagatctttcctgtgttgttcttgtgatagtgaataagtcttgcgagatctggtggctttaaaaatggaattttccctgcacaagctgtcttctcttgtctgccaccatatgagatgtgcctttcaccttccaccatgattgtgaggcctccccagccacatggaactgtaaatccaataaacctctttcttttgtaaattgcccaatctcggttatgtctttatcagcagtgtgaaaatggactaatgcagtaaactggtaccagtagagtagggtgttgctgaaaagatacctgaaaatttggaagtgactttgtaactgggttacaggcagaggttggaacagtttagagagctcataagaagacagggaaatgtgggaaagttttgaacttcctagagacttgttgaatgactttgacaaaaatgctgatagtgatatgaacaataaggtccaggctgtggtggtctcaaatagagaggaggaacttgttgggaactggagcaaaggtgactcttgttatgttttaggaaagagactggcagtattttgtccctgccctagagatctgtgggactttgaacttgagagagatgatttagggtatctggtggaagaaatttctaagcagcaaaacattcaagaggtgacttgggtactcttaaatgcattcagtttcagaagggaaatggaacataaaatttggaaaatttgcagcctaacagtgcagtagaagagaaaattccattttctgaggagaaattcaagctggctgcagaaatttgcataagtaatgaggagctgaatgttaatcaccaagacaatggggaaaatgtctccagggcatgtcagagacctttgtggcagtccctcccatcacaggcctggaggcacaggaggaaaaaatggtttaatgggccacaccaagggtcaccatgctgtgtgcagcctagggacttggtgccctacatcccagccactccagctgtggctgaaaggggccaacgcagagcttgggccatggcctcagagggtgcaaacctcaagccttggcagcttccacatggtgttgagccttgtgagtgcacagaagtcaagaactgaggtttgggaacctccaactagatttcagaagatgtatagaaatgtctggatgctcaggcagaagtttgctttaggggtggggtcctcacagagaacctctcctagggcagtgcattgggcagtgtggggtgggagcccccacacagagtccctactggagtactgcctagtggagctgtgagaagaggatcactatcctccagaccccagaatggtagatccactgacagcttgtaccatgtgcctggaaaatctgcagacactcaatgccagcctgtgaaggcagccgggagggaggctgtaccctgcaaagccacaggggtggagctaccccagactatgggaacccacctctagcatcagtgttacctggatgtgacatatggagtcaaaggagatcattttggagttttaagatttgactgccctgctggatttcagacttgcatgggccctgtaacccctttgttttggccaatttctcccatttggatcagccatatttacctaatgcctgtacccccattgtatctaggaaataactaacttgcttttgattttacaggctcataggcagaagggacttgccttgtctcagttgagactttggactgtggacttttgggttaatgcggaaatgagttaagactttgggggagtgtagggaaggcatgattggttttgaaatgtgaggacatgagaattgggaagggccaggggcagagtgatatggtttgtctctgtgtccccacccaaatctcatcttaaatttccatatgttgtgggagggacctggtgggaggtaattgaatcatgggggcgggtctttcctatgctgttctcgtgatagggaataagtcttaggagatctgatggctttaaaaatgggagtttccctgcacaagctctcttctcttgtctgtcaccgtgtgagatgtgcctttcaccttccaccatgattgtgaggcctccccaccaacatggaactgtaagttcaataaacccctttcttttgtaaattgcccagtctcgggtatgtctttatcaagtgttaaagtggactaatacagcatgctaatatgtgtgtgtgtgcatgcctacacttgtgtgttttaaataaataaaggtcctccaataatggtaagtagtaatgatactggtaatatgaatggtagtctgtcagtagtaatgaagcctttgttcgggaaatatgacttttgaaatgtagaattcatgtcagtcattggaatagactagtacctttgacgtgcagaagccaatctgattgctaaggtgaagctcatagcctagacttggttcagggggactccctcctgctattaaggttagaaccagggtagaagttggctgctgcttcaaagggctggaaactctgaatacctacttaagtacaatagcccactcctctgataagctgtgattggtttgcttttttctccctccagcacatgattttgattttactcctttcagctttagagctgccttaaagattaatttaatctaatttcatattggttataattctggagtttgtaggtaggagagtacaatgaggtttttaagatggcccctgggatgttcttgggcggagaactagtagtagcaggattagtgacaaaaggcaataggtttttgtttgtttgttggttggttaattttttttctgtttgtttactaaaatgcagatttcaccaaagcaagaatatccggaatagtcaggatgtgcttagtcagttacctctgtgggcggatgctccccttgctcttttttcctttccttttattggtaacttgtaatcagctgctactttagtttaatgagaaaaataacagtttacattacatctagattaaagaaactgctagacgaacaggggtgggcaagttgtcaatggcatctaataaatagtagtaagtaattagcacaggtctgatggatttgaaggaaagtaaaaaactagggaagaggaattgtggattggggaaacatagctgtaatttgagaataacacatcaagaaaataagaatgaagcactgaagtcagagatctgtggggactgtgttggggagagggttgggggcatctcgtctgaggaacaaatagagtagaggaacatctcatgctgggtttgtactctgctcaccctgctccactccacctctcaggcttttggttttatcagattgtgtctataacaaagccagataaaagtgacaaagaagtgcagttcaaggttctgctgtccttcccttgtctctgggagttagcaagtcacctttaaatgagaaaacagtgtgaccttacgtacttcacacggccattctgagacaaagttggagaagtgtcatgcatcactgcactcttctaaggggtggaaggaatcaagcatattccagacctaggagggatttcttaggaattcacactgatgtaatttcaaaactcccaagacagccaccacttgtctggcattagctaacctatgacacttcactcaattgcattttgagctcctgacttagttcattcagtaacgtttttgccccaggatgccaaagcaaacactggtcctgaactttgcctcttgaactacattcttcaccatgatgcccttccaaattccctatagatgttttcactactggtgtgtacaggaaggaagttcactttgactaataaccaactctgttatttctagtggagtgatcatttgtctcttctgtccattggcctccctttgattcaagcagtggggtgtgtagaggaagctctgcatccacttgacaagccttttaggtcccaacagcagtggactccttatcagggctactcataaaaggctaaccttccaaaggaaacttgtcagggctcagctgttggcaagatggattaacaagtgcttccagctaatggagtagacattggtgacttaatgagggtagtttgaaatcttagctgtattctcttattctttttttttttttttttgaggatgataaatgagtttagttctttcttagctaagaaatgccaatgatttatttttattattcttatttttattttttattttttagagatatggggccagggtcgggggcagggaaggaagggaagtctcactaggttggccagaatggtctcaaactcctggcctcaaacaatcttttcacctggtccttccaaagtgctgggattacaggtgtgagccaccttgccctgcagaaataccaattattaaaaactcagaggttgtagtgcaacatatttgggagtggtcacaccccatggcctttgattttagtctgaagattgaaaataacctttggattttaccttgacaaggaagttgttcctcagtggacacagacatcatagttggcatagaaacagctgttgggttattcctgggccattgaagacatggcacctggcccagtctgaatggttgttctctcctggttgcttgtttaaataaaggttaagcaaaaattcttttttggttttgatttcaggaagaaataagggagtgactgcaatgttatctgaaaatgagcatttcctgtttcctcaggcatttctttatgacccccattaaagttaatgaataaccaagtgtctgacacagttgagcgtaatatgcctcacctaaggttcccggtggctgcacatttttgtgggaaatgaccttcagttcctgcagatccattattaggcaatctcttagttatagactttatcttcccaaaacattcaaatcacatattagccaaatcacttagataccgtcctaagtgctggaactctttaagtcttgttagcagaaaaggctaaagtttaggtaaataagcagatctgttccacaaatgattcctcaccttaggtatttatgaaaaagctctgataaacttttgaaagcagaaaaagacgttaaaaaatcttactgtgagcctgaaaacataaacataaatcagctaaaagataatttgccttaataggtagtgggcgatgggggaggagagtgatcagggctcaccctggcaaaattgtctctgccggatgtttcaggttcgccttctctccccgtcacctcctcagaatcttaggagaccacataggatcaatccttgttcaaaggcaaaggcaaaaaaagtatgactgcaaatatgtgaagtacgatttggcacggagttcattttgggaccctaagtcctctaggcggtacagctatatattgcaatggactgagtgtttgacacacttgcccagaactcctgcatacaaatgaggagtggcatccttaacctcaggcagttaaatgttccattcccctgaaactaccattttccaaagagctttggaattgtcttagggcctatttaaatgccataggaaaaaagttaatttcatttctttttatggtcccatgtcatttttaacccctagtagtagcagtatttctagctgttaaaagtaagtatttttgagtcacaaatctaacaattgatttgtggcaatttgtttaacctcctagagccacagcttacttatttctggaatggtatgatagtaaaatctaccttatggggcctctctgaggattatggataaagcggttaacacaattccaggcaactagtaagcattcaaaatgtgttactattattactgggattgttgccgccgttgttattaaacaacttgttcacataccttttttcactcgacttggctcagaattctaccagactgttcagaaaaatcaagtgtgtgtttaatgtacagtattttaaagtcacaaatccagaggcttttaagaataagttacaaggtctgaagtgatttttgaaagtacactgagcggagtagatcctgttgaatatattccaggctctaaaatgactatttctaaaggagatgatgctgtggaatatgttataaaggaacaaaaaattactttactctgtagacacatttcatagtttttgtgcaattttctagtttcaacagcttgtccaatatgtattgaatatatattctatgaatgatatgtgctagattctccttgggatgccatgttatagaggtcttcagaacgctttcattaagattcattcatatgtcaggacttaagatatatatatatataagaaatctcatgaacagaagtttcagaaatcagttcattgcttgcctgaattcaaggagaaagaagtcttcagagtgaagctctggatctaggagagaattttctcctcagcctgttttcaggaagtggcttctgtgtcctctgtgcttggaaattggacgattttggttaatgtggaagatcttaatgaatactttctaagagtaaggctatatacaggtcaggcacggtggctcatgcctgtaatcccagcactttgggaggtcgaggcgggcagatcacctgaggtcaggagttcgagatgagcctgggcaacatggcgaaatcccgtctctacaaaaaatacaaaaactagcagggcgaggtggcgtacacctataatttcaactactcgggaggttgaggcagaagaattgcttttacctgggaggcagaggctacagtgagtagagattgtgccactgtactccagccagagaatgagactctgtcaaaaaaaaaaaaaaaaaaaggctttataaatatcaatatcaagtccatccctccttgccctgtgtttatggggaacagtagcaacatggccaaagtcttgcccaaggcgaggtttaaattttgcagaggcatttgactctcttacagattgtcttcaagaaacaggaaggaagggtttcttcagaaactcctggaggaatctatgtttttaagtgacattgatgcttcatatgtttgcctctgaagatataacttgttttattggagactgaaactacctatttgctatatctgagaggttactcatcagtacccacatctggcattcgcactgaccattctttgtacaagagcttggttttaaaggccataaatctgatatctacactagattgaaaactatctaataaagctccttctcaagcataatttactacggtgggatgctgatgaaacagaaggatttacatatgagttttatttttaaaaatttatttgtaacatcaatgtccggaatttctgcagacatttaaaattattgtttaatatttaaattatttattctaaaaatatactttcacatggggtatataaataataaagacttagattaaaagaagaaacacaggtaagattatgtttataaaaataaaaacaatgtttatgtaagtaattaattaaaaagtattctgtgaatacaaagcagtatcaagatgtgtgtgtttgaattatatggttttttttaaaaagtatgttaccatatagcgacatatagaattttagcttttttggaaacaatcccaattatttcatatattacttttctggatgaagggatggtatggaataatggaataatcagtggatattcctgataatgttttaaaaatagagaaatatcctgggtgaagaaaacttcctttggtgttgatttggatctgattaatgattttgataccagtgggctagggaagatccccaaatgccagtgaaaccttggcctcagctgctgtccaggctcttgacaccgtcctgagaatgaattcaaggatgagttggaaaatagtggaagtacacagatttattacaaagcaaaaagtacgcattcaagaaagggcagtgcaggcagattcaagaaaagggagtggaggcagactcaagagagagtcaggtgcaagggggttgggactgctacctttatgggattctgtaaccaaggggtagaagattcatgaagattcctggaacaaggtggagatttcttggaactctggtaccacccatttttgcactaaatatggatgtttctagaactgtcatagcgctggtgggtgtgtaatttaagatgttaatgagcatataataaggtcctaggtgaaatctaggtcaaatccagtgctatgttgggtccggtccgttttaggtcggtcatagcttggtccacacccagattttttcaggatcttatctacccctagcttctgcagctatttcaaccgtttctttttgctagtcatgtgaaactgctgcctggaattttctatgttcctacaatcaccctgtattattcctatgtcaattttaaaaggaattatttgtctctggggatcttcatgagctgtggtttctctggggatcttgatgagctgtggttacatagctctaaaatggtcctgaggatgggtcagtttttacaagtagccggcagcttaaatggggtaggcagttacactggtcatttcactgaatacatcagctggcctggcatttcacttgaggtcaccaattctgagccccagagaggagccagctgttcacatttccaaaacccctatgtcaacgaatgggttttggaaatgtgatcagcctcatatttaatatcgggagatacacaatagataaaaaatgttgcctttggaaggatgtgacttgaataatgctgcaaaaggtggaacacaatttgagtgagttaagaagcccagggtagttattttggaagttgcagatttgctagcctgctatgttgagatatctctgaagacaggggctcaactccaccaggacctgaggtctttgcttaaataaccccacataaggcccttgtttcttccaaggaccaagagaactgagagctctgtttcctttttttttttctttttcttttttttttttttttgagatggagtctcgctctgccgcccaggctggagtgcaatggcgcgatctcgactcactgaaacctctgcctctcaggttgaagcaattctcctgcctcagcctcccaagtagcagggactacaggcactcaccaccactcccggataatttttgtatttttagtagaggcggggtttcaccatattggccaggctggtcttgaactactgaccttgtgatctgcccacctcggcctcccaaagtgctgggattacaggtgtgagccaccacgcccggctgagaactatgtttcttaaacttaatctgcaacatgactttaatattctaaatctctaattagtagccttgggctgggggaaggccccctgaaagttattgataagaaaagttatgatatattactcacatgcattatttttgctccaggaagataaagatcaagaaggggcagaattctgtgtctttctgtgagactgtctctttttcaacatttatttagtttccatgtgaaactccttacactgttgtaaactagtttcttgccctgtacacagcttgctgggcctgctgctgttcttgatggcctagtaggaaaggaaatggcttgagacactttccacctttcctaatccttcttaagccttgaatgatgtcagtgcaaacaccaagtgaaaaaaaaaatctcacgttgccccatttcccaactgtttgaccactgcctgttcatggacagtgaacccactcataccataacaactttgcatcattttttttttaaagaattgactacacatcaaacacaaatgcctaggtcttgggtagattccaacaaaacattacagtgagaaaaataagaaaaaatatgttacagtgagcaaagccctcagcctctgcactgaatatccttagcccttcattttcatcagattttcttgaatcacagacctaaggaatttattttctctactttgcaaaggagctaactgaggctgtaaaagacaatgctcccaatgactctgacttcaagagacaagactatgataaggaccaagttactttatttccagccttcaatttgatttattgtttttatttatgcactgcctacttcaaaaagtgatttgagggagactacagatcaaattccctttcaaaatagatctcacttctttgggggaagatgaaagggtaagggtgaagcaaggtgacacattttagttgacaatctctagacttgggctgtcatagactagagttggattcagttatctaatttgcaccgccttaattaatgctccaggtctacaggtacatagtgtgaatttaaaagtttgaaatattcagatcaaaatggttataactgtaaccattcacctatcatccatccatccaactctccatccatccatccatccatccaaaagacatttattgatctcctactcagtattaagcacttgtcatattgagtgggtggtgggaggagaggatagagtcaggtgttaacgcatatatgtacacataactacaaattatagtaagagctgtgttaaatatggcaaccattttttaagtctagaatttatttgaggctatgcagtagagaaaataactcatttatttctgggtaagtagtttaaggatcacttttccaaagtgaagtcttttcttaaaaatagaaatttctcatctacaacattcatcatagaaagaatgcagcattgcatcagaactgatgttcttgctcataaaataaacaaaacacaatggtgtctctatctgtagaatgtaggtgttgtaacacatctgcctagaagctagttaaaatgcatgttgttcttatatttcaattagaagtaagcagacttgattgtctaacacaaaaactcagttgctttgatgtatttgtttttgcatatggttcaaattatcatcaaaactgtattatcagtgataatatactaatgcagtaggttgacattaggggctgactagctgactgttgccatatataattaatccaaagtaatgtgatatggcctttaagatgtaaaagaatttacacaaattattttctcccattatttccagagattagatgttatggaaaagacttttaaaagatgacatgatttaatagccttttcctaagtagactataatacctgtaatgcagaagaatttagaacttttagacatgcatctagtttacacatttaaaagctaaatgtatatcgtatattgtgaagttcctttctttgaaatttttttaaaaatcagatttgaaaagcctttttgcctatgatgttttagagataatactgctggaaagcaagaacctgacataaaagtccataacgatagctttctaggctctaatcctgtgattccactagaaatatcttttgggtgggcatgacattaaccatcctgtcttacaaatacaatagaatatttaatgatcttccattgtattctggaaaatagactgcattctctttctctatctgcctccctctttctcccttctcttgtcctttctggtactttgccagaaaccgcctgtttctttcctggagtccagtaattgaaggtaattttttggaagatggtttcaattatctaaagccagtggaatgtttaactgccccttgctattcgtgaacttgtttacagtgggatttcagatgaattcagattacatgcaaccagatgttatctgctatggttacttttttttttttttggtgaaggaaaattgtatgagggaggggtctttgatatcatatttagatcaactgccctcaaattcttggaagtgtgcccctgggataaagttttggggtaaacttttgatcccaaccaatgaacatccaaatatgagaatatacattctctgtgtaataaatttaagatcttcccattttctgtgtgtctttatatgatactaatccaaaaaaattgcctcacaaaaatattttgtcatccatctaagttagagataaaacaattataaactgaaagctcattctattcttactctgcctaaacatcacagatttactgtcatgctgcccagataatagaaaataaatgttgtgatatttaacaagaaaaaaaatctgaagtaataaaagtcacctgtgaaacaacaactaaatgctctagtctgtagacagttgaagactaatttccttaactgacagctgaagtgaaggcttagtaagatgtattatttgtaaaggttgaactttaaaatctgaaagagaagttgaatacacaaatcttagcttagaaaacagatagatataatcaatctttatgaaataattatttgccttatttaggaatccagcatacacttaagagattttttttaaagttggtttgcaatgtaattaaaatatgatttaattttcaaagtttaattgcacacaaacttttagaaaaatgaaactatctcttgttgaatcttcaagaaggcatcaggcatgattttgctcccctataggttggagaagacatccaagagttttaggattaagagaatacaaatgcctttacatacacagacatgcctacatgcatgcatatgtgtgtacacatacatgtacaggatagatatgtacatacatacatataatattttttcttagcacttagttatatagcacttgccatattacctgaatgtagtttacacttcattgaataaaaaaaaagaacaaataaaacaattcaagattttctgcaagcagaaaagggatgcccaacaggagctgtgggcttcaagggatgtaaccactatcaaaatcacgctctggaaggaaagagtgtgttaggaaggaaaaacgttcttgatctctcttcccaccacctgttctcccggggcctcttgttgcactcacctaacaggaaggcagatggcacgggagcaggttgaagagtaggggatcaacctccccagtcaaaaagcagagcagagctgactggagaggttcacttgaagctaggagtttgaaaccagcctgggcaacaaagtgagatcccatccccaccaaaaaatatataataaataaaaaggaaatagaaaaaaagcagagtagagaaatacgaaaatgaatatggaggaacagagaaacaccagcacaccaatatctctcactgatctatgtactactgttcttatgatttgaacttcatgcaaaaatgccactgtttcaattatttttctactagtgtagattatagtctttccagtcaatgaatgtagtaattactaatccacataatgttccattatgacttagatttggttgatctggctgtgcatggtggctcatgcctgtaattccagcactttgggaggccaaggaaggaggattacttgagcccaggagtttgagagaagcctaggcaacacagtgagactttgtctctaaaaaaagaaaaaaaagtaacaacaaatttagttgtttttttcaaatgagaattttaattatgaaccaaatatataatggaaatacaaaactacatcataatatttacctgatttattttaatatatactatatatatggccttttagtaaccaactgtgtacacaaaatgcatttgataatgcagtgtcaagttgcagaatcattttagagataagatatggaatattaaatatcatttttgtgttttacctattgtgtgttttattttacttgaaaataaaacttgtagagagatgggattagttacttggtaaattataagaagaaatacagtttcctcaaataattttacatatgaaaaattagacgtaagatgaatacttaattgacaaaagaagtaagtctaaatagccatatgggtcaggtgcggtggctcacacctgtaatccccacactttgggaggctgaggcaggaagattgcttgcaccaaggagttcaagcccagcctaggcagcgaagtgagaccctgcctctaccaaaaaaaataaaataaaattaataaataattaataaaatgaaacaatcatatgtaatgctcattaaatttcaaggggctaaatttatatgcacataatacatgaaaaattcatatacagtgtcatacgctgtcagtggaattaagctaaatattgacaaaacgttaaattaaaaataccaaaatggtaagaaattcagaaatgacttaaatacctatggatttaaaaataccataatggacattataaagtattttgaaaatgaatgataaaaatattacgtatcgaaacctatgggatgcagttaaagatgtactcagagggaaatgtatgccttaaatgcatgtataagaaactagagaaggctgaaaatccatgatctaaactttcagttgaagaagctagaaaaaactacagcgaaagtaaaacaaaggtaataaaggtaagataaaaatttctgcgctggaaaacaaacacataatagagaaattcaatactgctgatctttagattcagtgcaataaagattccaacaactgtgtttgtgtgtgtgtgtgtctgtgtaaggtaccaaggaattttaaaagtaatatggaaaatgaaggggccaagaattgtgaagacagcttgaagttgcacacatctgatagacttgtactactaaatatcaacatctattataagtagggggtctcacgggccagtgtgctctgcacatggctgctagccttggctgtgtggcttttcacatcaagggaatgggaacttccggaggtcagccaactctgcaaataaccagtactcagatccactgaagcctacctccaggaatctgttacatctgagaccaggaaggagctgtgaacattaacgttgataaagaaaagcccattgaagagtcttccagagaggggaggcagagcgagatggctgaatagaaccctccagcaatcatcttcctcctctacccttgcaggaacacaaaactgaacaaatatcaacccaagaaagcaccttcatgagaaccgaaaattaggtgagtgatcacagtacttggttttaacatcatatcaagggaagagacactgaaaagggtaggaaagacagccaacaccaccccttcctcatcccccagcagcagtgggctgcttggcgcagagagataatttgtgcttgggaaaaggagagtgcagtgattgtaggactttacattgcaactcagtgctgccctgtcacagcagaaagcaacacagggcagaattcagccagtgcccatggagggagcgtttagatcagccctggccaaaggggaaccgtccacaccagcaggcgggtttgagctagctccaccactactggctgaagtgctccattgtagtccttgtggcctagactgcctttcagataaatttgaaataaatttgcctttcaaaaaaatttgaaaggcaatctaggctacaaggactacaattcctgggcaagccctggtgctgtgctgagctcacagccagtggacttgggtgcacatgacctagtgagacacaagctgaggcagccaaaggaatgcttgtgtcactcatcctccaacctcaggcagtgcagctcacagcactgggaaagactcctttcccttgtggaaaggagaaggaaaaggagtggggagaataaagaggactttgttttacaacgtggataccagctcagtaccacagtaaaataaagcaccaggcagagtcctgaggcccccattctgggccctagctcccagatgacacttctagatctaccctgggccagaagggaacccactgccttgaaggggaagtatctagtcttggcaagattcattacctgttgaccaaagagtccttgggccttaataaacatcagtggtagccaggtagtactctccacaggcctcgggtgagacccagttctgtgctggcttcaggtgtgactcactgcattcccagctatggtggctgagagagattccttctgcttaaggaaaggagagggaaggttaagaaggactttgtcttgcaacttgggtaccagctcagccacagtaaaataaagcatgatgtagattcctaaagttcccaaattcatgcccttgcttcttgacagcatttctagacccacctgggtcagaagggaacctgccaccctgaagggaaagacagaagcctggctggattcaccacttgctaactaaggagcccttgggccttgaatcagcagtagccaggcaatagtcaccatgggccctgggcaagtcccagtactgtgctggcctcgggtctcacccagcatagtcccagtgacggcagctataggggtatttgtgtcatcctccatcccaattccaggcagttcagcatggagagagagactccatttatttggcagagagtaaggggagagaacaagagactgctggtaatctagggaattcttctggctgttacccaagactaccaagatggcacctctatgagtcatcaaaaatcatagcatcactaggcttggaatgcctcctaatgcagttacagctgcagtgaccaaagattagatcacaacattcatttccctttgaatgcttggaaagccttctcagaaaggtcgggtacaaataagcccaaactgcagaggttacaataaatacctaactatttaatattcagtgctcagacattgacaaacagacacaagcaccatggtcatccaggaaaacataacctcaccatatgcactaaataaggcaccagtgaccaatactggagtgacagtgatatgtgacctttcagatggagaattcaaaatagctgttttgaagaagctcagtgaaattcaagctaacacagagaaggaattcagaatcatatcagataaatttaacaatgaaatggacataatttttgaaaatcaagtagaaattctggagtggaaaaattcaaccaatataccaaagaattcaccagagtctctcaacagcagaactgatcaagcaaaagaaagaattagtgaacttgaagacagggtatttgaaaatacacagtcacaggagacaaaaggaaaaaagaataaaaaagaatgaagcacacctataggatcgagaaaatagtttcaaatgggaaaatctaagagttattggccttaaagaaaaggtagagagtaagattggggtagaaagtttatttaaagggataataacagagaactttccatgcctagagaaagatatcaacgtgcaagtacaagaaggttatagaacgccaagcaactttaacccaaagaagactacatcaaggcatttaatagtcaaactcccaaaggtcaaggttaaagaaagggttctaaaagcagcaggagaaaagaaacaactaacatacaatggagctccaatatgtctggcagcagacttctcaatggcagccttacaggccaggagagagtggcatggcatatttaaagtgctgaaggcaaaaagcttttatcctagaatagtaagtatctccagtgaaaatatccttcaaacatgaaggagaaataaagactttcccaaacaaacaaaagctgagggatttcatcaacagcagacctgtcctacaagaaatgctaagggaactcttcagcctgagataaaaggacattaataagcaataggaaatcatctgaaggcacaaaactcattgggagtagtaagtacacagacaaatgcagaatagtataacactcattgtggtgtgtaatggtgtgtaaactactcatcttcagtaggaagactcaaagctgaacctatcaaaagtaataacaagaacaacttttcaagacactgacagtataatatgtgaacatataggccaggtgccatgactcacacctgtaatcccagcactttgggaggctgatgtaggatgatggcttcagcgtaggagtttgagactagccagactctgtgtctacaaaaaaataaagaaattagccaggcatggtggcccatgcctgtggtcccagctactcaggagactgaggtgaaaggatcgcttgagcccaggaagttgaggctgcagtgagccactgctccccaacctgggtggcagaccaagactctatctcaaaaaaagaaagaggaaaagatatacatagaaacaacaaaaagttaaaaagcaggagaatgaagttaaaatgtagagtttttattagttttctttttgcctttttgtttttgcaatcagtgttaagttgtcatcaatctaaaataatggcttatttgcaagcctcatggtaacctcagattaaatgttaaaacacaaaatagcaatgcaaaggcatgaacaaaattttgtatgcaatatgggtaggtttcaaaagtataatcttgaatgatgaaaagttgcagaataatgcattcagtatgatacaatttaaagatataaaagcaatactgtatattgttcagggctatatatctgtacaaactttaagcaattggctgaagggatgcatactaaattcatcattgcagttactcttggaaagtggaatttgactgggaaccaagaggacttaattttatctgtaatggtttctttcagatgaaaaaataaaaggcttaaagccttgaagggcaaatatcaactgaattcatgatgatgattgggatagaagaatacttttctacattaaattttttttattttcctcagaaagcaaaacaaaacacaaacaaacaaataaaatctattatgaatgattgggactgggtataaatgaggtgtttggaattctggtgatgttctataacttcatcaagaggtagaaacggccgggcgcggtggctcacgcctgtagtcccagcactttgggaggccgaggcgggtggatcatgaggtcaggagatcgagaccatcctggctaacacggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaaaaagaggtagaaacatggaaatgttcattttgtgaaagttcatccagccatacaaggtaggattggtccactttgttgtatgtgtgttatccttaggtggaaatttctggagcaaatatggcaaaataagaaaatttgacgtagtctgacataaaacttgacatacacagattattctttatgcttttctaaaagcttgtgatattttaataacttcaaaagagatggttcattaataaaaatattttgattttggctgtattttgattgcaaatctgtgtactgcaaaacaatctcattacttgctttttctgtaccataccatgattttcacttcatcacaccttagcaaaagctgttggggaatgagaagacatgaatggtctggtaaatgctgttgattatgaaatcctctgtacctatgatctcaagaataatggtggggttctggacggagaaggttagaatgatagcaggtaggaagtctcaacagtaatagaaaatggctgtttgggaaatgcaaggacccagaaccctcctagtactgcagctgtcggtgagtaaatgttcatttgataagctaccagatcacctctcaaagtgattttgtccaagggcagtccactcaacactcaattacgcagggactgagtatacaggacttcaattttctccttccttttgagaaccactatccaaaggataaaagaaaagtagcacagcactctgctctgtcatgattattgtttacctttggctaagaggtgtcatctctccagctttcctctaaaactttagggtctaatggtcaaatcccaggaccaaactccaggtgtttaactgttgcatttaaaatgtatttataacatattattattattattttgtcattggtttgcaagtacgctgcaatatgctatgtccattttccgtttgactaaatcaatttgaaaacaaaagtttaaaaatctaaactgtgggttttctagggggatttatgttttaaggagtgataatgaggtctagaacatgttatcttattttttgtttttttttaatttttatttctgtaggttttttgggaactggtgctatttggttacatgagtaagttctttagtggtgattggtgagattttggtgcacccatcacccaagcagtatacactcaacacaatttgtagtgttttatccctcactccctctcatcctttcccccaagtccccactgtccattgtatcattcttatgcctttgcatcctcatagcttagcgcgtgtgcatgcccacacacacacacacacacacacacacatatacacacacacactacaattcctttatccactagttgattgattggcattcgggctggtttcatatttttgcaattgtgaattgtgctgctataaacatgcatgcacaactatctttttcatataatgacttcttgtcctctgggtaaatacccagtagtgggattactggatcaaatggtagatctacttttagttctttaaggaatctctgtactgtttgccgtagtggttgtaatagtttacattcccaccagcagtgtagacatgttcctttttcaccatatccacacaaacatctagtatttttttgttttttttggctatggccattcttttaggagtagggtggtatcacattgtggctttgatttgcatttccctgatcattcatgatgttgagcatttttcatatcttttttggccatttgtatcttcttttgagaattgtctattcatgtccttagcccacttttcgatgggattgtttgtttttttcttgtagaacatgttcccttattgattggttttcacattcttatgatcaatgacgatatcattatcaccaagaatttgcttaatacttggtgcctacccagcctgatattaaacacagggtggggaaaaagttagttttaatgtaggtgcagactcaaattcctatggggaccggtgaggtaacctaaatgagcaaaatggtcagggtgtaagaaaaaagccaagaaaccgccatgataaatggaactgtatttgcctcagtgccctgaagacaattgggagtagtgttaaaccggaaacttctgaatcagacacgctccactctacttccagctgattgtagccatacaggaatttgggcccactattgtcaaatcttgatttttcaagagaaacatggaatatctctcttttaaaaaatatgaaatttttccattttggaaccaatccaattagaaagtaacaaacacacattttacagcatgtgtctgtacagtgtgtgttacttcctaattggattaattttgttactttctaatttgattggttttgctaacagtaattttctattactgttgagagttcttacttgccatcaatctaaacctctctgtccagaacccaccattattattgagatcataggtacagaggatttcataattaacagcatttatcagaccattcatgtcttccatatgggccaaacaaaatgcttctaagggctgtttttggcataatcctatgaacctcagctttccaatgtagtcaggggaaataagacacacaatttatgtaaaaaggatatgaaacaacagtaagtgctgcatgcattcctctttttattcattcaaacaatagcatttattaagggccttctagcttccttgccctgtgtgagttactagggttacaaaaatgaacaaaattattttgtattgtcaagcagcccggtctgggaaaagaaacatatcattagatttgttattaaacagatcataagagtctaataataattgggacaattagtatggtagaatttcaaagtatagagacttttgaaactgtctttgcataaattatatcattgagaaaaattatatccaacagtaagctgagctaacccactccctatcttgcctttcccttaattattcctgggcttttgggccaagctaactttggaagacatttgggctatagtttaaatgataataggccttgcccccaaactcaaacacttttataaagctaatgtaaggctacaggctggagagaggagggaagcctgaggcctgctaaggtatagacataaatgattgtcagccactattccagaggttataaaacatgcaacttccccagttactcctgtaataacttcactattgtagaacctaagattggccttttgagatatcttttcaggtttttttgcatgtctgacacctgtggttccatctggacctgccaatctgacccctgtggccccacccagaaggtgttcagcatgtagatggacagctttgacctcctgcgagttcatctccaccccaacaaatcagcagcaagcacccattacctggccaacaccaccccttccctcaaactgccttaaaaaaggcctaaccggggagctttggacaagaatggtttgagtactaactctctcccatgtggtgtggctgtcctcatgtctattaaactctttcaactaccatgccaaggtctttctttatgcagcaggcagttacacttcgctgacatttttcttaaggtcatgggaaataattagcttctctttaaattgtataaatatatcccctctatctggactacactttagtcaggttgacagaagcagaaacaagtcataaaagtaccttacagtcaacttctaaaggaagtactgtcatagaagtgtgagatttcctaggagctgttgttattaaccaatagttttaacacccttttaaagcatatcatcaattatactaagtacacagggctatttattttaaatgggtgtactaccagatagctatctatttatcaatatgcacacaaacacatacattcatttacatagtattttatttcttttgccactaaagacattcttactttagctacaagttaaataacagcaacggccacttttttttttctcacctgcaaactgtggtgcagatggaaagaaggcacttaagtgaataagctgtttttaattctagaactctttggttgtgataaaaatggaaactatgtgctctagaaaagctgagtaaattcaaactgtttactgttaaatgcaacttatttgtcaatttaggcagtaaaggtctgaacactcaaattctgtgaatgtccttataagcattcactttgatgtgtaaaactttgtagacttgaaggagggagtgtttgatttccatatacttccaaatattcccttcaggcagtttcctccaaagttggaatattgtggcgagtaaggaggaagttaaggattgctctctgaaagttattttgtctttctaggtggaacaacaatgtattcattagtgataacaatctagatatgaatgatgtaatgaagtatcggttgaactaatgagatgggaagctacaataacctattgactattttgctaaataatatcgccaccttcaaacataaaaacaattgttgaaaaagcttctgtcaaaaataaacccttcaatattttatgacaggtattattgacagaatagaagagactggaatttcctatcactgtggttggctttaaagaatacaacttttaacacatttttcatctctgtaataatacagtaatgattaaattccccttaaaaagcccaaggcatctatttgtttcatggaaacttccaagtgtcctctgtacagacttgttcaagtgggagttcataagtgcaagaacagtaaacttcagcttatctaacatggccaaggaatggtatgttctacttaatcaaatattcttgttgttggagagctgtttcacataccacgcattttaattttcaaagagtaacctttggttagcattaaagctgcactcacatagcctatagtttgctttgatgcagtaatagaagctcatctcctttatcccccacaaggtagttcttctatctttaggtgctttccaggatttggccagaatttacccatggacccctcctattgtagttctcaaattgcgaattctgagattcactgagagtcatccaagctctcagtggatctcagaatttttgctctgcctcaaaccagcctaccaaacgtttattctttatgtgtgactggttggctgcttgtggaaccagtttgagcttcagtcttttagttgataactgtgtaaacatactaactatccttgaataatagttgattgaaagagccgattttgcctcttatgatttaattaaaataaaggatttggaatcatataatgatataaacttttgtaatatataaggactctacctgacatatcgtctctagcctaaatgctttattataaacacaatagttgcattcttgagtgactgttgtattctgtgcactatactaggtgctttacagaagttatctccaggactcattaaaaagacacaaagaatgcattttatatatatatatgtgtgtgtgtgtgtgtgtgtgtgtgtgtgtgtgtgtgtgtacgttggaatattatgcaaccttaaaaagagggaaatcctggaggatattatgctaagtgaaataagccagacaaagaaaaatagatccatgacctcactttaatgtggaattttaaaaagctgaattcatagaaacagacaatagaaaggtggttatggggttggggcaggggaacggggagatgttggtcaaagggtacaaacttgtaattataaaatgagtaggttctggagacctaatttatagcatggtgactatagttaatacattatatacttaaaatttgctaagcgagtataacaagtattcccaccacaaaaaaaggtaactatctgaggtgatgcatatgttaattagcttgattgtggtaatcatttcacaatgtatatgtatatcaaaacttcgtgctgtataccttgcatatatatattttttatttatcagttatatctacaagctgaaaaaaatacacacaaataaacaaagcaaaacaaaactgtaagataaatttaatagaagctttggaaattactgccctatgagatcatcagcagaggagcgggtcttccattcttcctgtacaatgtctgctgttgggtcactgcacactgctctcgggctggctgcctactctttagaaagtctgggtacttcactcccaccaactgagaagtgtgcttattaagatccagtttgctctcaaacctgtttatgtcaactgacattgaataatttcaacataaggtgaacaaaaagagtgtttttttaaaaatgaacataaagtctaaggctttgcaaaattttgataaaagccaattgctttaaaaaaaatactgtcaaagtaggtttgggtgagacccctgtagaggactgggggaaaccataaaaacccaggagaggccgggcgcagtggctcacttctgtaatcccagcactttgggaggctgaggcaggcggatcacaaggtcaggagatcaagaccatcctggctaacatggtgaaacctcgtctctactaaaaatacaaaaaattagctgagcatggtggcgggtgcctgtagtcccagctactggggaggctgaggcaggagaatggcgtgaacctgggagttggaggttgcggtgagccgagattgcaccactgcactccagcctgggcgacagagtgagactccatctcaaaaacaaaaacaaacaaaaaaaaaacacaaaaaagcccaggagaattctcacactgccctgtcatacattatatactctcttgttcaattttagagataatggaaattgtaataatgcatcatgagtgaggttagtacaagaatgagaacttggaactctaactggtggactatgtcactcagggttcaggtgcaggaaacagaaaccactttaggtattttaagttaaagggatttaatataggcaattaggtcctcaggatataggatttttaaaaagggcaggaggatgagactcttttctggcctgccaggaatgactcccggaacaaatactctggaactgggccaccagggttgctgccacctctttgtgatcatgacagtggaaaatcagggggcgtctacctccaacaccacatgtgccttttaacactctcagggacattgcttcaggaaaccccaataactctggggccaggcttgcccatccaaaacagccaagagtttctgtcctccattcatcttccttgtgcaggccaggggaaccctgatttgcattcagaatcctaactccaaagaaatgtaggatctggagggttttgctgttcatcctctgtagtacaggaaagcacagtagaagaggtgtgggattgaagctgagtatcaaactccctatcaaattcccctagaaaagaactggctttctttctatgaaaataagttggtgaattaacgtgctattagttctttattaaaataaaacttttgatatgtagcctattttactgaccaattataagattatttaaaatcttatagaattattaaaatgggcaggcttagtggctcacatctgtaatcccagcactttaggaggccaaggcaggaggattgctggaacccaggagtttgggaccagcttaggcaacatagggagactctgtcttatagatgctgtctccaaataaggtcacattctgagctactgaaggttaggacttccacataccttgtatttatttttattattatttttgtaacatagagtgttgcagataaggcatttcagcaggtatgttttgagcacagactgtgtgcaacactttgtgtgggatgttcatcggggagaataaggaagaggaaagcaaagatgacctgatcatggtgcaggttcttgagaaacttaaagtctactgagaaagatggatgcacacgcagataactgtattactaagcagaaataatttaagtatgaaaggctctttggcgctgagaaggactgttccccccttacataagagggagaatcaacacaaaccacagacatgtagtttacgtagtaaaatgcatgtacttaaagtggatggtatggcatgactggagccactttatctgttcatttattgcttaaaataaactatgtttattatcaccttattaaagaagtacctattacttttaaaaaggtacttcttttaaaagacgtacctattactttgcatcatggttggatggatttttttccttttctctttccttttctgtgggtttagtggaggaggagttgggaagcttgagtaaaacccttattctgccagaaaatgtagcagttatatgtaattggctgtctttactcagagaaacaggagaacctgtgaggttcagcatggtggactttgattaaacaatgattatatatgaggcagttggatcctgctccaaatgctggttgcacaacttcagacaaaaggaggtactacaggaaaaagccagcaaatgtaccccattattgcatcctggtctatttatgatgggtgtccacccaggtctctggggacagcctaggtcacactgatcttgggtctccaaacactccaccaagagtagttttaaaatatgccccttaagttgattcctccccaaagaagcctaaaacatataggattcttggcaaactctgtcatcatgacattatataagatttataaagccctcctaaagattgctgtgggattatggaagcttcttgggtgccttctggcccctctaatcaacttttcacactgttgaggagataggggaagcaaactcatcatcactccaggtgtgtatcttctcacacttgatcttctgaactcagaggacagagatctgattataagaattattctttattacccaaaatttctataaagagcatgttttgtttatctgagcaaaactatatcatgagactaattatccctcttgggtttttgttgtaattaagctacacttttccccctgatttttagaaatttagcttttgaaatagaagataaactaaagaaaactccttcccagctaatttttttccataatttttttcagtctttgaaacacagaggtctctccccacctccctatttttttttttttttttttaccactgaatacattgtttcggcttagttatggattgttttctgaaaatttatctcctgccttccaactaaatttcaacatagaagcaagtgcttttattctctcttctttcccagatatataaagtgtctagttcttgtgttattggcaagattatgtttcctttgttttcttaacctcagcttcataaaaaaagctcacttcatgcttctgctccaagattggagagctcaaacatttataactccaaaaacaacatgttgccctacagaaatttaccacttgaatttgagcagtgttgaggggtatgccatgatgataggcagcaatggcaaaagcaaaggtaaaaagaagaaaaagagttttttgaaatgtgagctttgaattatttgtcggactaaataaatagcattaccctatcttccctaccttatgcagaacctcattttagaaaatcagcaccagccaaaagtgtaatgcaccatgccgccacttaggtagttacacattatttgaagatattccttaaaatgcctgctaagccacttttatctcttctgctatagcagaggcacagagcagtagaaagcacctaaatagcttcatgttattctttacttgaagaaggaattatagtcccaagatcactatagccgtggtaggcactcctaaaacaaatgtacagttcaggtcatttaattttatggttatagataaatgcagcgagatgagaacaaataacttaaacagtgattagccttaagtctacttgtgtcaacacaagatttgaggacagaatgaatcttctatttattttctgggcatttcttaaaactatgtttgttcctattaatccatgaaatatccattagttcacatacccaccgttttttatatttgtagctcagcaacacaaagacaacaaaaatataataataacaataaaccagcaagtaaattaacttactgttgtttgttttgttttgttttgaaatgagcgtcagtgaatctagtgctatatctgccaatgtcttgcttgtatcaggagctcttagaaaaagttcacacctaagagcactatgagttggaaatgcctattttagatgtgtttctcccatgtttttcctccaaaatcactcagtgaacctggttttacttgacttattttggagtgacatcctcaaagcatgctgaggactgcaactaccaaatataaagctggaaaggagtgatgctgcctgatgctagtgacaagttgttccttgtgtggcagacagattcaaatggattaatgttcaagccaagccctttcacctctactttctcatgaggagtgacagagaagaatgtgtggcttgtccatagacctcctgactcttctgccacctttgagttgacaccactttctgatctgagacagtttgtcacttagggtcagtagttttgccattcagtgaagttgtacaatggatttcctctgtggtgggaggaagagcaggaaagagagaaggaaagagagaggaatcggggtggggtaagaaatacagagagagagagagtgagagaaggaggatctcttttactaaatgttatctttgcctttttaattggtatttttagataataataactttcctatattaatagctaaaccctgtccttattatccattcagtgtgtatgatatgctcatacctgtgaggctccgtgatgggaaatgacatagtactctttgttcccccaagttctttttgccacttttcctggccatggtctcatcaaagcatttggaaaatgtgcagctgtggtcttccaggaggggacagatattgtactcatcgagtcggtacctggtgtctccactctctcatgacttagcccttcccctctctctccatccagccatgtggtttgtgttgaattaactgtccttgctgcaggatgaggccctaatgtgtttaagctaatcactatttcctatcccttgggtcatggtgtttagctcagggttggtcatgtgtttttagcaagggagcctcagggctttttgtggcctttccaactctggcctctacctcttgttatgaatgaagatgcattgagcgccgtgtgctcttggcactcatgttatgaccagaggacaacagcatcaggcagatacagcagaagtcagagaggggagatgcaaacaaatagggtgttttggttgttccctgtagcccatgctactgctggatgtttcagttatatgtgatagtaaattccttttattaaaggctgtttgatgggtttttcttatttgtcacccaaatgaaccccaaagggtcacaaaaacctgactgaatttcaaaatactttgtcattaattcttaattggtggtgggaactaaacaaagaaaacaccaattatggcaaaccatcgtgaacagtgaaagtttgacactaacaataatacataagacctaaaagtaagaccactgaagttttgcatcaaatcagccagatttctccctttctctgaactgaagaaaaatagtctacatcatggctgtttgttttaacttaaaaagtgtgaggaagtgagcatccagccccaagctacagtaaacagctcgttcaagcaaattacctagaacaaaagaaacacctctgacataatgtgggggtccaagcctgaaaataatagggtgctcagcaaagtcccagaacccctgtaacaagagcccggtagttcttatagcattcggagccaatgggaaggagtacacttttaaaatgtggtacagttggtgctgaagtctctttacccttgatttttcttttccctcctgaataggaaagcagagctagctctgtcatattgagccagttggtaatgggctctgccaggcgtggaagagataaaagccaccacctgcctcacccacgctccccctaccccatttcccggtctccggttgtctgcacagctgctgacagccagtcattgttccaccccagggctgcctgggagctcagccgtcccagtctcagaagcacaattgcagtttgaatgcagctcctgggtgggtttcctgtgcaccttggccatgaccccttggaaggctgtatgcctgcaagttgagcagagtctgatcatacacggcttaagtacttgccatgtgccagggcctatgaagaggagaacacaaaccagcgttacagggagggaaaagggtttgagcaaaagcaagagaagaaaaagtatgtataacaacattttgggggcatctattagttttctggctgtccagggtctactcatcttacttgctgagtagaacccctctttctcctcgagtatttctcccaggcctggccagtgagagcattgcattccctcctggcaactgtgattgggtcagagatgggcaaacgacttagctcaacgaagcccctgagcctcattgcacagacctagctttgagaatgagggagattctcttctttctttctacttgagaggagaatttataaagaggaatagtcaaaagtaagcctgaaagagcattttgtggcaaatatattcttgcttcttgggcatggtagacactgtgataagcaactcagaaccaccccctactttaggaataaaggacttgttccccagcagctgggagtgaggctggtagacagtcctcagctgtcaagcccctttgaggattgcctcaactgaagagagctaccgtgcgcaaggccatgccacctttttggcataatccatatccagtgactgatcaaagtaggggtatagaggcttgacttttttgctgcagttcaggacaactctggaaggtcaacccatcttcagcgttccttctagggccaactgaaacttcccttgaggttgcattgcagctccctctgcccactcctgcttctgtcccttcccttctatggcagtgtatcccaagagccctccctaataaagctcctgcaggttaacctaccttccagggagcccaacctacaacaccaagataaattgcttgtattttttcctggcggtggagcttagtgactgaaatgaagcatgatcactctgagcagaaggatggcagtaaactgaagcatgacttaagaagatgatgcaaatcatcacatttctcctgcctgtagctcaggatccaaacaccagtgaaagccatggccatggccatgcacttctccttttaggccatatggcattcagtgtgcagttcactattcaacaaattgaccacttgttttggttttatgcaggcacaatctgaaaatcatagttctgctgttaacatcaaataccttttaatgatgtttgacatgaaaaccaccatatactcttatactttccccctggttgtctggtgtgaagcatcttttaaagaaaatttatggtagttacctttataatggtataactcttaccaagtttaaaattaaaatgttatcacaagtggcatttcccatcccatttcaaatgtagagtacggcgagaagtctcaggaaattaaaatattgcctttaaagccctccttttatggtgatgtgaaggaaattgcagcacactagcatttacccaactatcaatatttttttatagtctaaaatatttgccaacattttccccacgtgaaatctattatatgaaatgattaaaaacaaacatcacgtgcactatacgttggagatgcttttaataacttggagtcagagtaaatgatcaccagggatcagagttaatacgggttgaaaggatgcccttaaaatcatgacagtggccttgtattaagcttgtggtttacatgcttttttctgtactgaatcgctaaaataaacaggcattcttccagttaattgtgtgtgagtgtatgtgtgcattgcatagtcacacattccatattgcttctgaaacataattttatgtaaatgattgtaaaaaacagaaatctaagctacctcagtactgttatataatccgtaacagatttgccaacccaaaagcctaattctatcgttaagacctaaattcatatattttataaaatatatgatattgatgttgtccataagctttttttgatgcgatccccccttatacaaacccagtttttattgtactcttttgtaataattttgtataatgtggtctcttcaaaagcgagaccagcacctattcgtttttaagtcctactacataggaccatacggcatgttgcattgctatttgaatctttttagaatggatcaggatgtcccaaaaaatcttagaagctgtactaatctcagcagtataaatactatatacttataacactattatataaatgtttaataattcaaacttcttttacagtaatttagtttttgaacttttaatattaattttttcattctagtttttttgttttatttaacatttggcttcttcagaggaactgcaaccaaactttaaattacagatttattattcaagagtcacaaaattctatgaatataaaagaaacttatctaattgaactttcaaatcatagtttcataagtttatacataacctttatacatctaaagttattaatgcttaaaactgtactgtgacttttgagcaccccagaagtctggttgttaattttttttctacatttttaatctcctaactatgtgtgtttttttttttttggtagtacccccagcacacaattttcccagtaagtacaagcatgtaaaatacaatttccttgccagttaatgttccatacactctaattgtgaaagccactgtatttagtgacaaatttaatcttcagtacttggaagaaggcaacatgggttaagattaaaaaagaggacataattgttgagttctaggtatcttcacatttttaaaacaaatgttctggaactgatgttcacgaaacaggtcagcccctcactgaaccagttctgctgtgttgataaatttcttgttagaactatggcaggaagcaaagcaaaatgattatagaaaaacatgtgctttagcagcaagatggttatttgagcatatagttttcctcttgggtgtccttgaataggcctatgttgagttgaagggagccaagatgataaaccagacataaagagctctaagcataggtttagaaaacggaagcttcttggaaccattttctatttgacagaaacaaaccctgactcagccttctcatttttccacataagtacactgaattctcttccccatccaaggtgtggatctttctggaaaaacctctagctgaagtgtttttacgtctgcaagaattaaaggtcacagactcttgtttctagacaacaaggacagttcactttctgggtgttaatgaaaatccttctatcttgaatacttcctgagaatacttagagtattataacagtcatgaaaagaaatgatgaaaatacaatcacatgttatgggtggaggacagcagggtgcagtgtatcacttctcggtctagatgacacttcaaagtcccttctttctttctaaaactgtcccaggcttcagactgctgactctcctttcctgttctgagctgctacagtcgatcctgatatggtttggatgtttgtcccctccaaatctcatgttggaatgtgatcgcaatgttagaggtagagcctagtcggaggagtttgggacactggggcagatccctcaagatggcttggtaccctccccacagtaatgagtgggtttttgctctattccttcacacaagagttggttgtttaaaagagcctggcacgtcccccctctctctctcttgcttcctctcttgccatgtgtattagtttgttttcatgctgctgataaagacatacccaaaactgggaacgaagaaaggttgaattggacttacagttgcacatgactggggaggcctcagaataatggtgggaggcaaaacgcttgtcttacatggtagcggcaagggaaaatgaggaagaagcaaaagtggaaatccctgataaacccatcaggtcttgtgagacatattcactaccacgagaatagcacaaaaaagaccagcccccatgattcaattatctcctcctgggtccctcccacaacaagtgggaattctgggagatacaattcaagttgagattctggtggggtcacagccaaaccatatcatgctgcccttggcccctccaaatctcatgtcctcacatttcaaaaccaatcatgccttcccagcagtcctccaaagtcttagctcatttcagcattaacccaaaagtccacagtccaaagtctcatctgagacaagtcaagtcccttctgcctatgagcctgtaaaatcagaagcaaggtagttacttcctagattcaatgggggtacaggtattgggtaaatacagtcattccaaacgggagaaattggccaaaacaaaggggttacagggctcatgcaagtctgaaatccagcggggcagtcaaatcttaaagctccaaaatgatctcttttaactccatatctcacatccaggtaatgctgatgcaagaggtgggttcccaaagccttgggcagctccacccctgtggctttgcagggtacagccttcttcctggctgctttcacgggctggcattgagtgtctgtggcttttccaggttcacagtgcaagctgtcagtggatctgccattctggggtctggaggacggtggtcctcttctcacagctccactaggcggtaccccagtagggactgtgtgttggggctccaaccccacatttgccttctgcactgccctagcagaggttctccatgagggcaccacccctgcagcaaacttcttcctgggcatccaggcatttccgtacatcttctgaaatctagaaggaggttcccaaacctcaattctagacttctgtgcacctgcaggctcaacaccacatggaaactgccaaagcttggggcttccaccctctgaagccacagcccaagctttatgttggcccctttcagccatagctggagtagctgggacacagggcaccaagtccctagggtgcacacagcatggggaccctggacccagtgcatgaaatcactttttcctccttggcctctgggcctgtgatgggaggggctgctgggaagttctctgacatggcctggagacattttcctcgtggtcttgggaaataatattaggctccttactacttatgcaaatttctgcagccgccttgaatttctccccagaaaatggcttttccttttctatcgaatagtcaggctgcgacttttcccaaacttttatgctctgcttcccttataaaactgaatgcatttaatagcactcaagttacctcttgaatgctttgctgcttagaaatttctcccgccagataccttaaattatctctcaagttcaaagttccacaaacctttagggtaggggcaaaatgccgccagactctttgccaaaacataacaagagtcacctttgctctaggtcccaataagttcctcatctccacctgagatcaccttagcctgaattttattatccatattgctctcagcattttgggcaaagctattcaacaagtctctaggaagttccaaattttcccacattttcccatcttcttctgagcctccaaactgttccaacctctgcctgttatccagttccaaagatctttgagtatcttttcagcagcaccccactgtacgggtaccaatttactggattagtcaggattctcttagagggacagaattaataggatatatatatagagagacagagagagagagagagctctaagcacaggtttagaatgtgtatatcctaaagggctaggcccgtctctccttttcacgtttttctgcctgctttatattcgctggaagctgattagatggtgcacaccagattaagggtggatctgccttccccagcccactgactcaaatgttcatctcttttggcaacacccacacagacacacccaggataaatactttgtatccctcaatccaatcaagttgacactcagtattaaccatcacaccatgtgacatgcctgttcctcctttgctttctaccatgagtaaaagcttccagaggcatccctcgaagctgagcagatgctggtgtcatgcttgtacagcctgcagaatcattggccaaatttaaccttttttcttttaccaattacccagtctcaagtattctttacagcaacacaaaacagactaatacagacgccttgctaggtttgctctcctataagccatgaggtgtaatgggacttttattccagttttcccttcttcctctgaacacacacacacgcgcgcgcgcgcgcggagagagttttcttggaaagaagaaaggaagaaaacatttaattctcattaggacctaaagctttacaactacacaaagttatgagcttctattgtgtaagaacgttatatcatgtagtcattgaaataacccttttataagtcaaaaacgaagcaaaacaaaatttaaaaccccaaaatgcaaagaggatgagcagttgtttgtagtccagaagctggtgggtggcaggtttgtctaactacaaagcctttttccactacacccctgctgacccacatgagaagcagagagatggtgacaaaaaaatagagatttctgtatttaccaaagcctggaaaagttggtaccacttatggcctccttttctagactcttgactaacagacagctttccttttttaatgtccaagggtggagttctttaaaccttttcgttacttcatagtccagatcatactaactgtgtcttctagaacgtaatgatacagttagatgagggcatattactaataaaagaaaaaaatgaaggggagaagaagaaaaacagttagagaccatttgattattcttgaataggattgacaaacactttctgtaaagggccaagaataagtattttagtttttgtgtaccaagaggtaaaattgaggatattgtgtaggtactgatatagaaagagagaaagcaaatttttacgaacattttattgatgaaattaaacataataataattgaatacttaaaatattaactagtaaataagaagaaaatttattctagtaatgaaaaggatgaaatcatttttgggtgggtaacattttgcttaattgttgttcaaaattagttttccctgtcatcaagttgatcataaatacgtattgataaaaaagcattcttagcatctgggttatactgaaagagatgggaggctggatttgacctgcaggctatagtttgcctacttctgctgcaaaatctcctgtggatattcacatctcatggaatcaaggagaagccactactgtgttctcttgatttcccaagtcctcacctgaaaggtcatcttaaggaaggacttatcaaaattttttcctgggatacttctatctatactttaagaattatagataaatggcttgagacaataggagagaggagttagaagttgtctcagtgaaatttctataagatctatctgaaaaaatttatatgagttttgaaaattactctatgttgtgatcatatttgtttcctgaagcctgtgtcttaaaaccaaagtcaaaagaagattcaccatattgctaagtgaaggaagccaattttaaaaggctacatattgtctgataccaactgcagtcatgagccacttaataatagagatatgtcctgagaaatgcattgttaggcaatgtcgtcatcatgtgaacatcgtagagtgatttatgcaaacctacatggtatagcctactacacacctaggctatactggtatagtctattgctcctaggctacaaacttgtacatgttactgtactgagtagtgtaggcacatacaacacaatgttaacgatttgtgtatctaaacatgtgtaaacctagaaaacatccagcaaaaatacagtattataatcttataagacaccattgtcatatatgtagtctgatgttgacggaagtggtgtaatgtggcgcatgactctatctgacactctggaaaagggaaaactataggagactatatacacatatatatgtatacatatgtatacatatatatgtaatgtgtgtatacatatacacatgtgtgtatatgtatatgcatacacatgtgtatatgtatacacatgtgcatatacgtatatgcatacacatgtgcatatgtatacacatgtgtgtatgtgtatacacgtgtatgtgtatacacgtgtatgtgtatacacgtgtgtatacacatacgtgtgtgtatacacacacctgtgtgtatgtatacacatacaggtgtgcgtatacacacacctgtgtgtatgtatacacatacaggtgtgcgtatacacacacctgtgtgtatgtatacacacacctgtgtgtgtgtatacgcacacctgtgtgtgtgtatatgcacatatacatatacatatacatacacgtgtgtgtatgtatacacacagatgtatacacatgtgtgtatgcatacgcagtcttctgtatatatacatatatgtgtatatgtatatgcatatagtcttctatatatacacagatacgtatatatgtatatacatatataggagactatatatatgcacacatatatgtatacatatatgcctatatgtgtgtatatatatacatatgtatatatatgtgtatttttctcatggaatgcttcacaagtttccatgtcatccatgcacaggggccatgctaatattctctgtatcattccaattttagtatatgtgttgccaaagcaagcacaagagacaataaaaataccagaagttgccaggcattgggcagggaaagagatggctgggtggaactaatagtagtgaactattctgtatgatactgtaatggtggatacatgtcattatgcttttgacaaaactcatagagctatgtaacatgaagagtgaaccctaacataaactatggactttagttaataataatatatcaatactggttcagtaacaaatgtaccacaccaatgcaagatgctaataatacaggaaactgagaaagaggggagaggagtgtatgggaactctctgtactttcagctcaattcttctgtaagccaaaaactgctcaaaaaaatctatcaattaaaaaaatacatacatttatgtgcctatacatctactactgtgcatgcaaacaagcaaagttagcaggaataactgttgcattatgtaatcctttctaatattttttggtgtctattttatttattagtaaagaattaccttgaatatggtgagtgttagcaattatgaagctattattatttgttgctgtatacaacattggttgtatccctatgttacacaaacatgacagatattttagctgattaacctataattgcagggttcctaccaatgtaggcaactgcactttaaataccaattcacggtctgaagtatttaggatctaatggcagaaaagctccattttctggctttcttttcattgttcccagtaatattatttgatgtttttattggtggtagactttgattttgtatcattaaagttggatagaacatattttatggaattttacttgaaagggactattagaagcagaatagtctgtacaatttatgaacatgacttagaacacttgtattcatgtgacagtctcattcccatttaatctttaaatcagacattcacaacagaattttagagcattcttgcacacactggtgatatattctaaagaagacaagatgacctggttgtccacaatgacgagtaagcagcaattaactcttctcattacatagctttatgagttttgccaaatgcataatgacatgtatccaccattacagtatcatacagaatagtccactgctacaaaaatgccatgtgctccacctagccatctcttcctctgcccaacgcctgtcaacttctgatatttatatggtctccagtgcttgctttggcaacacatatactaaaattggaacgatacagagaatattagcatgtcccctgtgcagggatgacatggaaatttgtgaagcattccataaaaaattatatatatatatgcatatatgtatatattctctgtagttttttcttttccagagtgtcatatagagtcatgcaccacaattctatacccatgttgcagttacttttacaagaccttggaggatgtgtactgaccacatgcccagatcaggcttcagttccctcaggtacattccagtctcatgatgccatcatttgctagaaagtggcacagagtattaagaaggcagctctagaagaaaaagccttgggccagaatcccaagaaacacttagagcctctataactggaaatataagaccattcaaatacttttgagttttaaatgggcatttatatcttcagaaaactctgagaggcttacttgggccaccattcatagattccccctatggagaagggttaggagctacatatactccagccctcactcttggctcttaaatatgtcttcccagagagggcatgctttcctaatcacatagaagcagcacgggctaggctggcatcaccccctgttgatgacccaaggtattagtctgttctcacactgctaataaagacatactcaagactgggcaatttataatggactcacagttccacatggctgaggaggcctcacgatcatggcagagggcaaaagagaagcaaaggcatgtcttacatggcggcaggcaagagggtgtgtgcaggagaattcccctttagaaaaccatcagatctcgtgaaacttattcactatcaagaaaacagcatgggaaagacctgtccccatgattcaattacttcccatagattcgctcctatgacgtgggaattctgggggctgcaattcaagatgagatttgggtgggaacacagccaaaccgtatcacccaaggaacacatcagtgatcacttctcacacattttcactggagcacacaggctgaactccatgaactgtggtgtcttcattggtcaaatggggataaaggtactaccaccttggaagcctcctgtgaggattaactgatttaacatgtgagtgttcaataaatataagcaggtcctatcctactcatagcctagaattttcacaatgattaaagaagcgtgtaaactggacctcataagtcctcaatagtggatacctttattgctgataaaatttaattagatttatctctcccaccctacatcattctggtccaaagagcaggaactctgtagaactaagtttagtaccaaaagagatttattgaaggtatgccatattctaggcattaaaaaatactactattcattacttaatccttaaaatttctctttgaggttactattttatagtctccatccagatgagcgaattaagcagctttaaaatcatgaattttaacaggaaggacaagaaggaagagggagaagaagaaaaagaggaggaagaagaggaaggggaagaagaatgaaattaatatgtattcttagagtaacctgttaatctaaattaatttggtttatttgagtatatacctaattttcgagtgatttgtagggtttcaaatgtgttagcaaattagtagatatttaatataaatatcataataaaaaacatttgttaaaacatatgggaatttttaagtgatactctatattgcattttatattaatattatatttttaaaataaatttgtaatgttcaaaaacatgtttttctctaaacaaacgaaatacaaagttaacttctttataattctatacctatcctgtggttactatagattaccactgacacaaaacattttttccatactactatttaatacaagaattggaacagactattgatctagttttaacagatttagtgttgtaggtattttgttgaaaaatgatttccatcgatcaagagattgcttttccctcaagggaaatgagcccctgtctaaggtaccaacctcctcataaatagaatttgtagggagttcttatttccccccacgaggatgggatacaggtttaaatcacgattctttatcaaaagaagatttctcaccattagttaaacacaaaacactcagaatatgatatcctgagttttcaagtgtggtgactttccaatgttgttttttttgtttgtttacacacttaggaattttaagaaaaatataactacatgaagactattttttcacagtgggggtattattttcacaataaaaattatccatattattccatcttagaaaatttgagaattatattttataatttttattgtatatcagtttaaagattcttgttaatgggggagagagagggggttgtgtgtgtatgttcaatgaatcagtacaagcttccgatattatcagtctaagtcttgggtggtgtctacctccttgcttcagaagaggcagctctgatggtctcctcaagttccttggccagacccggaagcctgggcagtgtcaccttcctaaataggtctgttctcaagaattaactgctgcttagtgtgacaaataggaaaatgaaacaaagggggtgggggagggcacagatgaaaattctctacccctctacctactcctttcaccatcctcaggggctcctgatacaccagccaatagatctacactatcatttctgatagttttaataacccaaatgggctgaattatctattccaaagatctgtacagtagggtttctcagtttctgcactgtggacattttgggctggatgattctttggtctggagtagggaggggctggggtgctgtcctgtgcattgtgggatgtttagcggtatccctggcctctacccatcagatgccattggcacctcccaaccaaaactgtgcccagatcttgtcaaatgtcctcctggggtagaggaaaaaattaatccccctcaacccattgagagccactccatatatggtaatgcattagtgagaggcagaaaaagggaaagcctggatcatgaaggtaaatcctgtggtgcaactgtctagtgggatgcatttgcatgctctgtttctatgttcctctgttataaggaattaagccttacaagaagagtatgcaactcaaatattagtacctagctgacaaagaatttataactctgaagttacactgtggtagactagtatttcccagtcttcaggggggaacattaattagttctctgaaaacaaaagcttccctggtctctttcctctgaatgtacacgaacatattaaaggtccttgagtatccagtggtaaataaaaggcatttaccattgtttaaggttaaacaaagttctttaaggaaacaagattcttttctaatacccattcaaacccttttgtttccaacaatttgtaaagttgatgaataccatataaaccattccctcaaaatggaaggatttctaggtattctcttatcatagatttccacactaatttaaaatatttacactatcatcttgttactagagtcagatttaattgggactcagggttttacttgagaataatgttttgtgtttgtaaatgatataataatatatataaatatattttttatttatttatttttactatcggttcccattcaatagccatgagtagacttatgggcttagttaactcatatgactcttaatcaatggatcaattgcctgcatcaaaatgtgcttctgagtatttacttatttatgtatgtattttattattattatcatttctaaatacacccagggaactctgcggactgctgaaggagctttggagatatcaataaaagaaaatgatctagcacaattgcatgggcctgaccaataagaacatgccaatacgcattcagagccaagctcatcagcttgctagggcactcagtctggaggcagtctggcctacacagaggctgatgtcttagtggaaatcaggctcagagtcaagtgcaatgcaaagagccagggagaatgttctcctgcaagttcatctttacatgataataacaagacttaattaaaaatcactggtattttctctatttgtttcctaggcagaaagctcaaataccagactgtctggttcaaaattgaacacctggcaaccctaatgatttggtttacacagtgatttatgttgtgtcacagattcagaaatgtggtgtcagtgggggtaggagtgggggaacacagacacattcaggagaaaaagacctttactttcatctttatatgtttaattgggttaaaaaatgtttctcaggaaaaggaaatgttttcatctattattccattttattataggcatgtccatctctttgtcctatcatgtttccgctttttgctttcagtgctaatttccatagctttaacagactctgatgtctatcagatttgattttggtgttcctgacatagggctctgtcctaagtctgtgaaacagctaccatgtttcaatcactgtggcgatatgagtgtgtggtctggagccaaatggctgtttgaattacagctctactatttctcagctgtgtagatgagacacttaatctattttagccttaatttactcagtcataaaatgtggtggtagtgatggtggtggtggtggggggaaataatatctatttgtgaaaaaagtttagccttggcacagtggctcatgcctgtaatcccagcacttttggaggccaagccgggaggattgctggagcccaggagttcaataccagcctgggcaagagtaggactctctaattaaaaaaaaaaaaaaaaatgaaaaaaaatttcttatgagagtgaatgttctcacccctaatatgtgtgggtttcaggataagagtataaatggagcctgaatactctatctaaatatctcaaaattatgaattcccccaacaagttgctgaataaactgtgtgttgtctgcctgccttgacaaacataccttcaacatttaaaggtctgggtttaaatgtagaattctgaggctcctcagtgtcccatgctggaatgtggtggccttgggaaaatggaccttagctttaggcctggccctcctctcttcccaagctcttcttcacactgcaagggcctcccagatgatgcatgaagatcctggcccatatattcagctacatccacatccctagcaaaagggaggctaaggccattcctcaggcctagggcactgcccctggagggaagaccagtggaagatgcctggaaaggccctggaagtagcttcaaggccatttcgatagagaattctgggggcctgaaaacctagagccaaggggtggacctgggctcaggataggcaagtccccttgatccaaggtatcactgtaggaggaagggcagtcagaggagggccagagctgagccttctaatgcacagggcccagagtggagtgaggaacaatgctgggattagacacccaaatctactgaattagcgaagtccaagcaaagtactgcaaacaaggtctggcatatcacaagcaactaataagtgttacttttattattaagcacctactggatgtcaccttttagcactgaggatgtaacaatgaatagaaagtgatcactgctctgggatctgtccctctaatattaggcttctgcaccaacagtttgggctacctgctgtgacagggatatggaagtttgttaggtggagaataaatggaaacccctacctccctggaaggtcaagggaaggtcttacagaggaagccatggctgagctgagatgtgaagggtgaatatgagtttagccatcagatgactggtaaaggtggacagtccagtcaaagacaacaacttactggatacatggaggtcagaaagagcatggcatttagaataactagaaaaaaaaatgtttgttttgtgcagaggcagggtacttaggaggatggcaagtaatgaggttggagaaatgggcaaggaagaacaagatcgtgaatggtgagagtcatttccttagggagctacggatgtcacagtgaccttccacataattcagcatatctgctgcagaggtagccaagaaaccaagattaggacttcagctggacaatgttggcctgctggctcacagggcatggggagcaagttcacataaggcagtagggaagaggaggaaaactgcacacatccagggagattttagtgccagaattccggaaggctttcttccagaaggccctcaacctaactgccacgcctcctctcccacttttttatttagctacctcttatagactcatccttcagaacttagatgaagcattacacttcctccaggaatcccttcctaaattctcattctaattcagaagacattcttttgtatttctgcagtgtctcaaaaagtagattgcacgagacttattaattcattggtcagttttcctagaagagtggtttttaaactttatcatgaattctccaatgacttggagggcttgttgaaacacagatttctgaggcctatccacagactttctgattcagaaggacttagaattttcatatctaacaacttttccgatgaggctgatactgctagtttagggaccacactttgaggaccactgaggaaagagtttcacaagtcagagatttacagtggaggtaccaagcttttctcaagttagtttatcagaagcacaaaccatcaccctctaccaatcattataatgaagaccacttcatttcagtttatgtacaaaaactcatctccacagttatgccaagtgtatgaagacaaagaaacaatatcaggaaaagaggtttatttgattttgaatccttagccccttacacagtgcctgaaacatataagaggcagtgaataaatgcttattgagtgattacataaagagatgaatgggaggctgaggtgagcagattacgaggtcaggatatccagaccatcctggccaacatagtgaaatcccaactctactaaaaatacaaaaattagctgggtgtgatggtgcctgcctgtaaacccagctacccaggaggctgaggcacgagagttgcttgaacccaggaggcggaggttgcagtgagcaccactgcactccagcctggtgacagagcaagactccgtctccaaaaaaaaaaaaaaaaaaacctgttcatatatcttggacatttcaatttcagtgtactccagcagatttctgactgaccacatctgcatctccatgactgagggttttctagaactgtggaaggtccctttgcacaaggcaggctgaatgtgctagggaattaatgttctctaaagcagtcctcagcctgggaaatatggtgagactctgtctctacacaaaaatttttaaaaattagctgggcatagtggtgcatgcctatagtcccaggtattcggaagatcacttgagctcaggagtttgagttggaggctttggtgagctacttttgggagttggagaataactactcctgcttaattgcccttcggtaaaattttgaggcatgttctacacaatgtcccagaaatgcacagcagcattgagctctagttgccccagcagtcacctgcccagctgcatactattttattggcatctttctctcactacttgtgctcaacatctttgctcagggcatgtttccaaaggcatccaaactgaaaaggaggacaaggagctaaggataaaatatagatagatagacagatagatagatagatagatagtctagggagtatggcagagattccagataatgcaaattcagatgcacctgtcaaagtgacaaaaagaagattacaggcaaaagtagcagcagcaaaactggagctggctgtgagtcccccatcctgagtcctgcagttcatgatcttcatcccagatcccagtgtcacaggatctctagggtgttgcttttccagccggaaacctctgaggctggtagcgcctttgcccgaattttgcttgggcctgctgggcttattctgcctactcggcccatcagggtgcacttggctcgcgctaccagcccagatcccacacctgccaagggtgagctaggcacggagcagtgaagggtatgtgagggagctcagggtctggccactgtgcacagccaggctgtggtggggcgggcagcaccaggtgcctgcacaggcgccagctctatgcaaggctccagctgaaccaggcatactgcaaatggcttccgctgtggacgtcagggaacgtggtggcaccccgaagcttggagacgtcaggaacctcagagacccaaagagggtgttacagccctaactcgaggaggccctaggtctgagctccccaaagggctgcagctcttctctccttcccgtcgctggcaatgtggcaagcgaggggttgtgtttcagccctgtttgtgttacaactctttcagtcctgccatctggtgggtctgagttcttgtctggcatccaggaagaatgaggtatgtggacaactggaaggtgagcaaaatggagaggctcttccttgagtgacagaacagctctcaggaaacccatagtgggtagcacctttcctcaggcaggtcgtcctgataagcggctagcgttcagcagagaggggacccatactgggtagctcctttccacaggcaggccatcccgactaagtggaggagacctgaaatggatagttgattcccgcagctgttagtaccgtctgtgttaatctggcagagttagcggtgtttttatgggctcagaagggaggaagtgcatgctgattggtccatgggtagccataggcgggcctggagggagcaccataaattctctctgggccatggactccacccagaaatggcagcctggctcccaggcttcaggctgtccctggcttgaaggtggggtttcaccagggactcgcgcctttctccccaggaccctttctgcctcccgccatcagcatgccatccagggcacccaggctgttcgtgcccaggcccgcaccgagctgaccgcccccgctggcctccctcccacactcgtgagtacccaaagtccggaggggttgaggcgtcagggggctgtcatgtcagcgctgcctcaagggtgcacacacgcggccaggtggcaggagtgcctgggcttagccacaactttgctctgaaatcagagtgggcactgggagtgaggagaggccggagggcgggagcaggcacttctagcctgcagcgacaggtgggcttcccaggcccccaggagtacagggattcctgggtccggagctgtggctgggcgactgcagctccacctgggaactcagggctcccgccccgccaacttggtagggagtgggcctctggcctgctcctggcccccgtcggctccgcacgctgccctggcgcgcctacccctctgcacctggcgtcgtctttgcagcggacgctccagatgggccactgctgccattaccaggtggctgcagctggaggtaattctgcaggccgattgcccaacagagtaggatgggggattcacggagctgagagccaagacatcactttgagactcaaatccacacttcaccctgaactatccaggacactcagagctgccgacatttgctcaataattggtcaatttttgaccgtcactctaaccggaaatgcacatttaaaaactgtaccttcagcagctgctgtggaaagcagtttgacagatcctcaaaaagttaaacaaagaattgctacatgatctaccaatttcactttttggcatatacctaaaagaatttaaaacagggacccaaatagatacttgtacaccaatgttcatagcagcattattcactatagccaaaaggtggaaacaccccaaatggccatcaacagatgaatggataagcgaaatgtagtatatccataagacagaacatcattcagtttaaaaaggaatggaattctgttatatgccatggatgaaccttgaaaacattatgctaagtgcaataacccagacacaaaagggcaaatgttgtatgattccacttatacgaggtaaccagaataggcaaattcatagagacaaaaagtagattacgggtttccaggagctgggacaggggaggatggggcgttattgtttaataggtacagagtttcagtacgggggatgaaaatgttctggaaatggatagtggtgatggttgcacaaaaccgtggatgtaattaacaccactgaatggtatgcttaaaaatggctacagtgataaattacattatgtatattttaccacaattaaaaatgcatgtcttcatactaaaacaggtatcttaaaatgtttacctctgctgccaacgatggggaatgaaaaatcagtctcttgctatcctttcccgtggtgagctttcagctgccacactttctcattctcttccctcaagctgggccagatcacatgggcaggcagaggaaggaagacttgataaaaggtgtaattttgtcctgctgctgcttgtcgcagtatatgctttgtccattttatctgcttatgacccagttatttgctttttctctttatacacttgaggtaaccttggaaatgggctctaaaatctgaactgaaatgaaatggtcttcatgtacccccagtggtgtgatggtttgtgcttctaataaaataatttaagctaagctaagcgtgcatccactataactctctaacttgtgaaatctgtagcttcagaatcatcattcatcatttttgtcttccaagacactaatggaaattaaaataaacaaacctgtccatgttagaaagagaaaagatcctctacagtgacaagtttcacacaaattgcaatatgcataaaatatccaccaggttttaaaacaggtcatccattaagggttcaacagacacaagggagtattgcagttaaaaggtgggtagggtgttgtttaaccaacgttttattaatgaatgagagttcagacggcaaatgatagtctaacaacatcagtgtatatttgtgaagattaaataagactcatgtttcccccgtttggaggtttgcaaacgaaatctggcacaaaatatacaggaagataaactcgagaggaacgtagcctgtcacagtgattgatggggctgcttttcacccaacagtgtttgaaaatgtagatatccttaaataaatgacgccaagtgagccatgccagcctagggaattaagaagacattattgcattttgcagaaacaacataaagcactgctaccaaatttgatggttggaattctatatactttccatgacacctcacgatgtatatgctgcacaagagtgtatggtatcatttttagtaatgaggttaccaaggtgttccaaggtgaggcaaataactttctctgctgtgttcctggaggtgaattttaagactgcaaaatcagcagtatcattttctggaacactttaggaattcacctccacaactttcctttcccccagccccctcagtttagggtactttgaagagggactcaacatatagttgccaaaattgggggtgaggtgaggggatttataatagaaagtacaaagtttagaagtgatttattagcaagagagaaaagtattctcaaatggatgtaaattgtgaagcatttttttggtcaaaatcagcaagttatagcattcaatttgtttgcccatgatatattttgagttaaaaaaataaatactcataggcacataattaatgaaaagagcatagtattctgcatggtattttatcacctgtttctttcacttaacaggaattagtaatatactttgatgctaacaaaacatttttataatatatttagtagttgaaaacaatgctctgtcgtcaatctactttaattcattgttggacatttaacctggccctcccatttatacaaatagcactactgagaccatcattagagccagatcttgttttatatctttaattgtttaattagagcaaatgtctagaagtagaattgctggattcatgtgtcagtaaaaattttaggtcttttgatatgcattcatgcttatatcagcaggattcaagaagcccattttctcactcttttaccaccactgaatattatttaaaaagtggtaccaaggcagggtgtcttggctcaaacttgtaatccaagcactttgggaggctgaggctggaggattgcttaagcccaggagttccagaccagcctgggcaacatagtgagtccccatgtctacaaaaagtaataaatgaataaataaataaccggatgtggtggcatgcaccagtagtcctagctactcaggaggttgaggtgggaagatcacttttgcctgggaggtcaaggttgcagtgagccttgatcacaacactgcactgaagcctgggcaacagagtgagaccttgtctccaaaaaaataagtaaaataaaataaaataataaaatgtaggtaaaaaattgtagtcaaatttgggtatgcaagaaatatttttacttctttattttctttaagtgaaatttgatcttatctcaagccagcaactcaccctttccccacccatctgcactgtcaggaaaagcaatcagtgccattctttatggaacctcctgtcccttgctatggtcactgaggctcctacttgatacctagaaaatgggcaaagatttattacatcatggaggctgctgtgtcagacctcacagccccaggaagatgtgggcagttcattccaacggacaacaggatctttaactagacagagggaccctgttctttgtttttctctccccaacttggggcctaccaggaaatcctagggaccttcatcctcttctcctttcctagccatgggtattttcctctctggcactgccagccctgctccccctttttttttcctagtgtcatttcttttaggagatctggtgtcagtgaaaacaaaagccaggcatgccagctgtctgtaggcaacatccaagtccaagggaaggggaatggggggaggatggtctgcctacttgaaacagaggagccagaaatgaagggaaataaagcacaaataaatacttcaattaagtattttgacctatgtgtatgaatttgtctgtgtatttatagtcaatttatcagtctctctagttagttctaatagatttctttttcattagaacttgcttctcaaaaattatcacattaatactcttttttcgtgtttaaatgcaatccatcttcctggattggtgctatctctggaaagaacacttgtagaacttggatgataatgcttttatatgaccagtcgataatccataattgcagtacattacgatgaccatctatgtcccttttgtcttcactggtggttctcaaagtgtagttcccagatcagtataatcagcatcacctgggaacttgttagacaaattattggtcacaactccagacctactgactcagaaactctggtatcccccttccccccaccaatcagtagtttaacaagcccttcagctgatttcagtacatactaaagtttgaggactgctgctctacatcatcatcaatcataatcacgcactcatcttgctcatgggtactttagggtttccaaaccctttagatgattccaaatcaccaccgtgatttttaggggtaaggttaatgcaacaatacactaaagtcagtgtttaactgcacaaaaactcaccatcatctttctatacccaaagttgtgtctttagaaaaccatttctttaattggcaggcaactccagaattgatcatgtaggaaagcaaaattcattagcacgaactgtacaaaagtttgcacatcaaaaacccaaagcgtctcttctttttataaagatttagttacaaagataattataaagataattatgaaataattatgatttatatgttatataaataatgtaatcaatatttataatagataattataaaataatctttatgtgttcttttagaactataaaaattatgtttttaataagttttttattaaaaattggtctttttatgagactaattacaaagattaaagtctcctgcttagcttatctgtggtttgagtagctccagtagctcgatgggttagtgtgcagtggtacttatgcggtggcactttcatgacatgtggtttgccctctgaagctttgtgatctttcactgcattccaatactagaaataacatctttacatttttactctaagtcagttgccgccttgggaaatcaacttgtttttaggtgcttggttccctaagagggatatgaggagagtagataattttagtagttattaatgagaaatcctcaaaagccatacttttttaaattcttgtttttgaaacatttctggcacgataatacaggttgagaattaaaaacaagttttctcatttggcatgtttaagtgaagtcacttgcccagagcaggtactgctgtttatggcctcgcctgaatgtttgtggtacaactctttaggatgatgcttctgccaggactgtcacatgtacatgatttcaaatgtgctggcattttagtcagtgtattggagatagagtcttaaagcggctggaagagaacaatcttccttactttgattactttctctctctttaacactacctcatgcctttacttttaactattttaactttaactctttttttttttgaaccagacttgatgacaatccaggttgcaaattttagttttaccatgtattagctgtatgaacatgttagtttcctcatctataaaatggaaattttaatctatacctcacaaaacaatcaagagtaaatgaattacaattagacaggaggactaagggctactgttctatagcacagtatgagagtatagtaaataataatttattgtatatttcaaaatagccagaagagagaattttggatgttctcactacaaaaaaaaatgagaaatgcttgaggcaatggatgtgccagttaccctgatttgattattatacactgtatacatgtatcagaatatcatatgtattacataaatatgtacaattatgtgtcaattagaaattgtaaaaagggtaataaatgagataatgtatttaatgtgcttagaatatatgccacctagctaataacattattagcacataagaaataatcatatagttcttttacatcgtttcttaattctttggtatgatcgaaaatagaaattataagatttcaaactgcatttatatctctggataatttttacttcaaaactaggttatgtacatgattaacttttatttccaaccatttcaagaaaagaatatggagtaaaatcttatttataaaggaggaaatgaggtcttctggttgtaaatgacgttttatttacaacctggggacagcttccaatttattcagcaaggaattctttccaaaagttttttgatgtgagcagtgtatttatcttgtgctctgtttctggcccctgttattggttgtggccaagaaattataaaatataggatgaatctatcaggaactttgtgagtgtgaatggccagaggccacctgtccatgtgtgtgactctgctatggctgattcaacaatgcagcaaaccccagcagtttcagtagttccacaccttccgcttgttattaaggggtgacgttcaatgtgctcatgaggacgaggtcaggcctggcccaacctggaggccaggtgatggtccctagttggatgatctgaagacatcttttgatgcagtttgggttgaggaaggcaagagatgtattgatgctatcataggagtgaatcaggtgaggtaaaggcaaggaaacatgatatgaagtagaactggattcattataatatatgtgtgatttagtcacacaaatataccggcaaagaatgtcaagtgttaatcaaataggtcaactaataattgagggccaggcaaaggcaagccactgtcagggcaaagaagtgatacttttatctcaccccttatagagtccatggctgacacccctgtaacaaaggacctaataggagaaaagcataacaaatttatttaataaagttttatgtgacctgagagctttcagacacaaagaaccaaagacccagggaaaactgtgtttttttaatgcttaggactgatgaagaaaggacagtcacacagaaatgtgattggacaaaaagggtataatttgatgttaatgaagtataggagagaacctagcaaagcttgtttgttcacattcttcttggcctctctgtgtagcattcctttgccctggttatggggcaagacacctggcacaagaagcttatgacctgatcttaggggaggtaggtcagagagtaaccttttctaggttttatggctttctttggggaagaggagttgtagtttctatgacacaccttggtggagaaagggaatgggagaaaggagggcaaaggaaggttggagagaccttgcttttgaagcccttccagtctcctttacttcaaagtattctgcatggccaggtgccatacttcatggtattgtttaatgagccctgacatcacttaacaaaccacagtggcagatttcaagggatgttgtcagggagagtgggagaggagagtgtgatagacaactaaacagaaagcgactctacagcttgctaagggaagaagagagggaagcattaaatgagaaatcaactggagacagcaggtacttacggagacagcagatacttttagagacagcagatatttatagctggcgtcctacaccagggtttactttcatcatcccttttgttttcaaaactaagggtcatttttttcaacacaatgtcattatcagaacctagttgttgtaaagttttggatgctcccaaagtttctggagaggtaggtgtctgagtccttgcttccttccacaccttccacttgttattaaggggtcgacgttcaattacttagtggcatttattaccccaagatttctataagtgtcctcttggatgtgaagcattgttcatatatgaggggaaaagcaggtctttttgctgggaaccatatagaggtgatctcatagctttgaagtaccttgattggctaacacggtgacaccctgtctctactaaaaatacaaaaaattagccaggtgtggtggcacatgcctgtagtcccagctactagggaggctgaggcaggagaatggtaagaacccaggaggcggagcttgcagtgagtcgagatcgcgccactgcactccagcctgggcgacagagcgagactccgtctcaggaaaaaaaaaaaaaaagtaccttaatgcagcccctctcaatagtgtatttggctgggtccactccttccttttacttcccagatttagcttaattatggtgacaatggtttactctctctccattccccaccctgtttcctaatgttctttagccaagggctttgtagaaggactatgtttctaccagtggtatgtcactgaagtgggctattgaggtgaccaattaggacaaaggtgaggagtgtcttcaggggggtctttatctcatgtttcattcccttgtatggattgctgcttcctctacctttttggattgccaattccccatgtctacttttcttctatgggtttaacatagtgttttctctgaccctatcggaacattgttcagcagatggctttatataaagttattttgtttgctattaagcatcttagctatgctcaatgttttggggctgaattgttcattgtggcaatttgtaatatttgtaatatatttaagtaactctagagtcttggcttttaacattctcattcaattatgagggtcaggtcttgatctgaactatgtgtttatggccttttctcaactccttgtatagagatagttttccagaagtattaatgattgattgaagcagataaaatcttttatgttttcattcttttggaactcactttttggtggaaatacttgcaattcaactaatttactggtatgacttgttatatggattcttgacatgatgattggtttttataaatttgagctgtatttactcacttccatgaattgtgcagttatgaaaatttgaatctgctagtttctgatctccatttgtggaagaaaaagccaataaatgggaaagttattttaattctataatgctacatctagaaagggcgtgacaaatttttgtttgtaatacagttcccagtcattggaaggggacatctcttggtctgagtaatattcttcataatattaacacctgctcaatattgagcaaaacttcaattgcccacttctggccatatatccaactttagaaagtcatgtacttctagattttatagaagaatactacttctagattttgatttttttaaattaatttctctctctctctctcttacttttttgagacagggtctcactctgtcacccaggatgaagtacagtggcatgatcatggcttactgaagcctcaagttatcctcccacctcagtctcctgagtagctgagaccacaggcatgtaccaacacacccatcacacccatctaaatttttaaacattttttgtagtgatgggatctccctgtgttgcccaggctggtctcaagctcctgggctcaagtgatcctcctgcctcggcctcccaaagtgctgggattacaggtgtgagccaccacacccaaactgaattttttaatttatatttttcagatttgttactgtacccttcttgccattgagtacttaatttctccatcattgtttcttggagttttaatatcgaaatgcttcattatattgttcaataatgcagaatgtttgaatttaacatagagatttttaggcccataggctgaaataagtcatcaaaagatggaaaaacatatggtgatgaggcatgtcatacatgccaagcaggattggaggaagctggagaacttgaagccattcagggacaagaagattagcgagaggatttcaaagaagtttggagccccaagtcataagaaataaacacatgattccttatctcagactttactagtgaaagaaaaaataaaaaacaagctctctttcctagggatataaattatcctatgacaaatagaaagtgaaattctgtaggttattttcataacagaccttccagagaatttgctgatgactggaaaaggggaaaatgcaggaaaaaaaaggtataaatcctaagagtttctaaagtagccaaacaaggcaggaaaatgtctaatcttattgtgcaaaagggaggtggaatctgtgtggaagaaacagtaatataaaaataatggtacatgttctcatctgtgtaatgctcaatcatttccagtatgccctcacctggccacctgtaggagtatagcatcctacagcagaatgggacgtgtgtttggctgaggcctgactctcgccccttatagtttatgacaagagtattggggccaagcagggaagaaacatggaagaaacatctcattctagggcccacagtgaattatggccactgccgggacagagccagaatcatctcaggataggtatcttttacccacagatttctgcctcaggattgtggatgaacttgaaggtccctgtcttagcacctgaaattccatcagcagaagctcagcgtgccatagtttgcatagaacagaagcaggaaatcttaatgatgaactctacttacatccctttaatgggatcatggaactggtaggcaagaagcctagattgtatcttgcaaatttagagccaaatcttactgaaaggaatgagggaatatagatgagtagtgactactttatttttctacaacactgtttcctttttgagtcctgattctgctgacatggcacggaactttaagctcaatggtttaggtgtttctttcccttcctggggttgtatcaacattcctggaagtttgtgtggaactaggcctgggtgaaagggacccagctgttccttgaacctaagtctgctttgctgtgtccttcattcctatctatgtggcctctcaggtctagcaaacctcctgctgctttggtggcttgcttagggcatagtaagccactaggactccatgtttctatgaccaggcagtggactgaatttgttccacagacgcattttatttagcccacaaagttttaagaatctggaaattttatttgaataatgtagttttcagatttctcttgaaaaatgggaaatactgtaactcagtgcctgcattcttgcataggagcagccagctggctggggctgtgcctttgcatagggcattgctgtgcctttgcatggggcattggctctccaggcccacacaggcccctccagtgtccattggattccacctagcttccttcacccacttgagttttttgcatgatgcctccacgctgcacacccacattctctctctggagtttgtccctctctgagtggcttcttttgaaagattgtcttgggcccctgtactcctgggccttcagatcttcctttacttatcgcctcttcccttttctctttcccccagtcaaaaagaagcttttgcagtctgggcatggtggagaggagctcttttcattcactgtgcttctctctaacactttgtctgtacccctgattatggcctccacttcagatgccagtcacacatccaggcttcccgtatttctgaccaaccagctgatcagaggttcccacgacactctcctcgggtttgatattttattagaatggatcacagaactcaggaagacactttacttaatatgaccaatttattacaaaggacacaattcaagaatggccagacagaagagatgcatggggcagaaagaggcatgaagcttccaaaccttctctgggagcgccacactccttgtacctgcatgtgctcagcacccctgaaactctctgcactccattgtgtagggtttttatggaggtgtcattaaataggcatgattgattaagtcattggcctttggtgattgaattcaatctacagcctatctcccctccatggaggttggaaggtggggctgaaaggtgccaaccctctcatcacatggtcggatcctctggcaaccagacctcatcctgaagctatttaggggcccatcaagagtaatcctattagcataatctcaggtgtggttaaagagccttattatgaataaccaaagaggttcttcttactcctatcactcaggagcttacaagagttttagggagctctgtgccaggaactggggactgaatatatatttgttatatcacactatcagttttgaaattcaaaatggcacaatcaagattattcctgttttctcccttaacacactccttctctgagtcaatgagtacatctgtgcggagtgtctcccatttgccctccagacccactcttcccatctttcccattctctctgcctggagagctgatctgtatggactgtctcaatggacttctctgccttctggcttctttttgggtttggtcaatgggcagctctcccaggcagtctaaggtaaagaggagagtaaaggtgaggtgtttgctttttgtgattgtctacatgtgctgggaactacactttcttttcaagccttttggcttgaaaatgttaacagtgcctgcttgctaacttcagggaatgtcactagctctgggggttgctacagccttcccacatctttgtaaatagtctctattaaacactcaaattactctgtttgaaagtgccatttatttcctcttgggactctcacagataaaacgttatgtgcagttgtttatccatagaaatatttaataatatttatacagattttaagttttgtctaaaaatacattcaatgttaaaatgcagcatctgaaccttatgtcaatgtaagagttttctacaaaacagtcatatgtggttcaaaacacaagaggctgaattgaagctttttaactcctacatcacaaccttttaacacacaaggaatcctgagtgcaccagtttctaagagaacctaacagtactaaagatgatctagaaaaagaaaagaaaagaaaagaaatggggatgaattgtctgaggaagaattgtcagtaacaagttcatcatggccgtcaccctgcagaagaccctaatcagaaaacacagcttcacgcagctaaatttttaatgctcttctaaataatgtctgaggttagaatgtcagcttgggaatcccaaacatccagtaaaatgggacacctttgccacctctgtgagagtgttctgaccttgtctgtgtttttctccccttcagttcactcagcaacacagggaggtgagtaaaggatttggcagcacatttgaggcccgggggagaaagagtgcttgcaggcatgtctccacgttgcgcggaaaacatgatgtttagctgttgaaactattgtgaaacttggctttcttccttagtttgcctttttaataaattcctaaatcatgatttgattcataaattacaaatatatggtgtttgtacatgtgaaatacaagatcataaccatggagaaaggccaccattacccatagatttttaatcaaacaaattggtttattctgatgtttctctgataatttctctccagaccagggtttttttttttttttttttttttttccctttctgataacacaccacacttttggactatctacacaaatagctatgaaaaatggccttgttataactgagggaacttcattatattgaagtgctttttgaaaaatattctaaaatatgaaaactggccatccgaacaggagagcagtatttctgagggtgttctgctggctcgcctctccacgtctgacctgtcttctttgtgagctctgaatcttcctgtcacctcttcaacagcagtgtgttctgcaagtccagccttctcctctctgtggcgtcctttcggagatcatctgtacgctcaaggcttcagttaattacttgaataatgtatatatttaagcatcttcttcgcctttttctcttctgttttaggtcttctcagactcctcctagaacaatatagaataaatgccacataaggtaaaaattaaaaaatacatatatatatataagaaattcaaataaactgttttgtaaaagtaagagacaacatatggatcagtaatttaaaaatatatctccgaaccttcccacatgatgacttctaaagctataactcttacctcgtagtctcttttgaacataagttttgcaaaaagaatggtccccaaaaccaaaacatttcacgcacatgttcttccattaccgcagatttaccatgaccaagattaaacccaatgagaacatcttcctaccaaaaccctttagacggtctgtttctgtctgtgacacaattactcccagtaaacaagtgtcacgtctgtgtttttgcacatgtgtacctaggtatgtgtgcgcacacacacatgcatgtatgtattaagaaaggagttagtgtttattgttttaaccccacttcttactctggctgtccgttcccagtcagtttcaaatcttggattcttcttttgaaatgactcttaaagtcccccttcttctccattccagttgtgtttcttttaatcccaggctacagtcccctcacttctggactatcacaacacctgtccagttggcctctctgtctactctttccacgcctaggttataaattactcagttgtagctattatacctcataactttctgttccttgactttgctaatgctttccttctgaaaaggaatttattaatctgggctgttggtcctgttcctcttaacattttgtcaactatacttcaattacttgcatctgattaacagctgctgtgactttccctaaagtagaacatatttctttatgtctctttgataactcactgcattcattggttgcccttggctgaaaagcacattgcttatcaatgtgttttgttcacaatgatctggcagcccaagcatgatatttaatgtaattgatgtctcttatttactaatggatgttacatcatcattatttagaaaatttgctactgaattgacatctgattgaggatacgtgattgaggttaagagcctgtgaatgtttggagaatacttgtttatagtatgtactgtgcagtgtggtgtgctatctacaggctgcagctggcgtttccttctgttaatattctgtacttgatgtggctaagtaggcactgagatgctcaacttcagtgtttcctcctacctactgaaggacaaaacacttactggcagcaatcatctgatgcaatgtaagtaagaatgaaaaaaatacaggacacttatggaattatataagataaaaattagtatgatacacccatatttttaactcatttgtgtcagggtagttttaaatgaaagtgttattctaaatatggagaatctaaagatctatgtagttttaataatttattataagagaacttgagttagaggctttggagtgtcagtcattaaagtttactaattattctagccaccctgcccctccaattctgggtatatggtaagactgcatttactggagctcttctgattggacagagtttacaaccagttttacccactgagttgtgagtagcagtggctaaggcttttattacagtgtgattaggtttcctttgctttcattgcaacgtgatgaggtttcctttgcttttattacaatgtgatgaggtttccattgccaccatggctagcaatgatcttcacagtggctattctgtcagcctgggacccacagtgaagacattatggaacagagtttagccacctgtcactagacatgaacaagaaaaaagaaatacataatttttttaaagggctgggcatggtggctcacacctgtaattccagcactttaagaagccgaggcaggcagatcacttgaggccacgagttcaagaacagcccggccaacatggtgaaaccctgtctctagtaaataaataaataaataataaaaaattagccaggtgtggtggtgggtgcctgtagacccagctgctcaggagactgaagcatgagaattgcttgaacccaggaggcagacgttgtagtgagccaagatcagattgtgccactgtactccagcctgggtgacagagcaagactccatctcaaaaacaaacacacaaacaaacaaagcttcgtggtttgaagccactgatatgtaaaggagttttgttaccactgcataacctagtccctcctgacagatacacttggtgtgattctggttatctctttgactgtttcatctcatgtaggttacttaatcctctcattctttttacttttctgtaaaaaaaaaaaatgagtatagtatctacgtgcctaccttacagggttattataaagaccagattagataatgatgtatgtgaacgtgttacacaaataaatatacatacatataaaatatcattattattttctatgcaatcagataaacttctccagtaatgaactatagaaacgattcctgaaagagtagcctttaaaatattatttttaagtggtattcatttttggagcttaaaaatggttcttcattttaaacataatttatgctggtgctaagtctaaagcataaagaaggataaatgtataagaaaaatctttcacctcaacatacccccatccacattctcaattatagatgtgcctactgttaaaaatttcttatgaataatcatagcagtatttttaatacataatgtttttcaacattgttctgtcacttaacagtatattttgaacatttttctcattttttttctttttaatggtttcatgatactctactggataaatgaacagtgcattatatactttttcaatcaaaattttctttttaaaatttttctttgaaaaaatgaataacccttatcacttaacacagcttaaattattttttttaatgtccaaaagaaagaacattataggaacagatataatacatgccactgtctttgtgatgggaagtaaaaacaggataatagtaatatttatgatgtggaatgataaacagtaatgcctatagagatcagggagataaattagtaaaatcagagatgtgggctaaggaaaagcattgcaaggagagagaagggtaggaagggaaagaaagagggagaagaagaaagagaagagggagggagaggaagagaaaaaagaggagagagacttgttgccaccaagaaaatacatgtctttctaaaggcagctgctactcagctgaagtccactgttttcaataacaattctatctcatcattggcaaatattatttttcaagagaagtaaaaaaaaatcaatatatgtatgattttgattatttaaagtgagaagctaaatcagaaactttatttttaatgcataagccaaattacatttgttatttggggcaaccagatatagtcaaggcatagtgtgctaccctctaagataaaaaatataatacaggcacagagttttaacgtgtcttaaagaatatagctacatgaccgggtgcgttggctcatgcctgtaatcccagcactttgggaggccgaggcaggcagatcacctgaggttaggagttcaagaccagcctggccaacatggtgaaaccctgtctctactaaaaatacaaaaattagctgggcatggtggcaggcacctttaaccccagctgctcgggaggcagaggcaggagaatcgcttgaacccaggaggcggaggctgcagtaagccaagattgtgccactgcactccagcctggatgacagagtgagactctgtctcaggaaaaaaaaaaaaaaaagaatatagctgcatattttggtcttgtcttcataatctacctgtgtttcataccatagaaagcttcctgcctctaagcatgttttcataaacctacacaaccagcttcagttagcagaaatccttaagaaacaatattttagtgtaattttatttccagtctgtcttgtgctctaaagctcttaacaatcatacaaaaggagcttttgatgattctctctttgacttgccatttaccacctctttccatatcagaaatcaaagtggaattatgcatgttaatatggttgtaatttgactttcatatggtactgactaaaaagcactcaatacagcataccacattggtgtaaaagcaaatattttattaaagaattttgaaaagcacataatttatctccatacttttttcataattgattagttgtacaacatgcattttgataaattcaattacaaaataaaaatactcgatactcatatataaaaagtaacataattttaacatttttgtctatttacattggatgtttaacactgttgtctttttacactttctatttaggtcttttttttttttttttttttttttttgagatggagtcttgctccgttgcccaggctggagtgcagtggcatgatcttggctcactgcaagctccgcctcctgggttcacgctaggtttcttcttaaatgacctaaatgacatgagagatgcaggctgcagacattttttaaagtagtgaaatgcttgctctagagagtgtttttaagcctaggttgctttaattaataaaacttgtcatatatctcaaagaagggaaggtatgtgaaaaaaaaaaaaattcatccctgatgtaaggttgaatgcataattatttatacatatatgtaaattagaataaagatgactcttggttgactcaaagggtgttcaaaattggaagttattcttttatggaaggattttattataaaatgtaaaattatggttgaacaaagaggttttgttccatttggttatacatgctgagaaaattcttcatttttttaataagtctgaatatctcctttccaaacttggtaattttctggagtctaataataactgaaatccctttttaaaaacctgccaagagaacccacttttctgtctgatttaactaatgtaagtattagatttaatctgtttagttagggaaaaattagtttgtgaccgcaaatggctgtctgcattagttatatccaaatgaacagagtcatttttggaacattttttgatatccatttttcgtttacttggctagtttcccccaactttatcagttagggttcacagagtagttctacagaaccagaaatcagtaggagatgtgtgtgtgtgtgtgtgtgtgtgtgtgtgtgtgtgtgtgtgtgtgtgtgtgtgtgtgtgtcatagcagctgacagatccaaaatccgtagaactggggactggcaagcttaaactccatagggcaggcaggacagcgggaaacaccctggcagtggccgaagccgcagtctacacatgaaatttcctcttcttcaggaaaacctcagttttgctcttaaagcctttcagctgagtagatgaggcccactcagatcatcaagtataatctcctccacttcaagttaactggttgtagatgttaatcacatcaacaaaatagtttcagagctgcatcttggttagtgtttaattgaataactgagtactaaagtcttgccaaattgacacatacaactagccattataccatctctttttttttttttttttgacggagtctttctctgtccccgccaggctggggtgcagtgacgcaatctcagctcactgcaacttccacctcccaggttcaagccattctcctgcctcagcctgtcgagtagctgggactacaggcacgcgccactacgtccagctaattttttgtgtttttagtagagacagggtttcaccatgttggccaggatggtctcgaccttttgaccttgtgatccgcccgtcccggccttccaaagtgctgggatcacaggtgtaagccactgcgcccggccggcctataccatctttttataatcttcaaggaattttcttaaatcacctgactgagttccttctctgtgctcattctgtgcttgctgcattcatctgtcttgtaatttacaacaccatattaaggctagatatttatatgtttgtcacggtcctcaaactgtgtgtgctccttgaggttccagggaattagccatctatctttgtgttctctgtgcctagtgtgatgggtggcatatacaggcatcgcttgttttattgtgttttgctttattgtgctttgcagatattgtgtctttttacaaattgaaggtttgtggcaaccttgtattgagcaagcctattggcaccactttttaaagagcatgtgctcactttgtgctcctgtgtcacattttgataattctctcaatatctcaaacttttttgttattcttatctattttatagtgatccgtagtcagtgatctttgacattactattgtcattgttttggggtgccacaaactgtgctcataaaaggtcacaaacttaattaatcaatgtgtgtgctccgactgctccactgacctgtcattcccctgtctgtctccctctcctggagcctccgtattccctgagacatgacaatattgaaaccgagccagttaataactctacaatggcctttaagtgttcaagtgagagaaagaattgcaggtttatgttaaatcaaaagctagaaatgattcggcttagtgcggaaggcatgttgaaagcagagacagccaaatgctaggcctcttgtgccaaatagccaagttgtaaatgcaaaggaaaagttcttgaaggaaattaaaactgctattccagtgaacataagaatgataagaaagtgaaacagctttatgggagatatggagaaagttttagtggtctggacagaagatcaaaccaggcacatttccttaaaccaaaccctaatccagagcaacgccctaactctcttcagttctgtgaagtttgagaaagctgaagaagctgcagaagaaaaataggaagctagcagaggtcggttcctgagatttaatgaaagaagccatctctgtaacataaaagcgcaggtaaagccgcaagtgctgatgtagaagctgctgtagccagttatccagatctagctaaatttactgatgagcgtggctataccaaatgacagattttcaacgtagatgaaacagcgttatattggaagaagatgccacttgggatgttcatcactagaaaagagaagtcataggttggcctcaaagcttcaaagggcaggctgagtctattgttaggagctaatgcagtgggtgactttaagttgcagccagtgctcattggccattttggaatttctatcgtccttaagaattatgctaaatctactcttcctgcactctataaaaggaacaagaaagcctggatgacagcacatctgtttacagcatggttaactgaatattttaagcccactgttaagacctactgctgattaaaaaaaaaagattattttcaaaatattatcgcttattaacaatgcatctggtaacccaagagctgtactggagatatacaaagagattggcattgattatgcctgctaatacaacattccttctgcagcctatggatcaaggagtaagtatgactttcaagtcttattatttaaagaatacattttgtaaggccatagctgccatagatagtgattcctctgacaaatctgggcaaagaacattgaaaaccttctggaaaggattcaccattctagatgttattaaaaacatttgtggtttatgggaggaggacaaaatatcaacatgaacaggagcttggaagaaattgatttcaactcttatggatgactttgagaagtttaagagttcagtggagaaagtaactgcaaatgtggtggaaatagcaagagaacttgaattagaattggagcctaaagatgtgactgaattggtgcactcttgtgatgaaacttgaatggatgagggaattgcttcttacggatgagcaaagaaactggtttattgagatggaatctgctcctgatgaagatgctgtgaacattgttgaaataacaacaaaggatttagaatattccgtaaatttaattgataaaagtagtggcagggtttgaaaggattgaccctgatttttaaaataaattctactgtgtgaaaaatgctattaaatagcattgcatgctacagagaattttttgtgaaagagtcagttaattggctaacttctttgttgtcctattttaagaaattgccacagccaccccagcctcagcaaccaccaccctgatcagtcagcagccatcaccatagaggcaagactccccactatcaaaaaaatttcagctcactgaagactcagatgattattagtgttttttagtaataaagtattttttaaattaaggtaggtacattattttttagatataatgctattgcacccttaatcagctacagtatactacacacacaactttgatatatactagggaataaaaaaatgtgtgtgactcattttattgtggtggtctggaattgaacatgttaatattgctgagatatgcctgtattaggtgctcagtaacagcactccactgtagtacaaaatgtcatttaccacattacagagggagaatagatcacatttagcaccttagcttacctatacccacaacttttttttgttttgttttgagatggagtctcactctgtcacccaggctggagtgcaatggcatgatctccgctcactgcaacctccgtctccaggttcaagtgattcacctgtctcagcctcccaagtagctgagattacaggcttgtgccgccacatctagcttttttttttttttttttttgagatggagtttcactcttgttgctcaggctggagtgcaatggtgtgatcttggctccctgcaacctcttcctcctgggttcaagtgattctcctgcctcagcctcccaagtagctgggattacaggcgccttccaccacacccagctaatttttgtatttttagtagagacagggtttcgccatgttggccaggctggtcttaaactcctgacctcaagtgatccgcccaccttggcctctgaaagtgctgggattataggcatgagccaccacacctgggctatacccacaaattttgaataagatatataatgtaaattttaagggcatggtaatataatacaaacaaatcatcaggagtgaggattcctggtttttaattccaatccaggacctaaccggctggctgtgtttcagttcacccatcaatctctgggtcttggttttctcatctaaaagcatgaaggttgagtgagattattgtctctggttcagaagtggcctaatggtttacaagaagactgaacagatgtattttctccccctctttcttcaaatgcattgaaatgacagtgaagaattatagcggagaacaaatacatgacaggaaggtaaattgggaggcggggatgggaagggaggatcatcagaccagagttatgaatttaatttttgattaaggagaatggatggaatattgtaatggataatattaagtggaacaaggtttagcccagagtatatttaggaggaggctaaatgcaagggctactgtcagaattgccagcttctggaagctggattgggtggagggacagaaagcaacatcttttttttttttttttgagatggagtctcactctgttacccaggctagagtgcagtggcgccatctcggctcactgcctcctgaattcaagccattctcctgcctcagcctcccgagtagctgggattataggcgcccaccaccatgcacagctaatttttgtatttttagtagagacaaggtttcaccatgttggccaggctggtctcgaactcctgacctcaagtgatccgcctgcctcggcctcccaaagtgctgggattacaggcgtgagccacagcacctggccgaaagcaacatctttaaagtctacttgacagctgcaagacagcacccgaccccctcctctgtatgcagactaactggaagtctgacatttatggccaggtaaaacacagagcactcttctctcatgaaattagaggagctgagggagctaagcatttctaaagtggatgccagcaacccaaagataacttcgcctcgtcctggctatttgtgggaaacctcagttcaacagcttcttcatctttcagggtgaagtgaaatctgccagtttacatgccttgccccaagcactcagagctcccggcgagactcctgttaactagactgatgagttttttgactaaatgcttcattttccaccctcccttgcagctgaccatggtcatgtgattagattctggccagcagtatgtagacagcagtaatgttcacagctgttaggtgaagcccttgaagagatggcacgtttctttccccttccactcaaactacttggttcaacagtaaataactttaacatggtcccaattgtgtaaatttagctgtttaaaaaaaaaaagtttggaatcaatcaagggataatgtaaggaagactaaatcatggttataggacaaaatttaaatattttaaatgaaaaagaaatggtaaaactaaaataacctgtgaagagtcaaatatcatgtgtaactgatgtaacagcaaagagatttttaagtatatgattgacatgtatgatcacaacaacaaataagaactaatcatataactttcagatatcaggagaaacagataggagtggagatggggatagtaaaaataagttgtaactttgttaatagaagccaaaataaatttaaaaactagaagcctaagttcatcacaaagagttatgtggttacctgaccaacccgaaacagaagctgtttaagatgattgtctctggagaattaaatggaattgaggatgggatatatgagtcagagacttgtgtgtctcattttatgccctaccatatatattttttaaaaaagtgtgtgtgatagctttatatgatatcaataatgacgataaattacatagccatgctttaaaataatgccatcctaattttattaaagtaacttttctttacatgataggatatatgtacatgtagtatgtcaatttaattccctccattttattccaggactgccttccttaagtgttttctgtgttagaggatattttcaggaaaagcaagtgtaaagtaaacatttctccttggttattaaaaagttctaaagcccatcactagttgggatgctgtcctccctgtggtcatcagaataattcagagatcagattattctggtttatgtggcttgttctgggcaaatgagcaggccaagctgcatctcaagggttggccaacttctcagaggccatatatggccttctactcagaagacttctcctgcatataactacaaatcctttcccatcccaccttgcaaccatgacactaaccgtattgcattatgtatgtttatgtatattatgcattgggacataggtgagctcagctaggccatgacatcccacagttgagacaggtttgcttagaaagcaggtgtctgggtgtgaacatttgtgtgtcccattaactgccattcccgatccattatatcaatttcttcccttcccctgtagtctttcatccttggagcctggctcaggggattcatgggacagaaaagacaggatcggaatcagaatgttcttttttttgatctctcactgccccttacgttttattcagtgcagatagtttttccctgcccctaaatgaaaacttgatttgtctatgactttcctgttgatcctgagatagtaaaataccctgtcgcttggcagacaatcatggtctcaatttagaatttataatatcaagtcatgtgtgtcagaattctgaagttgatttaaagttcactttttctttctttcaccttgtctgaggcctgctatggaccggctgctcgacgtaggggaagggcatagtctttctactttctttttataccaaccatgtctcctccattagcttgaaaactgaagtttgtgattttactagggggagtcaaaaaaaggttaaagggggacagatgtagaaaagttcttatttgaaagctggcttcatgctcttacagtttcttcatagactgtcccccaaccccagcaaccccaatacctggtgatctgtcccttgcaattcttttgacctggggggttgtgttctatcttgtcactcattttcttctcaatagggttgccagatacaatacaggactctcaatcaaacttcaatatgagataaataatattgtcttagcataagtacatcccaaataatgtatggaatatacttatcctaaaaaattatttgttgtttaactgaaattcaaatttaactaggcatactgtatttctatttgctaaatctggcaactgtaggtagaagatgtttttcagggatgtctgcttttttgggccaaccaaatctggatatttaattatgctatgctctactactacaacattatttttccatgtcaagcaccttttcacaaatataacatcttaaaagagcttcgtagagcaactgaatatgttataaacttttccttctttttaaaaatgtaaccatctgtccaaaactgtaactcaaatgttaaacatttagtacattaaaaaaattatatcagtacctacatgtgagagagtgttttaagtcaactagagcgtcaacttataagaagctatggttggaaggaagtgaccctttctacatgtcagtcagtatcttctgaaacaactggcagacagtaggtgcttaatgaacatttgatgactgactcatagtgttatctatggttttattatgtaaaattatttcaagaatttccccaaatttaaattccaatgttgctaattcatcactgctatatctgtacagtactagaattacacacacaatgaaaagaatcctgggccagacgcagtggctcacacttgtgatcccagcactttgggaggctgaggcaggcggatcacctgaggtcagtctggccaacatggtgaaaaccatgtctctactaaaaatacacaaattagctgggtgtggtggcgcatgcctgtaatcacagctactcaggaggctgaggcatgagaatagcttgagcccaggaggtggaggctgcagtgaaccgagatcacaccactgcactccagcctgggagacagagcaagactttgtctcaaaaaaaaagaatagaaaaagaaaaaaaaagaaaagaattctggatgcacattatgattaagtggatctcagcaactgatgtcttctgagatgggttgtgaatatttaataacagggattattagaacaaactattgctttccttatgggggcagtagaattttgtttctttcaggaccattaaagagacagctgtgccagagaaaggactagtttatcccttcttttcaattccatcaggcctgttctgagccaaatccattccaatcagtttgactcattattcttcaagatggaaagctggatatttttacccaacatataggaatttcatgtgacttctcaaattcatacaaaacacttgcaaaagagaacagaattttttaagagaaacttttaaagctccttgcctctaacatcactttcttagctagccaatttcatgtagccaaggaggtaaatggatgtagctaagtaatttcctttcaataaattgaaataaagattccctaaagcttgctgtatactactagaagtcagaaaaagaagatgacactagaaatagtaaagtatcttcctatctgctacagattagaggcaaatataaatatgaccgctgccatctccccccaacaacagtgcaaaatattctggtacaaatatgtgaaggaaaaggctaacacatgcatatacaaaatgccatttgatagcattcgtgttacacccttgggaaggagattgctagccttgctgtccctaattcagttgtaaagaaattgtatataacgtttcaagttggttaagctggaattccatttccaagaatcccctgccctgtgtgattctggttgcgttggctaaaagaagagttttgaaggttgaagtgaagcagcaaccattcctctctgaaggttgtcacagttcaatgtggtgacagtcgcagagatgctggcaagttctggcttgatcttactctcctccaccctgcgtcttgctcttctttctacctgctttccccgtttaccaagcacggcccaagacccagcaccacaggcttgactgcagacccacagaggcaacagcctcggggcatttccctctctatgaaccttcccttcatgcttctcttgcatggctgggcacccttggcttctcagattgactggatggtgacttcccccatcttccaactttcccccagcgccttcatttccccagcctttcccacaactgtataaagtctgctagctgtaacaaatcccttctcccatggcttcatgtgccaaaggtcactgaggattactgaagcccagtttctctggacatcaaagttctcatttagaacaaagctgccatcaaagtgtctagctctgcattatgcaatagactgtgcccttgctaaaggtaaacttgatgtgactgcatttggatgtaacagccaaatatacactagcagtatacccatgagtaataggaacttcttgagaataacaatcccatctgagagaaaagctcatacacaatgaagccggctcaggaagcttagcctcattacaatgccgtgatttttaacttgtgtgggggtgttgctggtaaaattgagtagcaggcaccctgtatgggtgaaagctcagagaagttaattcaataaaagtcaagatggtatgaaattgctgatgaggggggacagaatgattttacagcatgtattttaaaaggccctaatgcttgtgatagtgtatgctcagatatctggattatttccttctttggaccactaccatcaactttgaagacaaccctcatttctcaatgtgcaggagctgtcttgccctgcccactccctccgtactcacctgtaaatgctgcctcctagaatagctgtgatcctgcctaagggcttttgtcaggcagcaggaacctttcacccacatgagcaaaacagaaatgctggagtgttcatgcccttggtggcatcactcaataacaataaggaatcagtggatacctacccgagtgtgtgccctagtctgtctccccaagctcttcagtgggtttgagctctagtagcctgcagtggtaatgcacgtgataatgcaccctgttttagctgctctcccttccctgtctcactttcccactcccgtgctgatatttcctgggatctgcctcctaataaaccacttgcatgtgagtctgtgtctccaagcctgcttctgagggattaaaactaatgccttctccatggctcttagccagggatgcttcttcctggctatttgttctcattaaggattcgtttaggttaaaatttgtattgggtaaaaagagaaggggaaggggctttgcaggtaaagcaaagatgtctgatgataaagtgtactatgatactaaattatagatttccctggaagcctccaaatgaattttgggtctcagagagagttatgagacccggaggatggtaggaaggggcctgtctctctctttctaagcccagtgagagggacttcaacaagactctttggggagcttgatatgcacctctacaggtggggagacacgatgttctggtgcctgccacctctctagagaagctgagagttagaggagagcaggcagcttgttgctctgaaggcagagcaagggcagatactgcagccttgggcttgccctgggtcctagtggtcacttgctaacataccttatatttgctgatgaagaatgggggagtgcttctagtggaaaggaatttggccttgtgcgtgagagagagagggagtgtgcatgttctcttagatcctgaaaataggtaaacagcctcaggagaaagaggctggagcaaatagctgcatttccaggtgttgagaaataggatggctgaatttaacaaaaatacaatatgcccagttaaatttaaattttagttgagcaatgatttgttttgaaagtataagtagatcccatgcactgactgggatgtacttacgtaaaaattattatttgttgttcaggtgaaattcaaatttacctagacatcctgtattttatctggcaactctgcttccaaaccgcctccatttcccagcaggactagaaggaaggttctgtaattgtgaaaatgaagtacttatcatgatacctgtaaaaaaaaaaaatccttggagtagaaagtgaaggttttgctgtgctcccgaactgagctaaagtgttaataaaaacttaatgctcaacttaattaattgttttttcttttaactaattaatctattgatcacatatttactgagtgaatactataggtcagacatagttccaagcactaggcacacaacagtgaacaaagcagatcaagttcttgacctcacagagctttgattctagtgatgtctgtacgtggcaatccgaatagaacttgggaccaaggaggcctgcagagttttgaagcaggtgatggttcctgccttagctcttgcaattcttgcctcctgcactggtgtccaaaactccccagggacaccatcaagaggaaaacctccattattgccagcactgctcggccttgctaagatctgtctgcagatgggatttggggacaatatgactgcagactgctcagctagacctggtgctatatatttccttcataccatacttcatttccaaagggattcgaagcagcaaactcatgcagctttatctgcttcactcactcattcattcgcttcattcagtcaaaaaagagatgagtaaggcatggctcccagctcacagggccatgaaccatgatacgctggagtaaaggaaggacaaggccctcaaagcaagaagctaccgactctgggaactgcaaattgcaatgtcatcatatatgatgctgtcaagaaaaaacaaattaaggagaaacaggaaatgcttcaactccctctcctataattcaattacaattttgcttcctgcttcttttcctaaccctttctaccacactctgtgagggtcatagaatgaaaacaaatataaatactgaattgcaaccacatgcagatagcacatgtaataaaagaagcctgcctatcatggaatttaacatgactggctggggggaatcaggctctttgtccttttaaacttggctcatattttaaatgacgttcctctgggtacatcatgttttagtctaaaagaaaagtatcaggccagtttgtatacacattcaaataaatatactttaccaggtaggtgtctgcattaacctagggaatgtatgagtgtgtgagtgtttagccagccacacatattgtgtgtatactcaccatgtgtgtatagaaaatgctacctgcatgggttgacaatttgatgtttcctaccttatgctaactattcccctttggccagttttttccccaacatcagtaatattattcagttattccctaaggggtgaaaattaagtgctattctgtgtgcagagtaggggaaattaaatctagctgcaacaagttggagctgctccataatccataatctgtagccatgatttgatttccaaaatttactgctggaaataaggttaatagtccccacatgttttcgttaagtctaaatttcacctcaattataggtgaggaaactgagactcagagaagctaaagcccccagtttaagtttgaagggctggttagtcacagtctctcgcaccagtgattgagtgactacagcctgctgccccctttttttagagggtgggtgtatacatcaaagcctgcatgtgttaaatacataggaggggaccaatctgagttggtacgtgaccccttcaccaaagtaggaactgagaaaatgaccttctccagctcacctctctagaaggaggggcactgatgatctttggagatgattttagaggcaaagctagaagctgcaaggccaccccagaaccaccaagcccagtggaacgtcagacggcatctgctcagatgctgatcttgtgtaattcataaatcactgagcctgttgactcggacttctgatgggctacataagcccaccaaggtatgttttaactctgctgtctttgcctttctaatatttcacattgaagttcttataatgcagaatctccctgaaacttctaatgggtttcattcttttgttgactcttcattcattcaggtaagtaacttcgcatttttcatttgtactggtatcagccatttcctaaacattttaatgttgctggttttgaataatagccactccacgcatagcaatctcaacctcccgctccactcaggcaaatgcagccatccatttacagatgtgcataggagctctttgcttatcagggctgccgttttcacaagatcccaagccttatagattccattacactccgcaaaacggcacacttggtctttgtgttgtatgcacttatgtccaagttttatgattattcaagagagtggtcgtggcataagaactctgaattaagcctgagtgatgctggcatgccagaggcaagtgtgagcacagatcttgacagccaaatagcacatcctgttccatatcacataaagttaagtgtgcacaccatatgaatagccacgtacattatcttatactgcagttcagagtagttggtaaacggaaaaaaaaagattctctgttttcctcatttctatgcatgatgacagatcttgacagtatcttggagggttgctaatttagtttcaggcagaaccatgcaattcctattgtctcagcatgactagaccacctcttcagatttcataatgggaaaataacacaatatctgcatttgttcttctggcagccagctagtggtgtgattgcattgttttctcaatcaagaagtaccattatttcagatagactggtacatggaagaagaaaaaaagtaccattgcttttgtcttcattgagttacatcaggatgattttctttggtagtgttatattagagaaagtaggcagggcgcggtggctcacgcctgtaatcccagcactttgggaggccgaggcgggcggatcacaaggtcaggagatcgagaccatcctgactaacacagtgaaaccccatctctactaaaaatacaaaaaattagccaggctcggtggcagcggctgtagtcccagctactccggaggctgaggcaggagaatggcgtgaacctgggaggcggagcttgcagtgagccaagatcgcgccactgcactctagcctgggcgacagagcgagactccgtctccaaaaaaaaaaaaaaaaagagaaagtaatttacagttttattttctctcatttaagcatctaacattattatatgcctaacagagtatatttatctcataaaagttgctgagaattcttttaaattaaatttactccgtagttgcattatattataaaataagagatgtattccagggaagaaagttttaagtaatacttttatattaatcaactgttgttgcataagaaacaaccacaaaaagtttattggcataaatcagtaaacattatttttcatccacacatctgtcatccagctgatgtggctctgctccaggcttgggggttgagtttaggtttgctccacattctggggcccagcttgggagtattctatccggtggctacctagggcagtgttctcatgttagaggtcggaagctcccagaggggaaagtgaaaacaagagctgctttcttttttttttttatttttaatttttatttttattttttgagatggagtctcgctctgtcacccaggctggagtacaatggtacgatctcagctcactgcaacttccgcctcctgggttcaagtgattctcctgcctcagcctctggagtagctgggattacaggcgcccaccacaacgcctggctaatttttttgtatttttagtagagacacggtttcaccatgttggccaggctggtctcgaactcccgacctcaggtgatctgcccacctcggcctcccaaactgctgggatggcaggtgtgagccactgcgcccagccaacaagagctgctgcttaagacctaagctcagaataggcccaatgttactgttgcctacattcgttcgccaaatcaagtcatacgacaaaaaccaacatcaatgacactaggaaaaatacttatcccatgattacaccttcagctttaaaagtgcagtgaactcggccaggagcagtggctcatgcctgtaaccccagcattttgggaggccgaggcgggtagattgactgagctagggagttcaaaaccagcctggccaacatggtgaaaccccatctctactaaaaatacaaaaaaattatgcaggcgtggtggtgggcacctgtaattccagctactcaggaggctgaggcaggagaatcgcttgaacccgcaaggcggaggttgcagtgagccaagactgcaccactgcactccatcctgggtgacagagagagactctgtctcgaaaaaaaaaaaaaaaggaataagtgcagcgaactacaggctcttatttaaatctaagttttaaattcgtgcaatatgaataacaatcatatactacagtcaaatttcaaaacaaaaaaaacacaaagaatggaaaaaaagtaaccagtttggcaggctgtttctcattttatcccatttcacattttatttcctattttatcttctaagagtcagaaacaaattccgataatgtagagaaagttcattagcaattttattaagaaatgcaactaatttttaagtgctgtgttaaaccaacaaatgctcaaattcatttacattaataagattacactattttaaattttcacaggcaaatgtattgaaatataatgtcatggcttaccctaatgcttattattatatgtataaagactttaaaaataattgattttgatattgtttgtattttgttttgttttgtttgtttgtttgtttgtttttgagatggagtctcactctgttgctcaggctggagtgcagtggtgcgatctaagctcactgcaacctttgtctcccaggttcgagtgattctcctgcctcagccaccagagtagctgggattacaggtgtgggccaccacacccggctaatttttgtatctttagtagagatggggtttcaccatgttgtctaggctggtctccaactcctgatctcaagtgatccacctgcctcagcctcccaaagtgctgggattacaggtgtgagccaccatgcccagcctgaaattaattattaagagctctttcagatgactatgtttttcaagctttgtataaacatggcatacacattgtatgtagatatattgatttatcaatttattgattggtgataaagattggatgggggtggggaatggttatgtgtgagaaaataatgtttgttaactactctctacaaattggttttataatacatattttacctaatgagaatgtggagtctcaaggaacacttgcccagagaatttcagttaacaaataataaatgtatctcattttgttcacatagataaaaccagtagtgaagcttatattcttctcatgcaccatactgctattctggttgacacagctgcaagaaggttaatttcgttcctctttttcttccttagcaatttttttaaataacaaaagttaaattttatctgggcatcttctcttttgagatacactggatggatatttctctgccacccagaggataaaagattataattttcttcagtcttctgataatatcatgcattttttcatatgcttttggggattgcagatggtcactgaataattgttattgtattattacatattttagaagtcataattgtaatgacttctaaaatatatcacatgactacttgtgattgacttcagcatacattgtatatagtttaaaaaatattctcaaaataccaattggtcatgattttgaaccattggtgtgcacagaacaaatgcagaaatgttttgtgaacaaatgatatagtttggatatttctcccctccaagtctcatatagaaatgtgaccccccgtgttggaggtgggggtctagtgggaggtgtttgggtcatgggagaagatccttcatgaatggtttggtgccctcctcatagtgttagttcatgtgagagctagttgtttaaaagagcctagcacctccttccctctctcttgctccctcatgccatgtgacatgctggctccccctttgccttccactatggttgtaagcttcctgaagcttcatcagaagctgagtagatatgggtgtgatgtttgtacagccagcagaactgtcagccaaatacacctgttttctttataaattacccagccttaggcattcctttatagcaataaaaaatggactgacacagaaaattgttactgagaagtggggcattgctgtaaagatacttgaagatgtgaaagtggctttgaaactggtaatgggcacagggttggaagagtttggaaggcttagaaaaagacaggaagacaagggaaagtttgcaacttcttagagacttgttaagtggttgtgaccaaaatgccaatagaaatatggacagtgaaggccaggctgactcagataaaaatgaggaagttattgggaactagtgtagagaacaaggtagtgctagtaccttgttgtgtactagcaaagggcttggctgcattgcatccacgtctgaggcctctgtggaaggtgaaacttaagagtgatgacttaggatatttggaagaagaaatctctaagcagcaaagcattcaagatgtggcatggctgcttctgaaaacctatacatagatatgggagcaaaaaaatgacttaaagttggaacttacaattcaatgagaagcagagcttaaaaatttggaaaattcacaacttgaccctgtggtagaaaaggaaaaagcattttcaggagagacattcaagtgggcttcagagcaaccacttgctagagagatttgcatgactgaaagggagccaagtgctaatattcaagacaatgaataaaaggccttgaaggcatttcagaactctaggctgcccttcccatcacaggcccagagacctagaaggaaggaaggaattgattagggggccaggcccaaggctccactttccttgcagcctcaggacactgctccctggatccacgctagcagtgctgtagcttcagctataagggccccaggtacagcttgggctgccactgtggagagcacaagccataagccttggtgagttccatgtgttgcgaagtctgcaagcatgcagaatgcaagagtgaaggaggcttggtagcttccacctacatttcagagactgtatgggaaagcgtgggtgcccaggcagtagcctgctacagaggcggagcccctgcagagagtctctactaggtcaatgtctaggggaaaatgtggggttggagctaccatacagaatccccactggggcactgcctagtggagctgtgggaaggggttgccaccctctagacaagagaatggtagagtcaccagcagcttgcaccttgagcctggaaaagccacaggcactcaactccaacctttgaaagcagtcacagagcacagaggctgcaccctacaaagctacaggggcagggcttcccaaggccttgggagcccacccctcacaccagtgtgcttaggatgaagagcctggagtcaaggattatgctggagctgtaagatttagtgtctgccctgctgttgcctcattcttttggctgattcctccctgtagtaatgggattgtttacccaatgccagttctaccattgtatcttggaagtaaataacttatttttgattttacacgttcctaggtagaaggaacttgccatgggtttcagatgagggtttggacttttgagttaatgctggaatgagttaagactttggggaactactgggaagggatggttgtattttacagtgtgagaaggacatgaaatttgggggatcaggggtagaatgatatggcctggatatctgtcctctccaaatctcatgttgaaatgtaatcctcaattttggaggcaaggtctagtggggagtgtttagctcttagggagcagatccctcatgaatggcttggtgtcctccccatagtttcagttcatgcaagagttacttgtttaaaagagcctggcacctcctccgctctcttttgctccttctcatcatgtgacacactggctccccctttgccttctatcatgattacaagcttcctgcagcctcaccagaagctgaatggatcgtggtaccatgcttgcacagctgcagaaccatgagccaaagaaaccttttctttataagttacccagtctcaggtattcctttatggcaactcaaaacagattaacaccaaaaaggaatggagacatctacccgcttttcactagggtaaacttgaatacctttgttttgttttgtttttggaaaaaaaaaaaaacccaaaaaagtcttaaattattacgaatagcaaaaattagtgatcagcaagcaaccaacttgtggttaagtaataaaatttgtaagactattatagccaggaattctgtttttgaaaaatgactttaacaatgggctttggctctattttgaatcttaaagaggataagaaatatgagctcccaatatacaatggaatttaaatacaacaattgtggaagttttgtacagttgttgatggattacccacagctgacatgcttttacttggtcagaagataaaaagaatagaaacatttaggccattcgtgtgttgttaaagcaagttggaattcaagaagacatctgattccactaaatcagcgaggagttttcaaaaagcagatggcattttaagccaaaagacagtcctttgaaggatcttgagacatgtaatttatctgaatacatgttgctctcatctgtgatttcctggaggataggaactatgtcagattcatgccttccttccctagctcagtgactggaaagcagaggggctcaataaatgtcttaagagaaaagagaggagaaaattttgtaatgctatttgaaactttatgcaaaatatttgctcaagtatttcacactcagtactttttactttttgcctatatgcatactaaagtacaaataaattattgctgattgtgttgattttgcccattaaatttgcattgtatttattttaaacaagtctatgtttttagacattaagataaaaatgctaccttatagaaaaacaatgaacagtgctgtaaattaaaattagcaccttagaaacaaaactaaatagatttcagggtttgttgttctgaagtaaattctgtgctgcaaattttgaatcctaaaattcagaacataatttttaggctccataaaacatgtttgtggttggctgctttatagtaacatatttttgtatgcatttggcttcatttcttctattattgtgattctcattccacttgttacctagcagttgccttttctactgtttaaaaaattttttaagggggaaatgtgttttgtaactcagaaaaacataatgtaagatttctcaaaatatatgattttaaaacaaggacaataaatgatttcctcttaaaactgacattacttaaattactaacacaataatatctttaaatgtctacatacatgttaaatggattgtaatgtcttttgaaaaatatttacatattttgtttcagagactaagtatactcaatttatctacaatgattcctttgttgacaaatagttacaggcgtgactgatttgatagttcattggaagaagatcttcggtatctttcataaagcttagaattggcctggtatttaaaaaataattcatgttggagtaatttttgtatggttaatccatttaaagacagacaggataattcatttttcactgaatcatctagatagtagaggcctataattgatgatggcaagaataagaatatttaacctttgggtgaaccaaatgaataaaactctttgcaacaattcttatgggtagaaacagtatttttctgactctagtttagtatcttgggcttcttcccaactgtgagcttatggagaaatgattcctctaaggcagaatattacttaggttattgtcctattatttctttcctttccatcaattacttccagtctagcagcttttagcaagattcttgtttgaggttagccatcctgctatataatctggagtctaggaaaagtacatgtcattttacctggatattttactcaatattaaacatttatgttctaagtttgaatatccccctttccacatctaaaaaagaataaatcaaatagtaaaccccattgctataatttgaatgtgtcccccaaagtttgtgtgttgaaaacttgatccccaaagcagtggtgttggaagatggggcctaataaaaggtgtttgggtcatgggggcaccatcctcatgaataggttaatgtccttatcttataagtgggtttgttagcatgagaattggttcatcttctcttgcatactctctcttgccctttctttgcccttctgccatgggatgataatatcaagaaggcctctaccagaagctagcaccttgatattggactttccagcctctagaactgtgagaaatgaactttttaaaattataaattccccagtctctgctattgtgttatagcagcaaaaaaatggactaagatacccatgaaggagaagtgataataaagacaagcttaaagctatctatatttgaagactcttgaaaaactatgaatatgtctccaactactatcaaagatgttagttagaatatagattataaaaaaatcccatacctcaaccattctcactactagaaacacatattactaaaaccctgtggcctgccaattgtaaggtaatcttttaacataagaaactgcattaattttctataaacccaaagacttgcacaattatttcagaagtgtaattctcccaacacacacacacacacacacacacacacacacacacacacacacgtaccacatttcttttcagtagcttgactataacttggaaaaaatgctttagagaaatcacttcaggatggtggaaaaaacaaagaatcataattctccttatgtgtaatcaatagtaacactccatctcatgtataagtttcatatactttcaagtccagctctctggctttgttcatttcattcaacaggactgaaacaaaggtcttggcctcagtttttcacatgaagatgtttgcaaaggaaacagtattttaaagagtatttaattcacagaagctgactataaaaaataactaagaagcttcttttcttccaagacttagtgtttcccttgttaatgagacatttgtcatatagacttgtttactgccttgttcagtttcatagaaaaaaatgatgtacttttagaatttgatatagaaaatattaccagaaaaattataacaaatggcatgtttagaatttatagtctgctgaaatacaatttaggtctttattttactatgaaaatgcaatcaatagccaaaatccaacgtattccagtgattgaagtttatttgaatactgtgaagttgtgaaatacatatttggtcttccctctgtgtctttctataagctaatgagttagctggtgactggcagcccctaggtagcttaaggatgggggctggtcacagaaaaggccaaagaaggcatgattagagggttgagacttttcagccccatcctcaacctctggggagtgtagaggggctgaaggttgagttgatcaacagtggccaataatttaatcaatcatgcgtacctaatgaagcttgtataaaaacctgaaaagactgggttcagggagcttccagatagctgaacacctgaagacgactggagggtacccccctggaaggggcttggaagattggctcctcccatacttattcattccttatccgtatcttttgtaatgtcctataaattgcacccgaggaggaggttgtgggaacctcgatttagagctggtggtcagaagcacaggtaaaataacttgtgctttcaacttacatttgaagccagggggacagtcttgtgggactgaaacctgaacctgtggtatctggcactatctccaggtagaaagtatcagaactgagttagaggacacatagctggtatccactgcagaattgattgcttgcttggtgtggaatgaaaatgcaatgtattggaagcccctctctcccccatatctgatgtcagaagcgttctgtgtgatgtgatgtggtgggtagagaatagaaaacacacacttcagtttttactatatccttccacgtatttactgacagcaggcattcatatggaatgtcaggcactgcaagcgatacacacatccataagacagcatctcttccattaagaatcttaccaactcacaaaagaaaagagatatgaatacatggaaaggtaaatggcaatagagtatttaaataagtaagtagaatttgaatttgtctttgataatggtgaggaggtgaaaggagttcttgaaagtctggaacaaaaatcaaatcaacttatgagtggatagaagatgggtaggtaatgctaaagccagtatagtaacatatgttaagtgtagactctaggtgggttcattgtaaaattatttcagcttttctgtatgtttgaaattttcattaaaaaatgatgaaaaaagacgagcatataaagggagagaagtaaactactttgatgggcatttaatttgatgtaatggaaaataaaatacgaaaggtaagttctaggaataattgtattttattagttctctgcttcatttggtcagaaaactaaaggcatttaatgttagagaataaattacattgtgtatctatcagctaataatagaatttccaactcaaattggcttatgtataaggaaagttattatcgtgcctaacaggaaaaccaaaattaggacagacttcagggctgtttaaatcagttccttgtaaattctctgaggggtgtaagcaccctctctgctgtctataacatcatcttcaatatgaggctagtttctatccactcaaaagatggctgacagcagtcttctctctttccattgcaaaaaaatgactgccttcattttcccagttgccctgagtaaactcctccttgtgtctttctgtcctaaattgatttaaacctgcccagttctgaatcaagctctggtaagagggtgaggaaatacaggctcatgactggcttagactcgtcatggcagggggcagcaacacagtgaccactgcagggtagagaagagacaaagacaccctccatgagcgctgaaggataaagggtgggggaaaggcatttgttcgtaaaaagtgtaaaccaggtacttttaggaaaattttaggggaagaatatgttataaaagagaattatctttatgacagtaacttttttcaatgattataaaggcgatatgtgttaactatcaaaacttcataaaaggcgatcagttataaccttataatcaaggtttatgttgacatttccttcaaacatttattatgtgtgtctgtgtgaataaatatatatgttatatacttgttatgatactgcctatacaattttgtgttccacttgctttccttaccattatatcaccaatatttttaatgtccttgtaatgtatttacaaattttgtttaaatggctgcatatctttccattacagaaaagtacttcatttgggtaaatattcttatacgatacaatatttaaaataaatcaatttctgctttgttattaacactggtataaatatctttataataaaacattgtctgaatctctgattatttccttagaaaagattttcaattagtatatcattaagccaaactgtatgaatagttttaatctcaatacatattgtcaaattaagcttgtcacattttatacttataattgagtgatgattccatggtttctaagtattactgttattatcattactattatttagcaactcccttttggcaggaacaatatgctttctcacttttcagctccaaggaggtctgtaggagatatagctacaaatatgttttctgtcacttttgttcttcattaccatcttgctgcatttcttccttcttctttggcattcttacatttaaaaagtagagatggggacatgtctctgttatttcttcttttatttatttctaaatctatttcttgttatttcttgatctaatatccatacaggtttaggatgtaagcatttaaactttcatacgtagaactccacatagcaatgaaggaagaaatcaaagagtaaatgaatgaattagtgaatgaatgcaatgaatgagaatgcaatatctggtagttcagaatgaaattttccttatcaagtccataaaatttgcaaattacttcataaaagtgctttataggttttggcattttaacaatgtttacagtgttttagaagagacaaaagatttcagtcttgtggcagttagccagaatagggagcaaatgtgcatgtaattgcactattaagttattaagggtggtaagaaatttacacaaaacagaccctgaattgttttaaattctgttagttgaaaggttaacaaaggagaaattatattctttaactcctttttttgtttgtttgtttttaattcacctttattttccacttggccacattattttcttgttaaataaagaagagttatgaattttcttaatgagttaataatgtaagctgaatgtccacaggtaaagggtcttatgtttcaagttcatgacattaggcgacaaaaatcagtatatccaagtatgaatgagtagggaaaaaaagttatttcatttctggaaccatatttttagttccaggatgtaacactgtaggagataatatatgtgaaagcgtcttgaaattgtaaagcactatctaaatgtaaaggattagtattagtagtgtggtaaatcatttttctgaaggttggtttggaccatttatattttcaaagtagatgaatagaagaaaaatatgttttactccaagaatggctgatttcctcctctagagtagttgtagcacttttcctggtttgatttgattaatccttatgccttcctggtgaggaagattggaggctcacgttgcatttttatggatcttgcctacattaagtttcagatatatagatgccatttcttaccagtgcagctgactcgtctgtcttttaattatttcttttatcactgaatttcagatggacacactagagggaccatagcagggagcccactgcagcggcagcagttgctgcagcgtttggaagtgttgatatggcttctggaggtttttcctgatgctttgagctgggctgggggagggggaggcattctcagaaagctcacaggactcaatgcggggaaagggccactggaaaaggagctacccaagccattactcttcagctttcactgagtgtttatatgccttggttttatttcagaaaactaattatggaacattccagcattcttcataaaaagtgagcttggggagtttatcgggtcctggggagtcataagaaaaggatcaatccaagaggtggagcagaaaacaatcaggggacttggagtttgccagctggaaaaaaagttaaaagcggccaaagagccctggaagataatagaagctatattcagattcccaagttgtattctgagtttttgctccttggaatatccatagtcctccatttcagtttccaaagtaccccttctcctaagaactcaagaggctacccaatttttctcacaatgtccatacagagaagggggatgaaaggccaggtattgttatttcaatgtcaggcacacacagaaactcaggcataggaaagtaaactgctcaggatgacaaagtgttgttaggtgatataggcttcaattttattttttactcttcaaaaacttttatttggtcaagtgatatttgagagagatataaaaaaaatcttctttataaaaatgtcagtgccttccaggccatgtgtattcttccctgttttaggaattatcaggaactattgggaacaactgaggcctcttggtcactagttacatacctcctttgaacaatctcttccttcactttctttttttttttttctgcaatcttcgactcctgggttcaagcgattctcctgtctcagcctctcgagtagctgggactacaggccctgccactatgcccagctaatttttatatttttagtagagtcaggattttgtcatattggtcaggctggtcacagactcctgacctcaggtgatccacctggcttagcctcccaaaatgctgggattataggcatgagccaccatgcctggcctcttccttcactttcttacagtgaggcctggctgtctccaaaggatttgctctccctgcagccttctcatccagttctgttcatttttcctgtacaccatgcaccatgggtcctagatgaaagaaagatgacctccttgttcataaaaatcatttgcagactatttttccttctcttctagaaagaaaaaaagaatcaacttctttgaaatgtatgtttacttgtatgtcctcagattatcccatctagagttaacattttttctcctggttgcttcctctcagttacagggaattttagcattttttcccccatgactactttcttaattcttggtggctccagcaaagaatggaaggttcttggctggtccatccatcacctaagccccccagttccttgactttctctccttcacttctcttctggtctacccatcctcactcactccctgcacagtcatactctttttgatcttgccattgcaataattgcaccagctccataatgttagttttgagcatcccgttctttgactactacttcttatctttgcagctccttccctgaatccaagaagccattaatcccacacacatctccacacttgagcctactatattccaccattcatcctccccttaacattcacacctccctggcatggagttcacaagccactgtgatgatctctccagaacacacaccctcaactcccttgactccctcaaagtcacctagaaaaaactcaccaccagttaagtcctcctttctgcctgctctccacctatttccaggcagttgaacatgactggggaaaagctcacaaccacactctggtctcaagtgggtcctcagcctcctagaaagtctcttcacattccctcagttaagccagtccctcatcactaagaaaaccacttcctcagtcattaacatcattagcatcaactccaatctacttgttttcaactttccccagagaaaatagaagctatcaccagagaactttgtcttcaaactactaaatctaccaacctgcctgcttctttatcccatacacttaccctggatccctggccctcactcacttgatgtttgcttctgccttagccatattttttcttttctcttgactctaatgccttccatcttcaaaacagaacagccaaataaataaataaataaataaataaataaataaataaataaataacatcctctctcctgtgtcccctcttcagctactcttccaggcttttagagcagaactcctcaaaagacatgtctttgtgatctctccacttcctcacaaccattgtctctcaaactcacaagtctactgcaaaacacacttgttaaagtcaatgttaaagtcagcgatgagttccctcttaccaaatacactggtcagtttcctgatcagtatatgtatcttaatatgcactgccgcagcatctgacataatggtcacatcttcctttccgaaacaccttgttcctttgcccttggacatccttcactcttattttctcttactttattagctccttcctcctactctctttttctggttccttttgaacactggagttttccagggctcagttcttggaccctttttcttctgtatcttcgcttaatgtctttaagtgacattaaccaggtctgttccactttatggtttatttgctgaggaattcagctcctaccttttccctgtgttccagactcattcatgcacttgtctgtttagtgtttttgcctggaaatctaataggcatcataagcataacatgttcgaaaagaactatgagtgtccaaaattcaccattccccattctcttcttaaaaattagtatcctctttaacttagttgctcaaagcctaaaaccttagctttatgctttacttttctccctctgtctcttcctctgtatctcttctttctcgccttttctccctctctcttgctgtcttattctccacatccactccacgagtaaatcttgcttactctaccttcaaatatatcactttaaaattatttattgtttatctactccactagaacataagctcccagaggccaggagctttttgtcttatttgctactgtttcttcaagcatttagaatgagaattggcagactatgacccatcagccaaatccaggctttcactgaatggtttttacatctttacatggttaaaacattaaaaaataaaataaaattttgtaataaaaaaattaaatgaaattcaaatttcagtatccagaaataaagttttattggaacacagccatgctcatttgtttacatgttgtctatagctattttgtcattacaacaactgagttgagtagttctgacagagatttttatgggatgcaaagctgaaaatattcacaatctggcactttgtagaaaaaagcttggcagtttctaccgtggattaacattccttcacagaagctgaagcttaaatttattttttctgctagttccaataatgaattcagaactcagtcttgtatccatgaaccacatggctattcttgaaccaacccctgatgaagtgttagaccacagttaattgtataaatctgggtccatgcccatctctaaagctggggaatggagaaggattaacactctctatatcatatgggcttaatatggaagagaggcagtttcccaagggaagttgacacgctataaccaagaggggtgagtagagaccacccctctgataggaaaaacaaaacacttgttttctacatggaccttcctgctattttttaaaaaatggcacattccaaaactcttaatcctatcaggaattaaaattttttgttactaagttatacatacttagtttactagaatgtaatacttggtaccttaaaccatctgtatcttggataggatctttgttttcttaaatccatggactccaaacatatataactattactttttgaagctaattgtgctggaatgggacatagtccaggaggtatgaaaatggatgtcatgcctgggaggcgtggaccaatttatagatgtcctaggcaggagccaggctactggtaccacatgtacactcagcttcttggcaatgacagaatgagatctctgcatgttgtacctcattccagctctctttcctcattgtgagaattaaggaccacccagccagagtgggaggttatctgctacaagtccttactaatttatcagacaaaccaattcaaggtatcagaattcatggagaagaggagaggacagatttctgactaaaccgtgtgtctgaatctccccctcaataaagggaagccattggagatcattaagaaacaaacaaaaacttttatatggtcagattgtgttttagcaagcttattggcggtagtttggaggctgtgtcatagaggaaaaagataatatagaatggattgtggccattggtaattctcctaactcaataacttcttagtctcgtattcttgaagtcatggagaaatccttgagtcagtgaaatgttcctttatcacaatgtcacactgcaagaggtttttttttttttttttttttttcctaagctgaagatagaactgttttggaaatcatagaaacatatttgcaacatgcaagatgttatttctgcattgatcattttaattcaagaaattagtttgggaattagacttcaatagtcttgtgattcacccttttgaaattaatgaagatttacaattttgagttcctctttgctagcattttcccctttgaatagcaatgctttgttcataattgtgacatttcttttctgttcgcattctctcactgagaattctctttgatagggtggattttctgcaatagaaataacatttttgtgcaactaaaaaaaagccaaatgccaaagggtaaaaaataagtttttgtggttataagattgttaaatgtagatgtaaaattatgttatttctgatgtcccatccaattgtggcataagcctgaagtttcgttcaccctgagatctcttattatcagccttttctggggtgaggtctagctcacacagaatccccagtgtaagggctgtgatgttattttaaacatttcattaatttaaaactgtcatttaacaatggcctctagttctaccaatggacttccttgtgggtttctgacaaaggtcgtggtctgtggtccctctccacacctaattgtgatgaccttctgagaataatgactgctgcttcacatctaccttcccagctttgtgaatctctggggttggccagctgtcacttagaatcatacaaggaaagggattctgcaagatgtaggcccagcttaaccaagcagacacacaccctattttcttctttcactaaaaccaatcattccctattttattctttaaacaaaggactactcgacaatgctattaattttcagcataattaattacgcctaaaagtaaattatactcttcctttaggggttgcttatttgtcacaacttgcccctggcaagtctgcatcttgtcaactagcagtttgtactcttgtcttctttttctcttgcctttaaataggaactataatcagtttattttccctccacatcaacaataattttttttttttacttaattttcttagaaaattctaggctggcatgtaaaatgtaatggttggtattagagcaaagcatgtagcacaatgaaacgccatctttaataaaggcatatgtgcctttattaaaggtttctccaaggtttctgttacaggaaatcatacatcatgggtggctagaggagaggcatcactgtctatgggagtcattggagcagaaacagatttatttcatattcttcctttgactattcaaacatagaccaccagatttatgaaatcctatgttctgtatctctgtatcttcctttcccctgatgtcatttatttgaaccacagcacaaaatgagattgagtaggcaaaggccattaaattcaatgtcattataggaggtgcaaggggaagcttggattcttatgagcacattctccacaagtagaaaccttaagaagcaacactaggttttttttttttgttttttttttttaatgaagttttgctctttttgcccatcctggagtgcagtggcgcgatctggactcactgcaacctctgcctcccgggttcaagtgattctcctgcctcagcttcccaagtagctggaattaacaggtgtgcatcaccattcccggctaaatttttgtatttttaatagagatggggtttcaccatattggccatgctggtctcgaagtcctgacctcatgtgatctgcccacctcagcatcccaaagtgctgggattacagacgtgagccaccacacccggccaactagtttttcttaccatctctcttgcttttcctcttcaccatgagatcaccatagccatgtggagcagagtcttggctgacccatggccaccaacatacaacatgagtgagaaagaagtcaaggctatttttattttgtaagccactgaaatgtggagtctgttatcacagtaaaagctaattaatatggaagttagaaataaattgcaccaaactgctaacagtgactctttctgtcatgttgaggagattagaggttactatgatttttcttactttgtttgtattttccctgttactgtattatgaataattttagatgtggaaaaaagttatttttttcttttaagcatacattcagttcttccttggcaacagacatttgaaatgtaattaaatttggactattcttgaacaaaggtgtttgccatactcagggcaaacttgtaatgctgcattaaaacatatatgtccttcaaattgacctacagattcaatgcaatacttttcaaaatcctgctggctttggagaaattaataagctaatcctaaaattcatatggaaactcaggggacctagaatagcttaaaacaatcttgagaaagaagaacaaagttgtaggactcacacttcctgatctcaaagttacagtaatcaagatactgtggtactaatatagaatcaaaatataaatcaatagaatataactgagactccctgagtaaatcctcacataatggtccattgtttttcaacaagaatgccaaaacaattcagtagaggaaagaatgctgctagaatgactgggtatcctcaaggaaaagaatgaagttggaccctctatctcacatcatatataaaaattaacacaaaatgaattcaagacctaaatgtaagagccaaaactgtaaaactggattagaagagaatttagggatgcattttcatgaccttggtttaaggcaatagtttcttggatatgaaacaacaagcacaagcaagaaaagaaaaaacatagataaattgaacttcatcaaaattaaaaacttttgtgcttcaaaggacacaagaaaatgaagagctggcccacagaaggagagaaaatatttgaaaatgatatgtatgataagggtctcatacctagcatacataaagaacttttacaagtcaataatagaaagacaaagagctcagtttaatcatgagggggacatggatggtaggatgtaagtatatacaaggggaaactgacatgtctttaggaagttagatatctattaaaaggactagcataatacttgtatatcccttgtttggaaatgtgatattcttattgattcctttggtctacactgatcaccacttttcaatatattagaatattgcaaaaatcacaccactaacatgattcaaaacaaactcctatgtattgagtcgataatatattcaaagcattatattggaccttgcagaatttaaagatgaataacacacacacacacaacacacacacacacacacacacacacacacacacacacagattttttcttgaagtaatgtttagttcacagaatccattcctcaggccacccatatcaacactgcttgaaacttaacaagtacattctcaggacccacccacccaccaaccagatctactgaattagaacctcgctctggtgaggtggggttgagggagtcccagcaatacacgtcccacatcttgttaagtcctccaggtgattctgatgcatgttaacatctgagaaccactgggttaagagatgaagaattaaaaaaattattcaagctcatatactacaagacagaatacagtaaatggcctaaaataggtacaaagtattgcatttcgtggctaacttgcaaattgtaactagtttaaaaaatgatttgttattgaatacacactatgtatgttatcttttgctaagttttatgaaaagcattttgttttgaataaaatttcttcccatctctagaatagagccgtgattatgaactaagtagggaagaaggaggaatatcagaatcaactaagggtctttatcagattacctgagtctccctctactctggccccaatcccctgttgaaaaccacagttctagatggtcacaatggagaatcttaaatattcagaatgttactttgatcagattatttttggataccagctaatccagtgatcatcattttgattctttattttacctaccctttagtctgttcactaacatttgattgctgctctgagtctttaatttaaaacaaacacatgaagtatcttgtagggcttatggaagaggtgaaatcagagtgaagtgacagtcaagttttccttctaactgtgacacacactagtataacgttgtacaggccacttaacatttctgatgaggcttaatttcattatctctaatattagttcaagatcccccgcttactttacaggatattgagaggactaaaggagataatatttgtgaggttatatagcacatattaggccctttaagattagcaatgatggtccttccatatttttctagagatgtccttctcctgaattcctgacctatcagtggatatccatgatgtagaaaatacttccaaaacatttttactctttgataccataattgtagggaaaatctatttaattatctataccaatacctatcatctatttatgtatctttattatctctcttatttatctttctatttctctatcaattatctatcagttaaatggaagcagacacttttatattgagaatgtatagctatcgggactctattcaattaacagaattaaattgatattgacaggcttaaagacaattcaaataactaaggaaatattgacaaaaaagaatgactaaggagagggaaaaatttgccttaccaaatattaaaacttctttcaaagctactataatctaaataccatggtattagcacactagtacacacatcagtggaacaaaatacagaattcaggcatagacccaagtttgcatggaaatataatatataatgaaagacatttcaattaactgcaattaactgtggtaagaatgttttatttaataaatggagctgacagaataaactatccatttggaaggagagcagagctatgtcttgcctcatatcagagatggattaaatacctaaattgtaatggattaaatatttaaatgtaaaacataaaagtaaaacttggactgtttgtttaactttgcggtaggagaggacttattaagaaagacattgattaaaaaggtgcgatacatatttgactgtttaaaaattaaaatttttcatggcaaatgtcaatataaacaaaattaaaagacaaatatgagtgggaaaaatatgttaccaatttgaaagaattagtctgtaatatagaaaaagttctcacaaatttgtaaagacaatgagcaaggatatcttttctaggtaatatacagaagaaaaaaattttaaatggtcaataaacatataaagatatgtttaacctttctagtaaagcaaattcaaataaaaacaataatgaaattgtgttcttcattcataaattgggaaaaaattaaaatattgatttttttcacatgccaggtaacatgtagggaaatgatcattgtcatgcatttttaaagggaaagtgaattgttttaaaacattgcaaattaatcagataatagtaaaataaaataatgccagtgctcatttgcataacactcacactttggagaatttatcctacaaaaatcagtttgcaatatatgaggatcaaaatgcaagagtgcctcttttggcatcatatataatggcaataacctggaaacaatctgagtgtcttttggtaagagaatggctgaatcaaatatgggacatccatcctatggattatgattaagctgtccaaagcaatgaaatagatcagcatctgctgacttgaaagaataaccattaaaacatatatactatattttatatatatatatatatatatatatatatatatatatatatatatatatatataatattttgtgtgtgtgtgtgtgttgctttaaagtcaggcaaagctactgagaaatgtgaggttatttcataattgtgaaaaaattaactgctggatatgtgtatagatgtatctgtgaatcgatgaataaggaagaaaaagtgagaggatacaaataaggaaatgaacatcacttatacatttacatggggacttgactggaagagagttgctggggatgatgaattttttgattagacatctttgatttgtttcacatgtcataaatatataataactctaacttaaaaatataataaagacaggactcaggttaggtgtaatcttctatgtatgtgcacagtacaggtctggaagggccatgccaaattgccaattttagaacctcttaggaggagagtggtattaggaaaagagggtaaaagagagtaagctttttcttgtacatatttctgtatttattaatgactgttattttacaatgagtacctattcaggtattgctcatgtgatttaaaaataaataattgttttcacccaagctttaaatagttgtttacacccaagcagtagagtaggacagttttttttctcccttcagtagacaacagttattggcacaaacattagcaagcataatggttgtaatttggttgaagaagataatcatgtattagcttaagtaaaatgcaatgccttgcaaagatctgtcattctatgaaagtattgacttagagtagtcccaactaggaaatacaaggcgtaatccacagattcttgtgcaattcagctgtattatctcttatagctcctataaaccttaacactaattaaggatctttaagaggtttttaactagagggatgggagaaagggtgtctttatccccacttaggcagaagaaatgttttaaagtggaaaatgagcaattgatggttgccttgccaagtataattaagaaaattcagcagcactgattgtaccaagttctggaagtaaaatctgccagaggctgagatttggcctttatgtaatactaatactgtaaactcaacatgtcaactcttttatctgattttaattcttggaataagctataatctctcacgtatagcataatgtattttatgcccatggcccaaagcaaaaggtctccttttgcttccctccctcctacattatctgggaacttggtgtcaactcctttacgctctgtacctccctttgcccttgagtcctgctgccacactgaaggcctgccttcttctcagctgttcactaacttcttttactgcacagtttgctggttgtgatttcttatttttttcaagaggattgagagacttagaaaagcttctaggacccagagaaggaagctgtagtggctaaacttcacagacatcatgactggcaagaagtatctggctcataggaagttcttgccttcagggatataggagttttcttgcaaatgtaaaccctgaatagtttgaaaaattatgtagccatatgaaacaagagcataagccatgtgtgatagggctacgtaggatcagctttcagaggagtagtttagatcagtgtgtgctgagatgtttgagagagaataaaaatcacacaggatttggtctgttgcactgctggagaaaattaggagatgatatttatgtataaattctcaaagatatatgttgacctgctacagcagtaatatatgctaggacatataatatcactttggatagataaatgtacatatatatatatatgtgagggcaggaatgaattgttcaatggtattggtgataggtttagggttaagaatgctaattaacttatttttaccatacactggatgcaactatctctttcttccatggcactacactcttgtttgatataatttatctttcccaaagatggtgatcattttctttgatattcagcccaatgcactgaaatattgtttgcccagagcctatgttttcttctaccttcctcactgcttacaagaacaaaaggtacactacaaatctaatttcatgcaattggcctatttatgagccacataaatgtggcacaaacacatttaccgagaactataattttaagaattaagtccctctgggggaagaagaagagaggtagaattatatgcatgaatggggctgaaagagctgttcaaagtttggtgatgagtgggcaaactcaggagagctgagtacccttggtaagttaaaaaagtaagtcagtattcaagagactaggaagaacatgaaagaagcccatgcaggagaataagcagtgagataaactgagttttggagacacagaaatgtccttggaacccaggaatacaaagcctggtgaagtggacggagattctagggatactttctgtgccccatccataccctttcagatattatcattgtcatataagtggctgacttccccctgccatcatgttcattacttggcctaagggctttctctaatcaatggagtccacctagacctagcataatgaagaaatagagaaaatacaagtattgaccttccctccccacccacctccccaactatagcatccttcaaccaaggatgaggtgtaaatgcctcaacttcctccttgggtgagataacactggatcctagcaatccgaattgcaattaatctgcagttatctacagtactaacacctagtaacacattcaacattgacttatcttcctttccccactttaccattgcctctctggtatggtctgggatcccctccccaaaaacctagctacataaatctagatttgttccaaatcttactttgggggaatccaaactaagatggggatatgtatacaaaaaggttagggaaggacttaaaaaataaaaccaaacaaaaaaaaaatgaaaaataaaagtttttatgtgatccaactaggacagttaagataaatgaatgaaaatattttttttttcctttaactaaaactgtttaaaaaagagtttaggaaacattgttatttaccgattttctggattagtgttttgtgaaggaaagggaaacatcatgggcacttttttaaagtaagcttctgcaaactgtaatgctttaaaccaaaccgcatgttaactggaataatgggaacccacgtcactaagagacccattgcctggttctctgtggtttcttaccacagtagttgtttttgaaaataggtggtctttttcaaagagcacttatgttatgtgttgaaataatgaaaaagcttctgaaacacaatatgcattttttaatctagtaataaagaaagtaatgtggctgaataatgcctggctagattagttttgacactgtatttgctttgtgttcaactttatctggcaatgcattattcactagtactatacacagtgctttattaagtcttaatcaaatgcattttatcataagtgtcaattcagtgctttgccattgtatttatatgtttttaaatactgagttctttgtaagtgaacgacaaatacttaggctggaaaataagattgtatttctggtgcttgggaatgaggtcattgtgtatgcacagagtggctttacattcacactaaagtcatttggaaacagattatattgccgtttcttttttctcctaataaaatgaaatgtaattttcttcaccaatgtgaaagctaagctggtttgaccaattgtggccatttaaataggtttgtagagcaaatagatataaattaaaacttttgctagtagatttttatttaatagattttggactaaattttcaaatgtgggttaacaataaaaatttatgcacaaactgacaagtgattacaggtacacacattttcaaatataattaataatatgtttaagtataataaaactataataaatttttataaagtattcattaaataattttattataattaaatattttcattataattaaaatttatatatttataacattttaaaataatttataattataacaaaatgttataaatacaagctggccttggaaagcttcttaggttttttttattttctaggaaggaaatgcttacaaaatatactattaagttaagatcttagacttactcttctgataatattggaaaacttcagtttaaaaagtattgtacaaatccaacttcaagtttcttgatatttcttttatcaaaacagcagctatagatttgtaaaagttctagtatttggagaaaaaatataaatattataaccctacaacattagtttggagaaatctgtttattccacaggtaaatgtatctgtaagactaacaaaattcataatttttgatttaaaaaatcagcacataaaaataattgcagggctttaaatgagcacagcattaagttgggctgctgtctctctccgaataagtgctaagtgaagcaggaatgttttaatggcatgaggccctacacaccaaaatggcattagcctctgagtaaatatcactagttggatagagttttattctacaaagtaaatacttaggaaattaaatattaattagtacttacatgtgcaatactaagaataaagtagaatcttctttaccctaaaacaatatcccaccatgccacataaatgacactgaagtgattatttgtaaaaacaaaagcgaaataaaattatgataatctccccaaattatctccccaccaaagattattgattttatttatttatgattttattttagaaaatcgtggtttgtataaaagggtcccaggtatatctggatgttttgataggagtttagggaatcctagaggcttccacgcagaatggattccatgaccatttttccatgaaaccatttgaaaccactaatgattggtgggccggggtccttttccattgtccttttgtgatatcttgcactttttcatttttattttttcttctttctcatttctttgctccaatgtttaaatattcctgccttgttagcgtgtttcattttcttggcctatgaactgctctactcataggtaaagcttggtccgttgtgaaaaggcctcagtaactttttaggtttgttctgatggattaataaatatgtttaagcttttgagattagtatttatttatttaaaaaagctacctcactaattttgaggaacactgaattaaattcaaagttttctttattatgaaaattctcagaacctttaatattcattctaatattcattctgatgacatatacttctaagagagggatataggatacaattatttctgcatcttatttgcccacagaaccccttttgtgtgggtagagggagcaatggaaaacttttatagtacttagtctgtgtcagacactgttctaagtgctttaccttatgaggagaaaaggaaaaaacttttttacagatgcagaaattgtgtcgagggaagctcagtgccttgccctctgtcaacagccaccaagggatagagccagcttatcacctgggcttctttaggattgtccattgaagggttggtcaaacatggttgtctggtccaatctttctgttgaccatttagttagtgagtatcgtatatgtcaaaatgaattcacattaattcttgatgcagacacagccataacaaataaatcacttcctttagactttaactttcagctgaagtgtcagttagatatatgttggctttgattcctcttatttgccttctatgtccaaataactttaatgaatacaaagctttatcagataataatactttgatgtacttatttgctcactttgcataatttgtaatatagaaaaaaaatcttcacatgctattttttcttacaaagtaataaaccagctgtatttatgaaccacctattatgagcatgcatttccagcagcagtctctcagtaaaagactcaatcaagttagaaaaaaatgtattagtagaggaataaggttttccttaaaattatttttatacttaaatatgtcaagcctgtagtctgtgtccaaatatttaaagttaagtattacccatttaaaaaacaaatttgactcttgtatacttaaaataaattcaaccacataactattttattttgaagtttttatttgtttgtttttggtttttttgttttgtttttcctttctattaagttaggacaagaaacaaaagcctcccatcaaaagataaggtgaaagcctcccatccacgtttcatgcttgttctccctgtgtattttaaaatctttttctttgtttcttaaaactaaaacaaaataaaaaacacaggaacattattgagatgctatttagtaatattaagaatgtccctgtgtgtaaggttattgatactggcatttgtgaaattaacatagggacatcaatgagagatctataacaggaaagattataggcctgggagggagagatctgggtcaagttttagcttcttccctgagtttgtgtgtgaccctgagcaagtcactaaggtctctgggtcacactttcttcaaagacctgtacagtgagaccatgggagtcaatcattgttatatcttttcactgtggtctcctcttctttttttttttttttttttttttttttttttagacagagtctcgctctgtcgtccaggctggagtgcagtgatgtgatctcggctcactgcaagctccgcctcccaggttcacgccattctcctgcctcagcctccccagtagctgggattacaggcgcccgccaccacacccggcaattttttgtatttttagtagagatggggtttcaccgtgttagctaggatggtctcaacctccagacctcgtgatccacccacttcggcctcccaaagtgctgggattacaggtgtgagccaccacgcccggcctgctgtggtctctaatgagccagtttaatgtttcttgaaccaacctttgctgtttaacacttgcttatcatgtttttaacagggatttctgacctctttgtagaagatttatagttttttgttttgttttgtgttttttgttttgttttgttttgttttttgagacagggtcttgctctgtagcccaggctggagtgcagtggcacaatctcggctcactgcaagctccgcctcccgggttcacgccattctcctgcctcagcctcccgagtagctgggactacaggcatctgccaccacgcctggctaattttttgtatttttagtagagatggggttttgccgtgttagccgggatggtctcgatctcctgacctcgtgatccacccaccttggcctcccgaagtgctgggattacaggcgtgagccaccgtgcccagccagaaaggttcttcagttctttatgtttgaataacaccatgttgtttgtgtgtgtgtgtgtgtgtgtgtgtgtgtgtctgcaagagaaagcaaaagagagattaaaatagatttagaaaacaatcagaattgtgagaatatagaagggattcactaaaagaatttctaatatcactaaaatcctcagctgatgtatcaatgagtctgtgattagctaacaaaagagtgtttttccccccaggtggacaatttggactttatgcaggtgtgcagtagtagaaccgtgaaggtagatacaattaaagttctgagaaatgaaaagacactaggccacgaataatggagcttgccagtagcagcagctagtagatccctttctccacggggccaaagagtttgatttgatttccagctctcaactcctactcaaggtgcaatcatcagtcccctgcagggtactctaggattctggagacattaagaagcacagaacgtggctgcatccctttttccgaatgggctttggtgcaagcagttcgtaagtggctagtaagaatttattgttcatgtatgttttttctcttgggagtctgtaattattttaaaatattagccataaatcccatgctaatatatatataaatatatataaatacgtatttatatatataaatatatataatatatgttttttgtttgttcctttttttgagacagagtcttgctcactctgtcgcccaggctggagtacagtggcgtgatcttggctcagtgcagcctccgcctgccaggttcaagcaattctcctgtctcagccttctgagtagctgagactatagatgtgcaccactgtgcccagctaatttttatatttttagtagaaacaagctttcaccatgttgaccaggctggtctggagctcctgacgtcaagtaatccgcctgcctcggcctcccaaagtgctgggattataggcgtgagccactatgctaatttttttttttttttttttttgagttggagtctcactctgttgcccaggctagagtgcagtggcgtgatcttggctcactgaaacctccatctcctgggttcaagcaattatcttacctcagcctcccaagtagagggaattacaggtgctcgccaccacgcccagttaatttttgcatttttagtaaagacagggtttcaccacattggccaggctcgtctcgaactcctgacctcaggtgatctgcccgcctcggcctcccaaagtgcttggattacaggcatgaaccactgtgcccggtgctaatttttaaaagtattaatttgcttttgcgagactcaattgtatgccaaaaattacctcaatatttgacttggagactgtagaccaaacttgcatcattatggaaaaacaatatgcaaaatttggccttggcattgcccaaagtgtggtattttgcattgtactatttgtttctgtatgtcatggagtatgtatagtaataggaaatgatgagtatctttgcacaaaatgtaatgcttttactaacatctgtcagctattttgtgagaatattgccaaaatataacatttatcttggtgtatagttcaattttgcttttgtgagtgtttcttctattttattgccactaatatagcataacagatgtctttcagatgtgaaaaatcaattatttttcaatatacctcagtagttattagggcagattaatgtaaagtaccgtaagagtaatgtccaaataaaatgtcataagtgaacaatacaattcaatggagaaataggattgagttgatcttggtacctttgtggaaaacagggagaaaaaaatgaacaagtacaacaaaaatatgcaaggccatgctttgttgaaagatcaagtagatgctttagtgatagtattttcagtggaatggtcagctgccatggaaagttagggcaaggccaaaactgtttatgcttcatttctatcgacaaacacgtagctggtttctaatgaagatcaataaaaggtaatcttgggaatgggtatttcagtatccagaagtctttgcaggagaatatgaattatgaaatttatgaaagcctgagtgttaccttttggatgctggtgtttggcaagttcataacaatctttatgttacttatcacaaatgttatttgttttctaaaattttgaatttcaaggcctcaacacacttgagagagagctgccaaataaacttaaacactgttctacagcagaaccagtatgcccctggcacctaggtttagaggggcctggatctggtttcatggcacgagatgcatgcagtcacacagagccccatgcttagaagggaccaatattaaatgcttgatttgatgctctgctcctaccattctgaaattattaatttttgaacaaagggtctcacattttcatttcatagcaggtctcacagattatgcagtgagtcctgagggaagccatgaaaggatagggctctgtgatgattccaacctttctcacctgaatttgggtggcggctctgtagctgctctcctcataacagtgttcctttatttctgtatcccttactctgcctacattttcattctgatatggaggacagaccctctgggatgctaagttctctgaaaggcctgaagtgtcctccatgcttgacttcaggcacacgtaatgcctttgttggacatttatgccatgactcaccttcttgcatagttattcactcctccagctctaacactatgcgaggcatcatgcttagtgccgtgaatagagtggtgaataagatttagtccttgctatcctaagattatactttagaaggatagacaaccaagccaatggtcaaataaaagaagttatgatggtggtagaacagggctcacaggaacatgaaggaggagcacctaaggtggtgatatctaaatagagatctaaggtctaactgcaggtagatgtttcccctttggggggaaatcagagagtgttctagagagggaacagcatgagccaaagctcagaagtgaaaagctgccatcttcaggataattttctccgtagaaaattgcactactagttacattcagagtaggtactagccagagattcattttagagacttacaagtttgccagcagtaagcctatgaattagttaatggttttggctgagaggccaccacagaatatcctgcctgtactttaaccagatttttaatcacaaagttcatgtaatacatgtctgaactggaacatggacatccatggacacattgaaaatttcagtttagtgcttagaagccccaaacattgttgactggaggaaaaaatgttatattagttaacaaaggtatatactgctatggaatgaatattcgtgtgtcctcagcattcatatattgaagccctaaccactaaagtggtggtatttcaagttggagcctttgggaggtaataggtttagctgaggttgtgaggatggggccccatgatgggattagtgcccttagaagaagtgcccttataagaagagtaaaacaagaaaaaaatctctctctccacacacctgcaacaaggagaggccatgtgagttcacagtgagaagctgactgtctataagtcaggaagacagtccttgccaagaaccaaatctgacagcaatttgatcttggatccctcagcctccaggactgtgagaaataaatgtctgttggttgagctacccagtttatggtgtttggttatagcagcctgagccgactgagacaataatcggtactgagaagtaggctgatgctgtaaacaaacacctaaaaatatggaagtgactttggaaggggtgatggacacaggcgggaaaagttttgagatccattctagaaaaagctgagcttgccttgaatgttaaagcctactgtggtgagaaattagaaagaagataggagaggtacagagaaaacttccttctttgcagaatacataaataatcactaacagaatgttgatagaaatatggatggtaaaggcaattctggtgaggtctcagatggaaatgagaaacatgttgttggaaactggaggagggatggtaggattgaaaaaaaaaattcaaaagaaaaagaaaaaaaaagaaatgggaggaaagtaacccttgttataaaattacaaagaacttggctgaattctgtttgtgctcttgtgttttgtgacaggtagaacttgcaagtgatgacatttggatatttatttatttttctttctctctttctttttttaaatagagacagggtctcgccatgttgcccaggttggtcttgaactcctggattcaagcaatcctcctgccttggcctcccaaaatgctgggatctgtagcagactatagatagttcccaactgatgatggttcacctgattttttttctttatgatagatttgttgaggtattaaatgcatttttgacttatgatatttttgacttatgatgaatttgttgaggcacaagcctgttgtaagttgaggagcacttaaaatacatatcagtatctaatagtgtcccaagagtttgaaggattcttttgtagggggacccaaaactttatcttggctacaaattatacaagaaactggactcccgtacaactgaagtccctgtacagttgagcacctcaaataggccaagtaccacagctggccaacacagaataccacataagcagaaagttatctctgtagctaaaattcttcatctaacaaatggctttccaagagttcatttgaaggagaagacagaagtaagtagttggctaggtttttttgtgcctttgtagttggataagcattagaagtattaaagcctaagcctttcaaagagttgatctgcctggaaccttctgcagatcagagctctgtgaaagcaaatgctgactcattagctgggatggtgtgaattccagaattattgctaacaaatctatttccacttaaaatataaaaaagaaagccatgaaatgagaactgactttcccttaggcctctaacagtgctgtttggttacatattttgagaggcagaaaatgagtgaagaaaaagagccaccaagaaagattctctgcaggtgaacaggaaaaaaagtaacttattaccttgcttggtccatagcaggtttttcatttccctttaaaatgtgagaatttgatgactaagatactgctattactgttttcactgtaaatgagttgatggaaagagcatgttgcctgatagtaatctttcatgtgtatgtacaggtacagtaagttgataaaaataactgcattaaaaaggtatttagaaagttctggcagagatagtaaaatggatatatccaattttttgtgctctatttttgtacctgatgtagtcttcatccatggagactgagccctttttgttttcttggaaataaggcattttatctattgaaatgattcaatttcctatcagtctagactgtgatcttacacagtttagtttagttcatctgcagatccttctatttttgatttatttgaatccatgaaagttaacatgccattgtagaatgccagactactttcctctcccttttacatgtgatagactataaaaattatagcttaggttgattattgcttactgggcagtccagcacagataacccaggtgttggttcaaaaaaaaaaaaaagcattctggagtaattgacagcactaaacattttgcttttcagtgaaatttaagagttggtggttggaagctattcatatacacagcatcagcaggaaatccccaactctggatttttaagcatgaggctatttttattttttcattcctatttaagactatttcagaatacgaattatagactcctggttctcactttggagtaatttataatcttagaagattataaatatatagattttctaaaaggtctatccaacattgtattatttaaagtattgattatttaatatgaggtttattagtctttggttttttccctgctaaaattatttcatttatttattcgctttctcccttaagcaacttgtgtttattaactgctgaatctactagaatgtcttcctataagtattaagagtcctagtaaaaataacaacaaaattcataaacatgcacaaaatgctcaaatcataaggtaaagcacaaacaaaataagttaagccacagaaaggcagaagatatttgcaatgcatggacaggtgttaatattcagaatacataaagaacaaactaagaattaattaaaaaattaaacaatagataaaattgataaatacagacaggcaaataaaaaatcctaacagctcacaaataaaggaaaaacgttcgatctcattaatgagcagggaaatgtaaattaaaagcaaaataagttatttcacataaaaaatctaactatatgaaatattgccaagcatgtgaataaagagggactctcatgtccctggagaaagtttaactagtagaaatcttttagagtataatttaataatgtccagtaaatttgaagacacacaaatcctttaagagagcagttccactcccacatatatactctggtatatatagtagtagtgtttcactatcataatcttgcaactttgggacctgacatattagttagtcatgaaatcaatttttaattgagtagaatagaaaagagtgggaagtatcagagtgcatcatatgtagtaagaataataattgttttgtaaaacaatattttccaaaaatgtatgtgtatgtgtgtgcatgtgaacatgtacatttattttaaaatgtattgatttctgagaatcatagtcaaatatactagaaaagcactattgtagataaactcccacgtgtgaaaattgagatattttgtttataatagcaaaaaattagaaacaacccaaatgtggcaggagaaaggatgagaaaggcatgatatccccatataatagacagctgtacacagtgaaaatagatgatctggagtcccatgtattcatagaaatgcatatcaaaagcataattgtgagtttgcaaaaaaaagcaagttgaccaaactatttacattatgatgcctttataaaatgtttaaaacatacagtgatatgtcttatttagacataaatatatgtttaaatttattaaaatatgtacttatacatgggaatcataagcacaaaattcagcattgtgaaggaattgtgaaaagggattgtgaaggaatacacagatctcaatttatgttctgtttcaggaaaaaaacaaacaaaacagaggaattattttctcacatagcaagaagtctagaggcttagccaaattatcaaagacccaagtttcttccttctttccattctaccagtctcagtaggttttcttcatagtcacacggtggctactgaggttccaggtattacatgtagacttgccaagtccagtagtagaaaaagggccattttttttcatgtgtgggttttttgaaaaaagtgagcttttcctagacatccccagtaggttgaccagatgtgcctaatatgcttgttcttatatcagacactgacaagcacaatgggaccaacatggttgatgtatccaagtcacagggaaggaggtgaggacactggaacataattaaagctctaccagtgagaagaagaaaattctgttggaccattagtattggctgtaagtacctctatctgccttagggatacagaggtgaacagcacaagctcctgagtgagttctagtggagttaaaattctaatgaagaagactgataatcaaggacagttgaataagatgattttacatagagataaatccatgaagaagagaaaacaccaggatttatgagacagcaattggagagtgacctggaagccctctctgatcagacgacatttgagctgagaccagaattgcatgaagaaagcagccgtgagcagaactgaataaagggaatccaggaagagcaaatgtgctagtgcaggaatgaggttgttgtgtcggaagtaaaaaggaagtttggtatacctggggcaaagggagagaaatagagaatgggttacaatcaagactgtgaagcaatctgatttacagttttaaaagatggctatcacacaagtgatggtgatggctttttctagggttgggacagtggagataggggagaaatggacctactcatgttgaaatagtgaagagaaagtcaagtgttaaagaaggcaatgtaaagaatcaaagatgagcccagagtagcagatgtgacaaggtttgatttcaataaagtggctcttgggacggaactgaaagactaacctagacagggacgccactgtcctgtgagtagactcttccagaaagaaatagtatgatagtaggataagttctttgcatttccagagttcagcaaggcattcatttatgccttggtgaatatccacagcaagcagagtcctctttgctcaatgttcagaatccaacatatcaggtcctgttttcaggacttccagccgtgaggtagaaagtgctttaacgtatacttggttagcatgaactgctataaacccataaacaaattatggacagaaacattgaagactgcaaaaagatggaatggaaagaagattgccatcaagggcatacaaaatgactgtgtttgaataagtgcgtttgatacttcagcaggtaatttggacagcctttgtgcttgtctgacttcactggaatagtctacatacctgcggatctcgttgttgatacgcccatattgcttccagcgggtgctttacttacctgcaggactgggctttttcttttcctgctattacgctctaatctcctgtagttgcagcctccatcttgaatatgggatttagatcattaactttatatgccatatttaaaaagcaatttcaaccaatagatattagctattaaaataacttcttggttagtaaataggcccatttaaaactgcattttgatttctacatctgaaaatgaaagaccatagtattgttttattttatttttaaaagtccagaaaaaaggtgactatactattcttttccttcttaatccataaatgtgcaccaatataacatttattgatctgcatgcagcgtattggtaaaagatgaattgtccaagtaaactgaagaagacgcacaacatataagtattatataatataggtttcttttagttgcaagtgacaggaaacacaatttaaactaaaaaggaaatttgttcatgtggaactggaaggcctaggtgcagctggatgcagggactcaaatgatgttttttttctctccaactcagcttctcttccttgtcttggctctatttgtaaatggttgtccctttatggtgacaagacagctgaagcaattctagccttatgatctctcaggttcaactcctattttcaatattctggacaaaatctccttgcctatcattgcctctggttgcaccgttcctgaaataacctctgtgaaaaggggaataaagtgctctgattgggtcaaattcctacaacctcttgaagagggtattgaattcattatatccaaatatggggcctaacagtggagaaagggtgctttcctagtagggtattggggtgctgataccaaaataaatgagagtgaaagctgaggagtcagggaacatatgtgccctctaacagtgttagaggcagaaatgttgccatgtttggtttctaataatttgtcgaggaaaaattcttgtcctctaagatgataaatcattcagggagcttctcagtagtttgcttctgaactcccggcactagaggcaggcctggacttagagacagcagaaaggggttgcctaccccatgccacgtgcttgacatagactatctcattgactactcacaaatattttattagtagtcctatcttttaaatgaaaaacagcctcaggcaggctaaggaacatgtctaagttcatgcgacgacaattgaacagcgtggtgcctataggtaataatggggttctgtacatttcagtatcactatgagagtacatttctaatgttctcatcacaaaaaagttgtgtgatgcataacacataacatgaggtgatgaatgtgttacttagcttaatttaatcttttcatattgcattaaaattataacactgctttgcaccccataaatacatacaactataatttgtcaatatataatatgctttttaaagtgccatagtctgtatttgaactcaggtctttctgagggtaaagcccataatctcacctttatagcatgccactgtcttgccaaacacaactcttaactcacttactgggtcaagctttaatttatttatatgtggtatttcaattttgtgccgtaagcctagtggcatcaattttaagatgtaggctttacacatattgtaatgtaggtgttaacattctttaagagtcttaacaagaaaattattagtttctcggtaagctttcattccccaaatatgtagtgaatacctattctgtataagaggacaagagcaatatgaaatgattggctatgccattctgggatggttttatcataatactaagaaaaaaatactctcctggcattccactacagtccaatccaggcttgaaccctcagaagaaattatgaattgtggaacacagcaaactacctcctctgtgcagggctaaccacttctcccttaagatcctctcctagcgtggaacagcgtggtatctgcagccatcaccccagatagtggttcttgagtttgcattgttgatatgtcttctggatagtgctgccctacagagaacccatcttgttttgttcccattcacatttccaggacagagcactgcccagatacatgttaggtgcacaaatatatctcttgaattacattaagtgccctattacagtgatctgccatagatatttggtatagcaacagcattgaacatttaaccactggtaaaattaatatgaaacacattgtattttagaaagtatatatgcattaaatatcacaccacacatacaaacacatattatgtatcccctaatgtatgatttatatgtatataatatttgacatcacagatacacacaatcctttatatacctttatgtatatagattgttctgtaattcataacatttaaggcttttgggattttgtttttaaacaagtattacagcttaaaacatttcctggggtttgaattctcattccagcattttatggaaccataaaatatgaccagtttacctcttctaccttttctaaacttctccctgctttatgacactgaaaacaaacacacatatgaaatgaattatgtttaaatttctgggcaacattttcttagcaagcaacaaaaatatataattctatttttcagaaagtaatttagttctaggaagctgagctgacacataaccaattaatagttgaaaaaaaaaactaccatttgttgtcaagctcttttaattttgctaaaactgggtttgcaaaaggatattgagaaaacattgactgtaaatccttaattcccattttcaaaaccttgtgataatgaataattctttatgatttcttcaacaagtaacatactcatcgtctttatgcttcctatcttttttttttttcaatccagaagtgtgatcatgacaaaagtctatgccaggaatatgtcgatctgacttaatgctttctgagactgttgtttctctccctgatttttgatacttttacagagataatagctacttcctaatctgttttttacttccttgtttccattttatgtttcaatgaaacagcagaatacattacttcatcttaattttcctacttacctgtgtttgttgttgttgttttaatgtgatagaatgtgggatttttactgtttggaatagcaagagagctacagatgaacaaatggaggctaatagataataaaagacttttccaaagacatggactaattggtgcccaggttcagcttgcaggatttcagaaacagcggtgagttaagtcagcaagtcctatggactcttgagagcaagctctttttttttttttttacatttttttattatttttttaaaaatcaatcacttactagaaggcagtagaggctattggttaagagcacagactttggactcaaacaagctatccttggaatttaattctgctgcctcccttcttagctatgtgatactggggtaagtcacttaacttcccagtgtgcttcctgtttccatctgataagttatggtgacattactgagctcttagagtttaggtaaagattgtatgtagtacagcctggctcatactaagcaatgaataaagggtggctaatgctggtttttattactatattttcttcttatactttgacaagcattaatagagtaagtaagcatggctatatggaactcaataacttggaaagcatgatgatggatgacactttttatgcttctattttagccaaaacaactgtttacatatcctgtggattatttaagcacatgccacattgctacaactcatggagtggccttattctatacctaatgatagctggcctggccatgcctcatttcactgccgatttccttctagatactcctagaatccacttattctccatttttactgccactaatctagttcagagtttttatcatttttcactggttctactacaccatcttattgaatatctttttgtttagcaaggatattaaatctattacctttattttgaaccagagaatttttttgaagcacaattcaaatgatgtaatgctcttggtaaatctctttcacagaaccccaaactccctcagagaagagtgatagtctcaccatgatgggtctttttctgtccttctctgtgtctgtaagatagggcagaggaggaaagtgagggtcaggaaagttagataattagcctgaaattacacaactagtgagtgacagaacaaggaccccatgccagatgtgtctgttccacagtccagatctgcacagttattaccacagttattacatagatcaaggatcagccaactaaagcctgtgggccaaaggaatcccactccctgttttgttaataaaggttgattgacattcagccacacccattcactttcatattgcctatggcttcttttatgcttcaacagagttgagtggtcatgacagagaccatctggttcacagtcaaaaatatttactatatggtcctttatagaaaaaacattgctggcacttgacatagaacatacttggattcaaaagagtaaaagtgatagattcctggatgttcaccgtgaggaactctgtgatcagagtcgtctgaaactttaatgaggtggatgaaatgtcgctttaacaaccagaagaattactcaagtagtaagacctaaatatactaagagattttaattacctagatatctattgggaaaacatcttgacaggatgcagattgtccaatcagttatttttaaagggttgctgacagtgcttaatgtggaagaggtaggaagctaaagagatggcagggctcctccacctgactgtgccccagaaagaaaagacgattgcaaacaaaatgggatatgtcatttgtagaggcaggtactgtgaaataaatggcagaattcacagtgctaaggtaggggattagaaaaagcagctgaacaaataaaacgaatcttaagaaagtaaccttgagtacaaaatgttctgagcccaaaacaactgcatatatgcataaatacgtgcacaatcacctgttgaatgcgctcaggaactttgcagttgacctacttggaggggaaaaatcggcatactcaatcattcagaaaagtcaagcatttgtttaaatcaaatatgccaaaattccaaaaagaatttagcatgaataatatttttcacaaaggcgaaaagccttctcgttctctgggagccgttttgtatttgggagattggagagcaaaaaggcaagtgccgtttgtgataataggttctcggagggcagaaataaattatgttcagaatgtacaaggaacatgatgatggttaagcccttagactgtatgtagttgtcctgctagagaactcaaagtatggaaaattacaaaataccattctaagtggtctagtgagtgagtgcagcttccaagtgctatcatttaatttactttcagggagtaatgtgtgtgccctgggtttgtcttgtcaatgctcctgtgcagtggtgcccaaggagaggccagaaagaacttgaggagatctgttggttcctttggatgaagaaatgaaatagaccattttttccttggtttcctcaatcatgtttaattaacttttgtcaagggcctgccgggtgccctgcactggaattggggacatcaagatgagtaaagatctatgtgcgggagaaaaggcaaaatcaaattattgtcatacaatttgatgaattaattctaatactagaggcaatacttgggccagaggctgggtgaagggagagagaagatgaaagacagaagcaggaaggagaggtttagaaatagggcaaagtcacagcatctgtgtgaccagactcctgtcctcaaagtaagtgtttgtgaatactgggctatttatatttccatatattttgtggaaaaccaaaaagtatgatggcagtcttgtggcatgttcttgcccttcacgcagtacatgcaacagaaggaaatatgaggacataacatgtggccagattctccttctgcgagggactatgcgtgtctctgaacatggagaggagaggcctccatcaaccctcctgtgcactttccagcagcttgtagttgggtttgagtgacaaatgcacctccctaggtctgagagccagttacattgctgccaccaatactcaaactccattggctttcttagtagcatataccatttttctaagaaaacaaccaccatttattgattacttactatgtgctggacactgtgctcagcacctgcatccaatacttatttaatcctcacaattattctgtgaagtaagagtcattttacccatttttgagaatatgaagtcacagagccacagagtattgaaataactttctcaaagtcacttggcaatgtatctgactcacacatataatcaatcttaagtctgctgtatttcagatattttttacttccgtagtgttttttgtttgtttgtttttgtttgtttttttttttttgcgacggagtctcactctgttgcccaggttggggtgcagtggcgcaatctcggctcactgcaaactctgccacctgggttcaagtgattctcctgccttagcctcccaagcagctgggattacaggtgcctgccactgcacctggctaattgttgtagttttagtagagatgggtttcaccatgttggccaggctggtcttgatctcttgacctcatgatccacccaccttggcctcccaaagtgctgggattacaggggtgagccactgcgcctggccctctagtgtgttttctattattatttttaaatatagtacttaaaacttatttaaaagttctatggttgaggcaaatccataataactactgcagagtttgaatgctggaatattagaatattagaatattctgggtctagaatatgtttggtcctttccaggcctgaagggaagacagtttccattttcattatgcactttggaagatgccagagaaattaggtgggcatcacatacaagtatcactgttttcactgtagcttttgttttagagaggacaacttgtaaaactttcagtgaacttaggcaaggagcaagccaaccctggcagggcaggccctctctgcaggaaacccctaactgggaggtgcccagctctggcaagtctttgaactgtcagatgccaggtgctgttagggcacctccactcagcccctgcctaatgcaagctcttgaaaactcagagatagcttcctccttcattagcatttgtgctctgtactgaacacaggtcaaagggagatgttaaaatacaccccagagttcacagggccaggatttgaccctattgaaacctgataaataccacccctctattgttctctgggtggaatctggcaccagggtgagaactgggatatgactgaaagattttgttttattgctatcttagtctattcattgttgcagagaccctgacaggatttctcttatctgtgatttgacaaaatatatcttcttaatcattgcacggttgatgttaagagggttcagaagtataaaaggaaggaacttggcttagaaataaagcattgagggactttaaaattaggccactggatagacctattagcctttaaagaggctgagaaattttgatgaaggctgggcctctgaaacgggcaactcttctaattttaataatgcatttgaaattattcttatcacttagtgaattcttatttgattgccttgaggcctttttcaagtttcagattttaattcctcactactccattaggaaggttggtcattttatgttcattttactgttaagaaagaaaaaaatgcagtgagatcgtacaactaagaaatggtaaaacccagactggaactcagtaaatttgatatcaagccctgtgatcttaaaaaaagttactgtggttaaacacgtataacaaaaatttcccattttattcaattttaagtgtgcagtttgtggcatcaagtacattcacacggtagtgcggccaccaccatctgtctctagaacttctgtcttcctaaactaaaattctgtactcattaagcagtaactcttccttaatctctccacctatcccctggatactaccattctgctttctgtctctatgaatttaactgttctaggtatgtcatataagtggaatcattatatctgtccatgttgtagcatgtgtcagaatttccttttttttccaggctggataatatttcactgtgtgtgtgtgtgtgtgtgtgtgtgtgtgtttgtgtgtgtatttatatcacattttgcttatccattcatctatcaatgaacacttcagttgttccttctggctattgccagtgtttctatgaacatgagtgtacagatatctgtttgagctcctgctttcaattcttttgagtatatgcccagaagtggaattgatgaatcatataataactctatttttaactttttgaggaaatgcaatacattttttttcccaaagcagcaacaccttttacatttctgtgctttttttgtccatatctaagttgccttggaatgatgaactagctgagaaaatagcactgctggtgtaacaatgccatatgtagctgatctgatgcttttattgtgtattggtttaacacacatgtatgtcatatggttcatgagcatttacaaatgatatgcttcctctgctgcttaaaagtcatattgaataaaggggcatgtttaactttttcagaacacttgaaatatgatgaaatgtcagtgtttttgaggcgtcaaaacaaatgacataatgtcagtatttagaaactcaactatgtgtaaaacaagttgcttttgttttccaccaggcacaccacagcatgtttaatgatggatattattgttgtgaattgtatctaatctgctccagactcagaaagcctccaacacaaagtgtcatttgttcatcactttgtgggttttgcctgtttcttacatacaaaggttcactaggagttgaacaaaaaacttaaagataggtatggggttgtgtagtcttgaagtgtgtgtgtgtgtgtgtgtgtgtgtgtgtgtgtgtgctggaggggtttttcagctgttctttttatttttatggaacaggatatctccagatgatttcatttgaagggggaaagctccaaattattccaaatgggatgattccatttggagatctttcctcttgcttcaggactgctagtataattcccagagaagcataagaaggccacagctatgcctaaaggagttaaagctggtgcctaatctttgaagtctggcaggcctacctccaccccaaagtcagtggtcaccgctatccaaggattcatcaaattgtgactcacagggtggagaaggctggctttgagagaggtgaatgtgcatcttcctcaggaccacagttgtggggttagctgtcctgcatcagacctctgtctcattttcatgatgaacatcaatgtggtagacacaccgtaacctgacccagaatgagcagggctcttttgtagtcccctcctcttgagtttgggcaaaacccatgacttgctgctagttaatagaatatggcaaaggtcatgggatagtcactcttgattaggttatgttgcataagacttcatcttagccagctggaagagagattcttttgttggtcttgaagctgccatattatgagagggggatgccaaggaatgggccacctaaggaggtgagagtagttcttggttggtagccaacaagaaagtgaggacatcagtcagtcttaacaaccacaaaggactcttattgacagtcatgtgagcctggaagagaactccaagctccaaaaaggaacacagcttggctgacactttgattgaatccaattaagccatgcccagacttctgatccatggaaaccaagacatacaaaatgtatttttctaagtttctatatttgtggtcatttgtcacctagcaatagaaaactaatacaatcaagcacacctttaatgttaccttctctttccctgcttgttcctttcatttttattttgcctttttacctgttttcttgttctgtggattctgtctgatgagaccatcaatcaagatgccctggtttcccccagtgaggagaaaaacacatgacccaaactaggccaatcagatctttctctccaggaatccaaatcttaagaagaatgaaaaagaggctgtatgtgtttggagctgactgatcccagcagtgttgccctgaaacactcttgctaccaattctcctagagagttcctgccacctatctttgccaattcctattccctaacttccttttttattctgtgagctccactagattcttcaaatgaattcctcttctgctgaaattaatcagaatctattctatttgttgcagtcaaaaaattcctattgatacatagagccctgttgtaatcacctcatacatttttttgtctctctgggttgtattatggtcttttttctttctttttaaacttcttttgacggggtctcactttgttgcccaggctggagtgcagtggcactatcttggctcactgctgtctccctcccttgggttcaagtgattctcctgcctcagactcccaagtagctgggacaacaggtgtgcaccaccatgcccagctaattttttttgtagagatggggtcttcctatgttgccaaggctagtcttgaactcctggcctcaagtgatcctcccaactcagcctcccaaaacactgtgattacaggtattagccactatatccagcctattgtcttctttctaaaagatttttctcatcactaagtgttacccaaacatgcagggtttcaaggtaattcttgataggattttagaatcagaatcctgattctaaagataggattttagaatcagaagtctggaaatgatacatgaaaattgtcaagttaccttcttaattttaatttaaagaccacagtttttggttaagtctcataaaaacatctttagacttaggataaatcagaagatgtatactgtatgtagcgatgaaaacataattttttaaactaggaaaataaagagtacagaatggctcccagcagtaaattttctagtttcttaggaggaaaagaaagatcagttggtggtgcaggttttcttgatcttcaaagtgagtgtgtaaagacttctatttcctggctggaaacatcaaagacaaaggaggaatcttaaaagaaataaaaactctagaataaaattaaaaataagaattgaaaagtagagagaagtacaattccactgttagaattaaaattttttgactcacttcttgatatacagaccttctttccttcctggtaaaagcctatttgaaaagtgttacgaagtttctccctcttgtatcttgtcagaatatacaaaaattcagattacagttgacccttgaataacacctgttcacactgtgtgtgtccacttatatgtggactttctcctgcctgttcacctctgagatggtaagaccaatccctcctgttcctcctcctcagcctactcaacatgaagaccatgaggatgaagacctttttgctcactcacttccactttagaaattgtaattaggccagtcacggtggcccacgcctgtaatcccagcactttaggaggccaaggcaggtggatcacttgaggttgggagttcgacaccagcctgatcaacatagagaaaccccatctctactaaaaatacaaaaaaattagctgggcctggtgacgtgtgcctgtaatcccagctacttgggaggctgagacaggagaatcgcttaaacctgggaggcggaggttgcagtgagccaagatcgtgccaatgcactccagactgggcaataagaacggaaattctgtctcaaaaaggtagtaaatgtattttctattccttatgattttcttaataacatcttcttttatctagctgactttattataagaatacagtatataatacataactgtatacagtatgcattaattgaaagtttatgttatccataaagcttctggtcaacagcaggctattagtagctaagtttttgggaagtcaaaacttatacttggattgctgactgtacagggtatcggtgtccttaacccctgtgttgttcaagggtcaattgtatattctttttaaagaagttaaaataagactgttaatacttttattgcactgttcatgacagcatgtcaagtatgataaagcattttttttcttagtttaatttattgaattgtaattaaggtatttttcactgtagtcctaagaatgaccatgctaaaactgtcttgacaagtcctttgctaatgccttaataaacaacattcaacactgttaaagttgggaacaagtttgaggtaaaatttgtgtccatgagagtggacgaatcatggtaaagaaaataatgtggagaaaatatataagaaaaaagtcaacaactgaagagtagatttttgaaagttcagtgggttttgctttgttctagggccaattttagcttccttattaagcattattttgtcaattttcctattagaaaaacataattgagattttgttttgggatttctagaagaaatgagttggtgtttttatggtgtttccttcgaaacccaaaactgaacatggaactgaacatggtcctttacaagatttccctctcttttacatacattctagagtagataaaaatgaaatgaatcttagagctcaggaaatatcgcgatttcaaatggacaatccttgacttttttgtcacattgtttcttcgtggaaaaactcattctctctcccattccaattttccagtagagatttgattgagtcttgagcatgcgttgaccatcttcatatcatgtattatgactgaagtattaaggatctaaaaggtacagagatagattgcacttagcttaggattgttacatgcactctcattcaatgtttggacaacttgatggaataccctggaaagtttgccattatctttccctgtgcattggctccatagacttaatgcacctatcttatggatggaatgacgatactttgtgcttggagacctgaaattgttgctttgtagccctttgctcttatttagccccagaaccagaacttctagaatgaaactctagtaaagaatcagtcaatgttttttgtttgtttgttttttccccactccaaagagaatgtgttttacttttttgtggctctgaaagatatgccaactcaaactcctaggtctctcaggattgatgggtacccttttatgttgcatcaaaattgaagatatactagtgtaaggtctagctacctttctagaattaccatccaaaaaagctgttaatttaaaccctacttcttaagccaagcagtgcatctaaagtgagctttttttaattttaaatttttttttttttttgagccagggtctcgccctgttaccaggctggagtgcagtgttgtgatctcggctcactgcaacctccacctaccaggttgaagcgactctccttcctcagcctcctgagtagctaggactacaggcatgcgccaccacacccagctaatttttgtatttttagtagagacggggtttcaccatgttggtcaggatggtcttgatctcttgacctcatgatccgcccgccttggcctcccaaagtggtgggagtgcaagcatgagccaccatgcccagcctaaagtgagctcttgactgaacctattactgattggactttcttggaagcactgaatcctgactgtatccagcatttcctaaaccaatgagaattctccttaaagcatttgtcctcagtttcaaaggaaatcagttctgagatactctttttctcttataggatactattatggtcttcagacattcactgtatgaagggtttaggttgtagaacaaatcaaatatacttgaaatgcattttgctttctgagggactatggtgtgcttttcttcaagacttgacaaaatttacttttttaaaaattaacttcctcctgtgtttacaccagcttttatactttgttggaaatacagccacttccagagagaatttggcattgcacttatcaaacaggataacttaattattggcacagattattttttatttgagcagtgtgcactgccatgagagagcatccacattttcattctgggcatggaaacaatgtaaaacaggtttggcatgaagcatgtatgtatgtgtgtatgtgcatcaaactctaccctatgtgaaaggctgccaatttttaaaatccttgggaactagagtaattaatctcttctgttgcctataacaatcggaagacctgggaatatttcatccatttgtaccatttggaaaccattattggcccatagagattgatacttcaagaggagtggtctcttgccagcttacttcgtaagttttgcctatctagtttcaatatttcccacccttctctactttatgttgtatcttttccttgggttaaaggtttttgtcagcttcttctgctttgtgcttatatttttcttcctatttacaaaagctcatcttccctcgccaatgaaacaagttatggagtgtgtacatctacacctagctggctctgctgttgtacagaggtgcaaacagggctgtgattttagacatagtagtgtcaatagacatagtagtgaggatgacacagcatcccacgggacaagattgcagtgatgttatcctcacttcaattcaactgcatgactaacaagaacattacagagaaaaaaagaaagaaaaaagattaaagattaatgcttccagtcagtcatgtcccatggggagacatcttagaacccattctacccattgtgaccacacatatatagcagtttttgagaaggaatcaaaactcaagaataaatgacatgttctgatatgttaggcaaatgtcagacaatgacacagagccctaagttaatatttgggaaactaaacttttgaagtacttttatacaaagcatatgctaatatatgcagactaatgcaaattatccataaccttgaggtttctcacaggttgacagtggggtccttggtgtcacagaaggtgaccattgctggtatagattctgacaattacttggattatatcatgacttcatatttaatgtgaattttatctacttagtctgagcagttgctcatttgccaacagttttgcttgtgtatataagtaaacaaacatatttatcacccctaggatcagtaaacgctaataaagttgctgctgcttgcactttagatttgttttaatgacagacacatcctaaattaactaagaatggtttgcttgctttagagcttagcaagaaaggtaaagatattagcatgattcgttgtcaccaatcaggttgaaatgatggtacatgttattctttgtcatcagcatactctatcttagactgtatttttaagggggagtgtgtgtgtgtgtgtgtgcattcatgcatgtgtgcatgtctgtgcatatgcgcacacattttctttcatgggagttctgatgtcactttttgacaaaattcattgtgaactttatctcagactgcagtgaggaaaaccaacagactgaacaaatgaacaaatacacagactcttctcccctactttatgtaatattttatatgcgttttatttaaagccagcactctacatgcagccatcatgaattatcttgtgtgatgtgcaatatttgttaaggtgtgctttgcaaatgctctcttattcaactagttccctgaatgggctgaaacatggtcatttttgttctatacacagacagtatattaaaataaggattaaaaccatgtttaatcaattgttagacttttatcccttcatgttactgttccatctttctttctgccctttgctgatcatctaaaaataaatttgtattctctgaccaatgaactcactccattcatttattaactcttttacagtcttgtttctttctgaagtggtagaaacacttaatagcctactctagtgaactttcttcagaccatgtcttctttaacacctgtcacactcaacaatgttgactaccctctcttaggtggtctttgctgcgtcgtttgctgtcaaccattaacaccatacctgtatccagaagcgctgtcggaaagccaggtctgctgatattgattcttttggtctttttctgtctccactttggcctctcttttccatttctccattgcctgcatgttttcttctttttctgtttgtcaattccatttgatacagctattctatgaagaaaataaaagatattgtttaaaactaaaaccagttatatctacttctatcttttggaaaagatataatgcgtgaagtacaggataggtagtgcttacaatttatttttgttttaagaaaatgcccaggctgggctcagtggctcacgcctgtaatcccagcactttgggaagccaaggcaggtggatcatctgaggtcaggaattcgagaccagcctggccaacacggtgaaaccctgtcgctacaaaaaaatacaaaagtgagctgggcatggtgatggatacctgtaatcccagctatttgggaggctgagagaggagaatcgcttgaacccaggaggcagaggttgcagtgagccgagatcgagccattgcactccagcctaggcaacaagagtgaaactctgcctcaaaaaaaaaaaaaaaaagaaaaaagaaagaaaatgccctaaggagacgggtaggtcagctcagctgaacaagtgtagtcccctggagtctactctatgtctaggctaagttttcttaggtgtttcgcatctattatctttttaaatccttaccacagcctgtttgttatttatcttcattttaaacataaaattactttattttttcattccattgagaaagtcttctaggtgaatttgaaagccaggaggagttgaacatgtttggcattcctcaaaagagaaaagaaatgagggttcagaatggtgaaatttctgaaactaggatgatgacttcaaaagatgatttatgatacttaggttaggatgttgctacatcaggttaaatgctgtcattggtttttgttttccttacaaagaagaaataaatttgtgggtgggggtagggagttactcaaacatacctaatttctaatactctaagctacatatttaaatacactattatttgtatttctcagtttcccattgtttttaatgtgcttttcttaacacattaatgatagcttaaaattaatattttcttcatgctaaaacaaacaaaatgatgagagaaaatttaggtatccttgtaagctagttctcctcttttctttcaatgtaataagcttctttgtgaccctggcattaaaatgttttgaaatggttattggttcacggacattaggctctgtaataccattttccctatcatctggatgtattgctatttgtttgaaggcacattccaccattattggtgccctcactagcagtgagggatgagcctgagtgaacattgggaataaagccagttgtttcctctgctgcattacaaggaaagttattcaggaacatgcccactgtggcaaatttaccaagtggaatatttgttgccttgacattttggactatctactggcatgaaaagtcaacagagaggtatttctacacttgcttaggaattatttgattaaatagcattggaggatagaaataactgttttgttttattttttacttaaggtgtaatcctcttagtcaaccgaagcttacagtggcagtggtattcattattttactcagatttttattctttttcattaatgtagagctttgtacccaaatgcattctatacatgtctctcattacttctctggcagcaagatagcacttcactccacccccaaactaaacagaatttaatgatgggcactccttgcctcatgagggggaaaaacacagtttcctggtcgtggtctctgaactgcaaagacacacttgaggtttatccactgagtaaataactagggtgaaaaagtctttgcctctgcagcatgaactaatatgacccagccaaattatgacccacctgttgatactcttaacaagtgtgagtaggtaatatcatgtttatggtgagtccatgtctctgagtaatttagggctgtgctgctcaatagggtagcccaagccatatggttctgtaagtttacatttaaattgatgaaaaatttagtttttcagtagcgataactacttttttagtgctcagtagccacatatgacccagtttagaccaaagagacttgaaatgttttctggggctcatagttgaagagattttcctttcctgctagacatggacaacaagctgcagctcttggaagctgtaggctgccatcttggggacatggaaagctgccttaggaagaaggaaacactaagggtagcaaagagaccagaaggaagaaattttgtttttggtgatagcatagagctgccacatcaacacttgcccaagacctgttctatttctagacctattatgttcaatactgtggccactagcctcctgtggaaactgagcaagtaaaattcggctagttcaaagtgagatgcattgtaagtgcacaatacacattggattttgaagacttagtatataataataatgtagattgtctcattaatccttttttgtattgattgcatgtttaaaggttaatattttggatatattatgataagtaaagtatgtgaaattcattgcacttattttttaagtatggctactaaaaaaattgaaatcacgtgtgtggctcacattatatttctattggacagtgtgacttcagacatttcagttaccttaacaataaattcctttcattgctcaagtcagtttgaatcaaattttctgctgcttgcaacataaagatttctaatcaatgcttggcataacatttctatttaaactttatttctgcccatttatgcttgcaaccatgacacacatacaaatgtatatgtgtgtgcactggcactcacacatgcgataaaaagtgctttcctgtgttcctaaatatccatctgagatgctagctcattacataaaactttctgactctcagcttttcacatctgaaacgtaaaaaaaagatttgtaacttagatatttccatgactatattcattctactgattattttctgtgtttgattcacttttatttatacactgaattgtcattaaattgtcttcttatttcagttttggggtacttttcttctctctttgattttttttgatgccactaaaattacaaccatttacttagctagtaagactgcatgtaagtggcagtgaagaatgaaaaagaaaactatccagtcaaaagaagtaattttaaaaatgttggagtgtgagattttatactataggaaagtaagtcactaccagatatgttatttaaagattttctttaaacttttaagcctatatatttaatttcctagtttttttttttttctaaaaaaaaggcaaagataaaattacaagctttaagataggaataaaagtcatttggtcatctgtttatgactagaaaacctttatgttctatgaaatgcatatagattaagggaaactatatatagccaaccaaaataaaacagccatgctgtgtgttttatcaaattacttcttaaaataggaaaacactcaataataagctgcatatagctccctaattactacagttttactttatatgatgtttaagggaatttttgagatatctccttaccattttttctatgaaagtgataatttaaatataattttatagcatatgtttttatttttatatttcttccagttctttaggacattaatcattattgaaattttgtccttcccccatctcatttctttgctttttacctccctggctttctttgtattgaaaaagctaggttccttctaggagagaagtgtcctatgtatattctgatttcttttttgtggagaaatgagtgactgttgagtaaagtcatgatggaagtgccatttgaaaaaaacacaagttcattatatttcgttattcatcctaattttcaagtagaattgcagtaagctaatcattgattagggtgctgttagagttggcagttaggaaggtaattctgtgagtgaggtggaaattatttggctaaataatgtggttttccacctttcactattataccgcttttgtgaaatatttttaattttgattatagaaagttttaaaattaaatagttgtgtataaacttattgaatgtaatccctatatatatattaagttctcatcgactgcatggcactatgaaagactatgatttggaaaacctttcattttcctttggggcaagtaccaatgactgtgttaaacaaagtaattcctaaatatggccttaaactctcttccccaaaacaaacacattcctcaaagtaaccctgagtgagcagaaaagcagtagtttactaggtatctctaaaccatatgcccatatcctaaacgtaggggttaagatgaagattttatgtgattagattggacaaatatgggaaatccactcattcatttattcattcattcaaccaacatttatcaaatacttatcatagtgaatctatatcaccaagaagaaagtttgggaacgtttctgctgaggaaagtaggggttatattagcaatgttttattttatgtatttgataccttgaatggatcatttttaccatactttcctctacaagataaaataatttactgtagtaatcagtaataaccggtattttctcttttcttcttgagatgtaatttacatatagtaatactcaccattttaaagtgtataattcagtgtttttttacattaaaaaggttatgaaactgttaccactattgaattccagaacttgcatcattctccaaaataaaccttagacccattcatattcattcctcatttctcttcccccctgtcttctggcagactactttctgtctctctaaatttgcctatcctggacatttcatataaatacagtcctacattatgtggcctctgtgtctgttttctttaacttaatgttttcaagattcatctatgttgtagcatgtatcagtacttcattcctttttatgagtgaattaaaaatattccatagtatggatatagtacattttgtatatccatttatcaattgttggacatttggattgtttcaactttttttttttttttttttttgctcttatgaatagttctgttataaacatttgtgtacaagtttttgtatgaacatatgttttcagttatcctgcatatacacctaggaatagaattgctgggtcacatagtaattttatgtttaattttacaaggaaccactaaacagcttttcacagtaggtgcatcagcagcagcgacgtatgcaagttccaatttgcccgcatggttgccaacacttgtagtttttgcttgtttgattatagccaccctagtaggtgtgatgtgtttgatttattctttagtttagaaagagtgaacaactttttaataaatcataaatttaaaattatataaattattttgatttaataaaatttgcatttttatcaaaattattaaaatcttgcagcttacagtagttcactcaaatattgagcactatttaaaaatgcaagaattcaaatagagtaacataattgaaatagctcaaagtctacttgtctgtaaattcagaggctattattgttcattaagagtcttctgattacaagagaagatatgtagtaccacatagacaaaaactatgcctgaaacaagtttgaataattacaaagaattgtgaacttactctcaaaacaaatgcatgtatctgagtcctcatgtcccttgggccagctgtataattgggacttctgtgaattaacttgtaaaataaaaggataatttaaaaaaaatctaagttgaagcttagtatctgctacagttgtttagaaattaggtcagcaaaatattttggtaagaggaatagtctataactgacattttgaattacagcacatgttgacaataaaaagcagaccaaatttttttagttttattattgtttctaaattttctatatacaacaaattcccttattatgtacacctagggcagaacacttccactgccacactcttggttttaaagcctttttgtttccaaagggaatgctttatgtattacatggaaaacatcttggtaaagcagaaaacttttctgatttggtttccaatcaggaaataactcttcaaccaaagatcctagcccaccctttcatcagagtgcagtagaagtgactggtgcaaaataaataaatgctagaaagaagacagtaaagcttacatagataacctcagggtcaacccaaactattccagagtaataagaaaaacattatctaaaacatattctagagagcaaattgcattagttatctactgctgcataacaaattactctcaaacttagttgctgaaaataataaatatttattatctcatacagtttttggcattcatgagtttaagaacaccttaggtgagagattctggctcagaacctctcttatgagattgccgttaacctgttgatgcagcagtcatgtgaatgtttggttggagctggaggctctatttcaaggcttactgatgtggttgtttataggaggcttcagttcttctccttatggtcctctaagtgaggctgctcaccacttggcaactggcttcttcccaataagtgaagaggtaaagggaggtggatgggagagggcacacaaccaatatggcagctacaatgtctcttacaactttttctcacaggtaacataccatgacttcttgcaatattctattggtcacccagaccaatgctggtgcattgtgggaggaaactacatagaggtgtgaattacagagggtggggataattaggggtcatcttagaggacaactaacccaccaacctccctctacttacattaatttataaatttagatgtttattattagaacacactgcttcttctagaatgttgcttattcttgtcttctctatagttttctgagtaaagtattaaagtctttaggaattgctttacttgggctggatgggctctgcttagtgattagagtcacctactcaccgtatcttttaactgaagttgggtgtccaacaattaaccttccaatttttatttcaagggtagttttaaaaagaggcaggtgttttagctctaagaatacctgtatgtttttagaacagagaaagtgggaacaatggagaatgaagtcacatatattttttaatcttgtttttacagtaggtggttttaagtcctaccatatgatggctggtattttcgagaattgtttctttctatcagtagaaaatgtgtcccttccaacgttccattacttgaatgtctgtgttaacctagaaagacagtaggagactaaaacttgtaatattttcattacttgaaagattaaattatgttttattgtatgagttctttagtattttccctggataggccttttcttcccatcacacaaacaatagagacaactttatgaaatatgagagaattgtattttaatactctgaggtaggatcaagctactttcatcagttgatacaattttcccctaaagaaattctagctgtgagggccaatggacttgggttacatataagaattatatatacattatcatttgcttttgaaagtaattattctaaggctaagttaggtttgaatttgattctgaacaatgatgatgcatttgaactgttagggtaattaggactatatcccattcacccacacactctttttcatgtgtagtcctttaaactgcacagcctttgaaggatggttagtttgtatctggggtttgtgttttgtttttttttttcatctactttttgattgctatgtcattgaaaagtgcttaatcacagagaggattacaaaataaaatcaccattagcataaatcatttatactcattttaatgcttccttcttgtttgtggagttgggtatttggaagagtggagaatatataaccttcttttttagtgtattttgtgaaacagtttttctctcctattttgttttaacatttaaaataagagacaaagtcatcagagtcaaattatgtatttacatttttattagaaaaataattggttagatgaactggcttattaatgtaacataatttattttggaaaattttttaaaagctaaaatctgtatttaatatatggattgaagaaactggaaatatatgaagatatactttgtattatacttttcatccttagaaatgcactgttatattgtttagggagacttcattcagttcctaagtaatttgtttttaattctggaatccttagaaataccatttcagtggtataactaatgggcaaactggaactaacggaaaggaattttatttctttattcctcccaccaaccccaattccttgcacagatttacatggcatggctcatgtaacacaatagaaagattcctgaaaattgtatccaacttttctatccctattttaaatgcactgaagaatagactacttaaattaatctaaaggtaatttttcttgtataactgtggcttgaaaacatttagtttatatatcaactgtgtttaatcattccaagttgtttttattcagaataaatccctaaagcaagctttgctgagtgtcaaccctttgctctctcttacgactgattactatggttgcttctttgcttgtaactttaatttacggaaaacaggctcttggtgtccagaaggcagaatgggcttggtgaaacagatgctagacctaaatggcttttagcatttctgcctctgcctcctggttgcttttgttgtatttctatgggtgccttgaataatgtgagtcactcaggtgggcagagttcatagagattaatttctggcgtgtgaagaggaacagaaagcagtagaggggtagatgttcttaggatgatccacatctgttcttctcttgtccctgtgcttcctggtcacccacctccagtttcagttttattcccattttacgatgaacattaaacagtgtaattaagttatgcaggacccatattgtgttttaaataacacttccaaaagtatatcatgggtcagttcataattgtgaacaagattctcttgtttaacatagcaaagtgaagctgaatctcaaaatattgttccctcttaacccaatggtatgaacaatataaaattaaaaatcagcactgaccattcaccattcatccatccacccatccatccatctagtccaaggaggaaaaaactcccgatcgtcaatgagaagaaaatactactatctagcaaaggaagcagatctaagccccagagactgcatgtctggctttggtaataggcaatgtgcatctagttgctctctgcataaaccaaataggggagaaataaacaaaataaaatcctgaaaacaccctactctcatcccaactgtggagaagctaatgaggcaggctgagagaagaaacagggacatttccctaagggtggcagtcttcttgctcacaagagagtaatattttttccaccttgatgtctccatgatggcatgaaattaggggataaaaaacagaatgaccaaaaacagtcaaagctaattaacttttgcaataaacaaggttgtaattgatcagtaaacaaaagaggagaatgggacaaaggagttggaatgagtagggaagtgtatactagaatccctgggagttgacttcaacctgcctattgccttaatgccttatctctgttatatctgaggaagagagcagctaattgggttaaataaatctcctgaggtactcctgatggaagtagaggctcagaggccctgaggtgagtaagggaaactctctgaagccataggcactgaattgattcccaataaagtgaagcagaccttggcataaaataattacaaaaccagagaggagatggcaaaactccaaaacactaaccaagaccctgccaaagcccaaacactcccccttgacaaatgacccctggtataagcagaactcaaattgtagtttatacgggaagctaaatctcagctaaggtaagaagggaatcaaaaagaattgacccgtattctaatcatgcacatagaggttctagattaacctgcccaagtttatcatggttgacatggagactaataacaggcaaattaagaaaataaaatgtagggaatcaatgaagaactaaatctgtagaaacaaggacacattatgtttcaggggagaaaaatgtgggtataaatgagtaacactaaaacacacctttattaagccattaagtttcaagtattaatggcaaaaaccgcaattacttttgcaccaaattaatataaagatgaaatttttcaggatttggtgagaaaaataaacaagtcacttacaccacaagctcaaaagcagaaacagattatttaatgataaaacaggggattacatggggaaattgtggtaaagggtagaataatcattgatatcatttaagtatagatggaaattaaacgatcatgagattgaggattacaggaagtaaatattgtaaattttgacaacatacaaaattattattaaaaatgttgagagaatcttgataatggaagattgaattgctcaactctctttttagacattgaactagaaggctgtgtagaatagaatgactaaaaacagactttaaaacttacaaatcaccaaggggaaaacatgtatgtaacacataaagaggcaatccatgtagaagcttaaaaacaaaagaaacattacatttagaatgtaaaacataagaagttgattgcatttgttatatcaatgaatatgaatgtttagtacttgttaagataatgatatatatgtaatataaatgagaacaatactcatatattgagttactacatgaaaaaagaaatcccatctatatactatatacaagaaataattctaaagatgttactcattgaattaaaagtgaacaataaggtaaacagttaaatgctaacaaaaataaaactaaaattcataatactactttcagactattaaatccaagccaagaaaagggctaagtgagatgaaaaaactcagtgtatgataaaagttgcaattcacaatgtgactataattgtataaatctttatggtctaaataacatatctaaaatgaagtaaaataaaaagttttcagctgcaggaaatgcaaagagaatttaacaaaatatggtggtggtaagagatgttaattcatcatgtcagccattaaaagattacgtagaaaaaaaattagttgcaatttaaagggtctgaataaaatcgataaaaagttaaagcaaatgtagatgtagaaatagataacttgatagccagttggttggatggattgatgaaagaatgaattatggctatttctagagaatcactttattgcaataccttaggccatacacggaaatgaaacatatattagacctcaaagaaaacttttatatagcccaaaaaggtaaaataatatgaactacctcactggccaatatataataaaactagagcttaatagaaggacaacaaaatccaatcacttaaaaaaaactttcaaataattcttgagttacagaagaaatcaaaagaaaaattataaaagatgaagaaaacaacaaatatttgacaaaatgcaagaccattttgctattacaattgacctagaaaataatattcacggcaattttgaaaaagaaaagtaatgagggatgaactaactttatcagattttaaaatacatcaggaagttgcaataattaaaataaattggtactggagaagagcaaaataaaggggccacccatagatttgcatatttgtaacattaatttgtgataatagtattattttttaaataactgagaaaagagaaccttcagtaaataatgtggaatagctggctaattgttgcagaaaaggataaacctgtatccctatcttaatttctaccttaaaataaattccagatggaagaaagtattaaatatatttttaaaagcctgaaacaattgttcttcaaaagttttgctaaatgtacttagaatcttggcagagggaagtgctataaaaaggatttaagactcaaaatttataaagaaaagatcaataaacttcacaacattaaacatattagaaaacaaactttgaggagaaaacagtatgagaaaggacaaaagactaatgatagactggagaaaattatttgcataaatatcaacattaatttttcttaatttttaaatctcatagacaaaaacaaccaacctcctagaaaaatatgaacagttcatttgtaaacaaagaaaaatcactgggtatttaaacataaattgttggtaagtctcatacagaaatagaagaaaaacacataaatataaatcatagggaaaatctaatatttatacccacattgtttggcaaataattaaacctggaaatttccagagtggatatattgataaaggactctcaattctgaggatataaaatatggtgaactatcttgtgaagtttcagaatatttatcagaaattttggtcatactgtttgaccaaaaatgttttcactgagaggaatttaccctcagcaaatacttggagaagttcaccaacatgtttgtacaatgatgttcattccagctttatttatacaccctctccttctgacacacaattgaaaacaatggtaggattcgttaatatgagactgtttaaataacacaatatgatgaagaattatgaaaatcttttaaaattaactgtttttactgaaagggaaatagctgtagtatatacaattatattaatacttttaaataatcttttttttttttttttttttttgagacagagtctcgctgtcgcagaggctggagtgcagtggtgccatctcagctcactgcaagctctgcctcccgggtcacgccattctcctgcctcagcctcccgcgtagctgggaatacaggtgcccgccacctcacctggctaattttttgcatttttagtagagatggtgtttcaccgtgttagctaggatggtctcgatctcctgacctcgtgatcctcccgcctcgcctcccaaagtgctgagattacaggcgtgagccaccgtgcccggctcttttaaataatcttaaaggtcttccaaccttgcccgagccgggcagggtggctcacacctgtaatctcagcactttgggaggccgaggcgggcggatcacgaggtcaggagataaagctctcctcagcaaatgtaaaagaacagaaattataacaaactgtctctcagaccacagtgcaatcaaactagaactcaggattaagaaactcactcaaagccgctcaactacatggaaactgaacaacctgctcctgaatcactactgggtacataacgaaatgaaggcagaaataaagatgttctttgaaaccaatgagaacacagacacaacataccagaatctctgggacacattcaaagcagtgtgtagagggaaatttatagcactaaatgcccacaagagaaagcaggaaagatccaaaattaacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccagttgctggttttttgaaaggatcaacaaaattgatagaccgctagcaagactaataaaaaaagagagaagaatcaaatagacacaataaaaaatgataaaggggatatcaccaccgatcccacagaaatacaaactaccatcagagaatactacaagcacctctacgcaaataaactagaaaatctagaagaaatggataaattcctcgacacatacaccctcccaagactaaagcaggaagaagttgaatctctgaatagaccaataacaggctctgaaattgtggcaataatcaataacttaccaaccaaaaagagtccaggaccagatggattcacagccgaattctaccagaggtacaaggaggagctggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaagcgaatccagcagcacatgaaaaagcttatccaccatgatcaagtgggcttcatccctgggatgcaaggctggttcaatatacgcaaatcaataaatgtaatccagcatataaacagaaccaaagacaaaagccacgtgattatctcaatagatgcagaaaaggcctttgacaaaattcaacaacccttcatgctaaaaactctcaataaattaggtattgatgggacatatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtaccaaaatcacaagcattcttatacaccaaaaacagacaaacagccaaatcatgagtgaactcccattcacaattgcttcaaagagaataacatacctaggaatccaacttacaagggatgtgaaggacctcttcaaggagaactaccaaccactgctcaatgaaataaaagaggatacaaacaaatggaagaacattccatgctcatggataggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcatgctacctgacttcaaactatactacaaggctacagtaaccaaaacagcatggtactggtaccaaaacagacatatagatcagtggaacagaacagagccctcagaaataatgccgcatatctacaactatctgatctttgacaaacctgagaaaaacgagcaatggggaaaggattccctttttaataaatggtgctgggaaaactggctagccatatgtagaaagctgaaactggatcccttctttacaccttttacaaaaattaattcaagatggattaaagacttaaatgttagacctaaaaccataaaaaccctggaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccgtcagaatgaacaggcaacctacagaatgggagaaaattttcgcaacctactcatctttcaaagggctaatatccagaatctacaatgaactcaaacaaatttacaagaaaaaaacaaccccatcaaaaagtgggcaaagaatatgaacagacaattctcaaaagaagacatttatgcagccaaaagacacatgaaaaaatgctcatcatcactggccatcagagaaatacaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactgtaaatcatgctgctataaagacacatgcacacgtatgtttattgcggcactattcacgatagcaaagacttggaaccaacccagatgtccaacaatgatagactgcattaagaaaatgtggcacatatacaccatggaatactatgcagccataaaaaatgatgagttcatgtcttttgtagggacatggatgaaattggaaatcatcattctcagtaaactatcgcaaggacaaaaaaccaaacaccgcatgttctcactcataggtgggaattgaacaatgagaacacatggacacaggaaagggaacatcacactctggggactgttgtggggtggggggaggggggagggatagcattaggagatatacctaatgctacatgatgagttaatgggtgcagcacaccagcatgtcacatgtatacatatgtaactaacctgcactttgtgcacatgtaccctaaaacttaaagtataataataataaaaaaaaataataatcttaaaggtaaggtacagaagtgttaagtttttaaaaatatgcacatttagatagatttattgctacattaatcaatctttttctccccctttccagaaggaaacagaagtaaaattaaatagtgcctgcctttggaaaaagatggggttagttgagtgagagagaattctactcttcattttgctcctttctgtagtgttccagttatctaatccttccacatatcagctgaagttttctaagcagtagttatttttagtttacttccatatatttttaaataccaaactaatcaatattgactgacaatatcaatcagttagtaaaataattgagtaacccctgtttttatatattctgatatgagatgaaaatttaggaactctatcaattttaatacttctgtagagagtttttgcatatgtatattcactattaatacacagaagattcctaagttcaggctgattcctttaaagtgtctgttttacccccacaagaattgaaatagtttcagtatattttgttttataaatatttaacttctgtttgctgaggttgagaaaggcaatattccacaagggtccattttctaaatctaaggcatgaatgattttttcatagttacagtatttatgaaatattgagaatttatgcatgtgaaatgtctcataatggactattttagatttaagctattctttttttaggtctccagtgtaaaattcaaagagtagaagctatagcaaatgaatatgctgcgtttcttgtgctataggctccttaatctttacagaagtcttatttgctcagctagattggtctaaaagaaatggtttaattttctctcaaataattcaaccttcaaaaagaaaccttccatgttgttatttttgcacttgtagtgcatactgggggtgctctgccagcttggcattgaatgtgtttgttttatgtagagtgtggtattaaagtagtggctgaattacttgacataatttgcataaagtcatatctcagtgataaaaattaatgtgttgagggctgtgagtgagttggaatgagtcatttatttcttaatagaaaaaagctttatcttcagtttctatcacacttgaacttcaattacctggaatattttcatttgtttgtttattcgcatttacttaagtgttaatgattattcagtggtttcagcaggagagtgttttaggtctgtctttaacctgagtctaatcatagaaggagttggcacgtatcagaattgtaccgtaaaagcacccctaaagcttgacaatgttctagtgattccattagcagctattaaatggaggtttaatgtctttgccatttggggatctgacagactgaaacttagtattcgttttggcccctgtgaatatcatctgctcatccatgcttataaaaatgaaataaaaagtcagtctttgttcttgctcttgcagaagcaattgtagatttttatgaggaaaacaatgaacatgtcaccctggatttggcagcagggaagagcagggagtatataaattgtctttttgggtgccaactgttttgcaccagcattgtttatattagtgaaatggttgtaagtcgtgtaaattgtatttttttccttagctatgttttatggtgggggggtgtcgtaggggaatgtgcattaaatctgaaatggtctcatgcttaaataccgcagtgtggtagacagttaatcttcagaacaaatagtgaacatgcgtaactgctttattgccgtcaacatatgtcactctgtaattatcctggcttataccttgggatgggctaaggatgcaggagctgtctcagctcagagaattttgttttcattttttgggttccaaacagaatgtattgggagaaaaaaaaatcatgtggatttgcccaatattggtgctcgtaaaaacaattaccctgaaattattagtgctgtatgttcaggacctaggagagcaggtgttgggtaagtctgactaaacagatgtgtcaatacaccttggctcatctgagactgtttgggaaaattcttgaggaggctcacgacaccacacatagtcatttccagttacctggtggtgacatgcacaagtggcatatagagactgggttgcagctgaccttctggtgaccagggaatacctccagagagactgcgatgcagttcgcaactgaaaaaagagccacttgaatactgatccttgatgatgggtatcgccattgaggcagcaagcccaactgtttatcttttttcttatttggtaactaggtgggatggttgtatagaaaaatgtgggtgggaatgaccacagaccgcaaactcacgtttgcaagaaatgtagctgtaattttctgtagattttacccatgtcgtcctctatacatagagagatcatacatccaggtttgcccagaagagtccagggttatgacttgtcctgaccctcctttttccctcccaagagtttcccagtcatgccagcataagaacttttccctgagttcgttatgatggaagaaccttgctgcttcaacggagagagccatggggatttaaaatacacagagaaaggcctatcagtacattataatatcatttccttcaaagtattcaaaatttccttagtctgtctctagttctccaaagggtgtatgtaatattataatatgtataaccgagatgaaaattgttggccagtggagcagcaagcatatttcttggataatgtagtgctttatttgggaggacttgatatcctttggggaggctcattgattttatgagatcattagtttacttattattcaataaatttaactcctctacactcaaacctgtagtaaaatatgttttgtgactgtgatgttctcttttcagaagtgaggctgggctggcaatagctggctggaacatggtctgggaaggaaatgggtgaggtcaaaagtggtgagacaagttgctgaagaacaggaatctgctatgcgaaagaatcagagtgctcccttagggaccttaatttaggggtcttgaaatatatcacactctcccaaaactaattcatgcttcaactgccctcattaatcataagtcagttgtgaaagaccataatgacagtaactgcctacgtggatcacattttgtaaaccaggttttagtcgcagtatgcaccatactgaccaaatttgtgtccatgtaaatcactgttcacatccatccagattccatttacatgcattcaggcactagcatacatacatatagatatacatgtgtttgcataaggagtgcatatagttatatatctgcatatagaatttacatgcatacaggcactagcatacatacatatagatatacatgtgtttgcataaggagtgcatgtggttatatatctgcatatagaatttacatgcatacaggcactagcatacatccatatagatatacatgtgtttgcataaggagtgcatatagttatatatctgcatgtagaatttacatgcattcaggcactagcatacatacatatagatatacacgtgtttgcataaggagtgcatatagttatatatctgcatatagaatttacatgcattcaggtactcgcatacatacatatagatatacacgtgtttgcataaggagtgcatatagctacgtatctgcatgtagagaagtatctttgaaatcaagtgatctggctccataactgtccttccatgcacacagcttgcctcctctcctgcccttaaattggggctgggaagggactacctgcctctctctgattccaagtgacctcagaaagtacacctgctcttcacattcacatgtttaattcgtacctttctaatgcctggaggtgatttggatatctggatgattttttccctttttctttcctacttcttcagaataaaccacttcttaatattctttgccacttttgtttcaatgctgccagaaggattttcttaaatcacaggcctaatacttttatttcagtttcccagaaacttttgctagatccttactgtgtgaaaaatgaatgcctcatagcatggcattcaagggccactctgatctgacctgcagtttcttgcctcccttttgcatcatctctgccaggaaacccagatcgagcttgtgcttcccaagtcttgatgcttctccatggtcttcttgtgttctccgcttctttaaggttcacctgaaatgcagcgttctaccaagcattggccagttctcataatcagtttttcttttctgtgagcatagtggatttttatcatttgagcataaccctatcaatgtcttgaattatgactgtgtgcatacctgtagtacctgttaattataaactcctagaaggcagaagacatgtctttttattctttgtgtctctcctagcatctaacgcaatacctggtaactactaagactcaataaatacatgcaaagtgaagacaaaaattaattccaagctaaaaaatgttgctaaaactttgaaaagactccttgttgaggatcaaaggtttttgataatggcaaatgcctagataaccagtatttctcaaagtaaagccccaaaattaccaaccaatcgttctgtccacaggttacctatcatttaaaagaaaaatatttgttcatatatatacattcaaaatttttggaagtttgaaatgtaagtttagttatggttttcataggcatttttttgttattttccatttttactacttttatttttttattattatactttaagttctagggtacatgtgcacaacgtgcagatttgttacatatgtatacatgtgccatgttggtgtgctgcacccattaactcgtcatttacattaggtgtatctcctaatgctatccctcctccctccccccaccccatgacaggccccggtgtgtgatgttccccaccctgtgcccgagtgttctcattgttcagttcccacctatgagtgagaacacgtggtgtttggtattctgtccttgtgatagtttgctgagaatgatggtttccagcttcatccatgtccctacaaacgacatgaactcatcattttttatggctgcatagtattccatggtatatatgtgccacattttcttaatccagtctatcattgatggccatttgggttggttccaagtctttgctattgtgaatactgctgcaataaacatatgtgtgcatgtgtctttatagcagcatgatttataatcctttgggtatatacccagtaatgggatggctgggtcaaatggtatttctagttctagatccctgtgaggaatctacactgtcttccacaatggttgaactggtttacagtcccaccaacagtgtaaaagtgttcccacttctccacatcctctccagcacctgttgtttcctgactttttaatgattgccattctaactggtgtgagatggtatctcattttggttttgatttatatttctctgatggccagtgatgatgagcatttttttcatgtgtgttggctgcataaatgtcttcttttgagaagtgtctgttcatatcctttgcccaagttttgatggggttgtttgatttttttcttgtaaatttgcttaagttctttgtagattctggatattagccctttgtcagatgagtagattgtaaaaatttgttcccattctgtaggttgcctgttcactctgatggtagtttcttttgctgtgcagaagctctttagtttaattagatcccatttgtctattttggcttttgttgccattgcttttggtgttttagacatgaagtccttgcccatgccttcataggcatttttttttaatcttgttaagtactattatgctctccaaggctatgaaaacattgcaaagtgttggccatgctgtctcagcaaatattcagttaatggtgcacttcccccaaaatatatgatttcctgtagttttttctaattatttatatctgttaatttttttcttttttattgttagtattttgatgaatcatattctcgattcacaataagcagatcaccagcacaaaaacattcactagagaaggggtgttcaatcttttggcttccctgggccacgtagaaagaactctcttgagccacacataaaataccctaacactaacgatcgctgatgagctaaaaaaaaaaaaatcgcaaaaaaaaaaaaacctcataatattttaagaaagtttacaaatttgtgttgtgctgcattaaaagccatcctgggcctcatgtgggtcgtgggccgcgggttggacggtgccaaagcatgaatgttgtgattacagtagtaatataaatactacaattcatgtatatatttttaattttaatatagagacatcatgttgtccaggctggtctcaaacttctgggctcaagcaatcctcctccctcgacctcccaaactgttagaattaaatgaaccactgcacctggcctacaattcaaattaatgtaaaaactgcaagtggttggtgatcaaaactccaatgcacatgtagactataatttgttcatgtcaggatagtgtgatgggtttactcaagcagccacaaaagaaaagtttgaatcagaaataagatgtgaatgatttttatattttattttatattttttaccccttatccaattataatacatttgtcacatagtgactttgaaactttgaaacgttcttccagttttcaaacaaaacacaatgacctttttgttgaactgattaagtttctctggaaagtaagataatactttccccatcaacattaatgtattttgttgcaaaaggtggggaaatcaccaaagtcataagagcataattcaactttgcactctttgttaaaaataatcaggtaaatgtcacactatgactgagatggtggtaaaataagccaaaagtttaatgacaaatgttatgtccagcggggaaacatgatgaacttttggcaacatttctgaaccaaatggacacccctggaatctgccagcactggaaaagcggttgctgtcctggaagagtggttctatattctgttctatagtacttactatgcttactatagtactatatactatacttactatatactatataccatacttactatagtacttactatagagcacagtacagaagaacgggctgtataaatcagcatttggcacttgtgtggtacatatatgagggagtggtgcctggcaactgtttgccttacttgttattggaaatccaaactctagcaatgaaagttatttttaactcagtaaatggttatcttggagtctgtgatgtagcctagaaaacataccccggggtgaaggctgatggagcacagccatatgtgcaacaaggaaattctcacactgctgtattcacagatgacatttggtggtcaacgctatgcttcctcatactgatttggtggtgaaagaaatactcaaaaaattatagccatagatgtaagtctttgggatttattttctgggtttcaaggataaatttctgcttttccaaattgaagttcatcagggagtagagaaaaaatgaattactctatttttttttgaaaaaggcatgtttttcatacgacaccaataatacaaataaaggccacttttatttgtatcagttattcaagtgacaccctcagcaatgtatttgatgtctgaataatctgaacccttcttttctgggcagaaacattttattccaaagacatctaaatatttgaaagaaataccaaacatttgccactgttcttaatgacaattaattttaaatagggcttctctagtacagtacaaataaagactaagaaaagaaacaagttgggatgtgaaactggaagcctctgggagtaaccattaccacgacatttaaattgtgactgaaaatgtgcaaataacaggttctctttaactgataagaaatgatttttaatttaaaaaaattttatataaatttgtttttaatgtttaaaaattttacctaaaagatgatgtttgcatttctgcctaatgttcattaagtgggttttaagtagtgaaaaattgaagaaacaccaccattgatatgaaagtggtgactagttttgaaaaatttcaaaaaaattgtttataataaatgctttcaggcataaacatattaatagtataaatatgtacaaatatgtactcactagcaacaatgtaattaagtacagataatataatttatgatttaaaacatttaaaatttatttgttacatttattcccaatctttgagctttcaatctcatacagctttgatacattctgcaacttgcaaaaataattttcggttgtttcataaattgataatgtcttctatataagtattttctgctctttgtttaatctttctcttgaggcatctattttgatttttcctattttctcatgaagaatgaaatgctttagtgatacggaatataggatttctagaaatcttggtaattactgaaatctttgcatcatacggagtatctgtgttgagtgttctgatccttatttatttacttttggtaactatcattgtagtagtgaaaatggaaatcagggccttgttttcttgtcttaattcttggcttctcagttttacagacagtaaagagatcaaataaagtaacatactatttgtccaatgtaaagctaattttatcatattttgcttctagaaattcagaattcacccaaagtagcacaattagagcagggcgtagtagagcaagatctcctcaactttcctcatatttcgttgactgagacatgttgtgatcaaagaatagatttcatcaaagaagtctttttgttttttacattttccatctcttttcctgactcctttatatgacgaacttcatctgtacacctgacttttcattcctatattttagaaaagtaatagcttctgggagagaagagaggaaaggaaaatgatcttttgttttggaaccatgaaagaccaagatgaggcattctgagatgccaatttcatgaatttgtctttgagaagacaagcaaaaagtgatagtaagctgttctttagcatagaaatttgtttctggttttgtcatcatgattaatcattctgatttgcagccttacttgtttcaatcattgaggccccattttaatgtgattaacatttttgttccatttatggagcagtactggcccctaatttttgagaacaggataacccttgattggccttatgtaaataaatcgtaacttaatgcccttgaaattggagtatcccccaggagaacaagctgtaaatcagagtagaaaaaagtgagccttaccctgggggcgggagctccacatggcatattcaagatgaaccaaatgcctttatttcagaattttaattcatggtactttttccttttcaaatggtgctgtcatcttgaaatgacagagattgagtgctaaattgctattgcataattttccttatctctcatctatagactggatttgattgaaagttcagattttgtgaagaatgttttacataggaaattttgaaatatggggaaacattatttttacataaaggaaaggagaactctgtgtgtgtaaaacggagttagcattttttttttttttttacccagccagggtctttgtgtaattataagcaaatagctattatcattccaacagattttttttcctctttgattctttctagcaatctctctctctatgtagcttcttatccctttttgtgccttaaaattattatgctattttttaatagtaaagaggctgaaacaatgtcctggaatccatatccagtggtgacaggagactaatcattgcctctgtctgagttatttgaaaatgggtccacactttcatgtgcgtccgtgtgaacagaccaccaaacaggctttgtgtgagcaacaagactgtttatttcacctgggtgcaggcgggctgagtctgaaaagagagtcagtgaagggagctaggggtggggccattttataggatttgggtaggtaaaggaaaaaggggggttgttctctggcaggcaggagtaggggtcacaaggtgctcagtaggggagcttttgagccaggatgagccaggataaggaatttcacaagataatgtcatcagttaaggcaggaaccggccatctctatgtgtatgtgcaggtcacaggggatatgatggcttagcttgggctcagaggcctgacattcctgtcttcttatattaataagaaaaataaaatgaaatagtggtaaagtgttgggatggtgaaaatttttggggggtggtatggagagagaatgggcgatgtttctcagggctgcttcgagcgggattaggggcggtgtgggagcctagagtgggagagattaagctgaaggaagattttgtggtaagggatgacattgtggggggttgttagaagaaacatttgtcatgtagaattattggtgatggcctggataccgttttgtatgaattgaaaaactaaacggaataagagaaggagaaaaacaggtattaaaggactaagaattgggaggacctaggacatctaattagagagtgcttaaggaggttcagcatagccttgccagcaaagattatttatttactttaagagttaggagtggcggtttggggatagcatcaggaggtatcagctgtgatggcttggaaaaacagtgtaaactggcactgtaaacaagagcagggcatgtatgagtagttgagaatggtgaataggagtatgactagacagaaaacagcacagatgacaagttttttggggcgcagtccaagttggtctggtgtctgggatgagactggggcctgataaaaaggagtgtctatacaggagctcaaatgggccgtaccctgtagcattctgaggacaggcctgacttctgagaagggaaagtggtaaaagtattgtccagtcctttttaagttggtggctgagcttggtgaggtgtgtttttaaaagacttttagtctgttctactttccctgaagactgaggaccgtaagggatgtaaaggtttcactgaatactaagagcctgaaaaactgcgtggctgttttgactaataaaggctggtctgttatcagactgtatagaggtgggaaggctaaactgaggaattacgtctgacagaagggaagaagtgattgcagtggccttctcagaccctgtaggaaaggcctctacctatctagtgaaagtgtctacctagactaagaggtattttagttatttgacttggggcatgttgagtaaagctaatttgccagtcctgggtggaggcaaatccttgagcttggtgtgtagggaagggagggggcctgaataatccctgaggagtagtagaatagcagatggaacactgagaagttatttccttgaggatagatttccacgatgcaaaggaaatgagaggttctaagaggtgggctagtggcttgtactatagcatagcctgcctttgctggtgtgtggcgattaggcctggtggagctgccatcagtaaaccaagtgtgatcagggtgaggaacaggaaagaaggaaatgtggggaaatggagtaaatgtcaggtggatcagagagatgcagtcataggggtcaggtgtggtatctggaataatgtgggaggtcggattgaagtccgggccaggaacaatggtaattatgggagactcaacaaagagtgagtacagctgaaggagccagggagcagaaagtatatgcgtcaggtgtgaggaagaaaatagattttggaagttatgagagctgtagagagtgagttgagcgtagtttgtgattttaagggcctctaaaagtattagggcggcagcagctgctgcacggagacatgatggccagcctaaaacagtaaggtcaagttgtttggacaaagaagctacaggacgcaatcccggtccttgtgtaagaattctgactgcacagccctgcacttcggctgtgtgtaatgaaaagggttgggatgagtcaggaagagctagggtggggacagtctctaaagctgtcttcaaggaatggaaagatgagtggggaaaggatttaggatctatggggtcagctaggtttccttttgtgagtttatgtaatggttttgttaggatggcaaaaccaggtatccaaaggcaaaagtatccaaccatgcccaggaaggaaaggagttgttgttttgtagaaggtgctgtagtttgagagatcagttggacactatcggcagggagagcacatgtgtttttatgagaattatgccaagataggtaacagatgaggaagaaatttgggcttgactgaagtgatggaggctatctgtgagggcttgcagcagtacagcccaggtaatttgctgagcctgatgggtgtcagggtcagtacaagtgaaagcgaagagaggctgggacgaggggtgtaggggaatagtgaaaaaagcatttttaagatcaagaacagaatagtgagttgtggaggaaggtattgaggacaaaagagtgtacaggttgggcaccacagggtggataggcaaagcaatttggttgataaggcacagatcctgaactaatctgtaagacttgtccggtttttggacaggtaaaatgggggaattgtaaggagaatttataggttttagaagcccatgctgtagcaggcgagtgataacaggctttaatccttttaaagcatgctgtgggatggggtattggcattgagcgaggtaagggtgattaggttttaatgggatggtaagggatgcatgatcagttgccaaggagggagtagaggtatcctatacttgtgggttaaggtggggggatacaagaggaggatgcaaaggaggctttggattgggaagaagggcggcaatgagatgtggctgtagtccaggaatagtcagggaagcagaatgtttagttaaagtgtctcggcctaataagggaactgagcaggtggggataactaaaaaggagtgcttaaaagagtgttgtctaagttggcaccagagttggggagttttaagaggtttagaagcctggctgtcaatacccacaacagttatggaggcaagggaaacaggcccttgaaaagaaggtaatgtggcgtgggtagcctccatattgattaagaaggggacggacttaccctccactgtgagagttacctaaagctcggcgtccacgatggtctacagggcttccgaggcgatcaggcagtgtcagtcttcagctgctaagccgagaagatctgggaaggagtcagtcagagagccttgggccagagttccagggggctctgggagtggctgccaggtgagttggacagtccaattttcagtggggtcccacagagatgggacgcggcttacgaggaatcccaggctgcaggcattccttggcccgatggccagatttccagcacttgtagcaagctcctgggggaggaggttctggaggaatgcctggctgctgcggttcaggcgtttggaagttcttgtgtgctggagatgtggctggggtttgtctcacagtggaggcaaggaattgcaactcagaaatatattgctacttggctgtctctactctattattgtacaccttgaaggtgaggttaattaagtctggttgtggggtttgagggccggaatttaatttttggagttttatttaatgtcgggagcagattgggtaataaaatgtatattaagaataagacggccttttcaccttttagggtctagggctgtaaagcatctcagagttgctgccaaatgagccatgaactgggctggatttttatatttgatgaaaaagagcctaaacactctctgatttgggataaaggaaaaggagcattaaccttgactatgtctttagctctagccacctttttaagagtaaattgctgggcaggttggggagggctagtcatggaacgaaactgtaagctggaccgggtgtgaggagggaaggtgataaaagtattatagggtggaggagtggaggctaaggaagaattgggacctagctctgcctggcgaggaggggaggggtcagatgggtctgtagaagaggaagattagaaagactcagcgacgcttggggttgggactgaggggacaggtgggagggaaagaaggaagatttgggatgagttgcattgggaacagagactagggagggaccgatgtgtaaaagaatgcctggacgtcaggcatctcagaccatttgtccattttacgacaagaattatttagatcttgtaggatggaaaaattgaaagtgccgttttccggctatttggaaccactgtcaagtttgtattggggtcaagcggcattgcaggagaaaataagatgcttagattttagatcaggtgagagttgaagaggttttaagttcttaagaacgcaggctaagggagaaggaggaatggaaggtgaaagcttgcccatagtgaaggaggcaagcccagagaaaagagagtagagacacggagaagaggtgggggttcttgccctccagaaaagcagagaaggggtttggggcatggaaataaggggttggggcacagagataagaggttgggggcgtggaaataagggattggggcacagagataagaggttagggcatggaaataagggatcggggcacagagataagaggtcagggttcctgcccctcccctagaaaagtgggacttgccactaagggtgaaggtgaaggggttgaggggttcttgcctctcccccagaaaagcggagaaggggtagagacacagagaaggggttggggttcttgcccctcccccagaaaagtgggacttgccgctaagggtgaaggaccaaagcaggcgtccctgcgtggactgacacctctgaaacctgggtgaataatcagagaggcatccctgcaatgattaaacaccaagggaaggctgccttccctagtccatgactggcactggagttttgggtccacggataaaacgtgtctcctttgtctctaccagaaaatgaaaggaattgaaattaagagaagggagagattgaagtgtggtgccaagattgaaaggagaaagaggttgagggatagtgagagaggttggagaagagagtaaaaagaggccgcttaccggatttgaaattggtaagatgtttcttgggctggtcagtctgaggacctgaggtcgtaggtggatctttctcatggagcaaagagcaggaggacaggggattgatctcccaagggaggtcccccagttcgagtcacggcaccaaatttcatgtgtgtccatgtgaagagaccaccaaacaggctttgtgtgagcaacgaggctatttatttcacctgggtgcaggcgggctgagtctgaaaagagagtcagtgaagggagctaggggtggggctattttataggatttgggtaggtaaatgaaaaaggggggttgttctctggcaggcaggagtaggggtcacaaggtgctcagtaggggagcttttgagccaggatgagccaggataaggaatttcacaagataatgtcatcagctaaggcaggaactggccatctggatgtgtatgtgcaggtcacaggggatatgatggcttagcttgggctcagaggcctgacacacactatagcagttcccatgaaaattagtgtaacttcctagataaataaggtatgaactcacaaggaattgtcatagaacaataagatgattccacatgacaacatggacctgtctcataagcataatgttgaatgaatgaagccagatatggaatacatactgaatgattccaattatgtgaagccttaaaacaaagaaaaataatctatgtagtcagaaatcagaattttagggtagtgtctctattgggtgagtagggcctggaaagcatatggagggcttctggggcattggtcacatcttgtttctttatctgtgtgctggttgcaagaatgtgttcagtttgtggaaacccatggagctgtatacttaagtgtatttttccagaaggattttttatactttgacagaatgttcaaaggatgtcctcttactgtgaacaacacaaatgattggagttataatgacacccttgctgtttgagggtgcatttttcaaaggattttagtcacagattcccatgttcactgaagctcaatagactatcccctacctgatgacaagtaatttgcttctttctttagtcctgcttttacctctggccatgaagaatcctgctttccactggtgagttcagaaatttctagcagcgatatttcttcagcccaaagtaaatatcctaggacatggaagaagcagtatagcccctgccacactctgactcatcttatccctgcaactcagttttctcattcctcaccgtcacttgcaggtatgaactggcaggaacctttccacagattttccagtgtctaatacaccatctaagaggtaaatagcctgactggagagaagctgacagtgggcagaaaggtctggcttatccaactggatgaaagctctctacctactttgggcagatgagtcacatgacattagcactttaaagacagagttagctatgccacttgtcttggttagctcgggctactataacaaagtaccataaactgggtgacttataaacaacaggcatttattcctcacagttctggagtctgttagtttgagatcaaggtgccagcaagctcaagttctagtgaccccctcttccactttacagatcccgtcttgttgcatcctcacaaggtgagaagagagtgagagagttctctagggctctctgttactggagcactaagcccattcataagggctccaccctcagggctcgatcacttcccaaaggctccacctcctaatatcacattggggcttaggattgcagcacatgaattttgggggaacacaaacattcagtccattgcatcactctcaaaagtaaagaggcttcttatataggaaagcattttcagtctttagaaatcataaagtaaatggttcacttgagtgaggcaagatgatcagtggggaaaagagtgagatctgtagccagactccctaggttcttattatggctgaaatctaggctgaatgggttaaaagtttatgtccttgtgtttcttcaatttaaaaaaaatgaaataagaaaaataatagcaacagataataaggatatagaagaactcaccttgtttaggttactgggggttatattaagaactcaaaatggtaactgttgctagtatatagtgtagagtcctctattcatggtagataatcaatagatgttgcctaatgagtataatttgtcagatgattctgatcttgtgggcacccctctttccctacagaaaactcttcaaactcacatagactttaggctgcaatcctgtctgccatgcagtttgctctcatctggcccttgcctcccttccagcctcatttctcactgctctctcttgccctttatactctagtgggacccacaggcttggagcatccctaacaatctgtctgattctccatgactttccttagcctgccccctccacctgaactgcccaccctgctactctttacttgagaaacttctctcttcctttcctttcttcagattcatcttcttcaggaacttactgactcttcctagtgatgtcaggctgagtgaggtgagccccttttgagattccattgtgctggagcataatctctgagcctatcatgtatctctctttcttcattagaacaggagctccctgagtgtaggaacagtggttttatcaccatgggatccctaatacttaaaagagttcttgttattaatctatcgaatgaataactgaaccaacaaataaatgacaaaaaagagacataggtggtgatcttccttagaactataatctctgtatttatatctagcattttcatttagaacatgaggaatagaaaaaaaaaaacataaaatgacccaatggcttttagtgtgtctcagttttaattttgcaaatctggtgctttgcttctatgagttaccagcaatgctagtcaactctgagtcagacatcctggtgtgtgggttttaaataatgcatttcctttacccttaggtggtaaggtgtgacatttgctgctttgataaaatctccagatgatggtacttacacaggtgcaataaggtccaagttgttaaccttatctcacttgcaaatctgcaatttcctttttcctcaccttctttttgagatgtgactaaagaagtgatggcaaggatgtgaaggattaggcaagagacatcctgggttgggagactgcattctatagtaaaaatcctttgtcctttatttcccaggttgaccatcagggtaatactactagctcattgctcagcttttcactttgctttgattggaagtcatcagtgacttagaaaaaaaagctttaaaaatgcaaaattattacttttcatcttagtaatagaagcagtagctttcttaatggtaatccactttttttccccctttggttttctttttagcaaagattggtcactgttgacttatctctcatttacttataataggtatcatgtatccccttgactcaccccaatttaagacactctctgataaaacctgtagtgctttgcaccttcaagttaattacccaagtatccctttctaccagatctcctaccctaagctcatcctatacagtatttctggaacaaccaccctaggcctgggtgattcatttcagctttcttcctccctttccaggagaggggaatagagtgcctgggggagagaatgggaagtcaagggtcttcagaggaaataagtggtttcctgatctgcttcttttccttctcattccttcctcttagcagaccctcagaaaacctggatttgactcaatagaaatacctgtattagccaagccatttatacaaatgatttttccccatgcttttctctggaccctggcagcaaaattaaactttaaaagtaaaaagttttaaatttcatcattaaatctgtatcacattaactttttcctgttgtgagcttttatgtgatttcagcgctaagctggtcaaatatgttacaatttcctagtccattactgttatctttcaccactatttagtcacattttgaaaaagttgacttagtcagatctggcttctctaataaaatgccacagactgggtggcttaaacaatggacatttatttttcagggttctggaggctgggaagtccaagactaagatgccaacagtctcagcggcttgtgaggaacggctctctggaattggagacagcctccttctctttgtgcactcacaatgccttttctctgatgcatgctctcagagagaagggcactaatcctatcatgagggtcatgctttcatgacctcatctaaatctaattaaccacccccccccacctcccccccccccggccacccaggcttcacctctaaataccatcacatcaggggctggagctttgacatatgaatttagggaagacacaggcattcagccataaaaatggttatgtgaacctgttgtgtttctgctgttaacattgcatggtcctttcatttagtaagtgtgttttgattagttgcttcttttgcaggtgtgtgttttgattatttgttctctttctataagctcaacagctagtgttgactaatagcatttaagttagtgtcctgaatagtttccaactgacccctaatccacacttcatcccttgacacactgacctctatgaattgtatcacctgggctaccccagccaatggtgggcactggcaggaaatctgagtacaggacaagagagaggtcaaggtgtttattattgtacctgcagatgctggttagtggtggctgtatccctcttcagaagtagccctctttcccagccatatttctcactgggctctaatcaccactttctcccattgccctgtcaggcccacaggtggccaaggctccccattgctgtgaacctcagggtgctttatcattttacaactttgaaaatagccccttcattaaattctcttcagttaccccttggagtgtggcaactctccctgtgcccccaccacccctcccattagcaacacataatgtgtagttcccattatgaaataaatggaggtgttttatcactttattttgaatcacgccaagctcccttggcagtgacacataataggggatattctccacctttgtggaaatggcttcaaatggatatgtttttgaaacgtggctttcaacttgcaggtttcttttctaaaactcttcaaataggcatctcttcctctttgttaaaagtaattcaaatgataagacagtaattatgattgtaataataccaatagcagtagtaataataatagcaatcagcattcgcagtttagaaaatgtttttgcatatgtgtttcccatcttatccccacaaaatcctccagtgatagttaacatttttttcctgattttacaggtgagaaaattgaataccacagagaaactctgttcttttcacacacctcaaaatttagtaaaaggcaggctaaattcaaatagggtctttcaagtacaaatcttttaactctaccacagcagaagtgtgtagtgaaaatagagagattaggaggtcaatgacattatcttcaatttgtgtttgtgctgagttcatttcaatagatgtccttggccctttgtcacctgtttgcaaagcaaatgaaaatctcatactcagttccggcaatattagtcattttcttgaaggatagctactggtttgtctgttttcctgagtccataattcagaaatcctatgaaaagatcattaacttgttgagtagactgcaaaatagacactaatggaatataaagtaattcaagagctttgacgtctcagttacaggatgacaaggagttatgtattgaatacacatttatcaccaggaaatctgaagatgttgaccatggttctgttcttttcctttaatctccatttcttgccaatccaatgtatttttctccctcaaatgcataggccagtatctgcaatacattgtgtttctacccacaaagttaaagaggaaatttcttcttcctttttaatatatgtatatagagagattgaatgcaatattcaaactgtacttgtaacataattttattacgtttcaaaccctattaatcatagaatacaaaaaaattcttttctagaatctcatttttctcttatttttcataaaacaaaaagggtaaagccactgggggaaaaatgtgtcttttgttgtataacgaaagtatgacctttaggaaaactcttctcccctattttcttctgatttaggttcattctctgcctttttttccctctctttgtgtgtagtcagttttgtcaaacatatgactctctggaaattttgcagaaataagagttcaatcaagactcttggaattttctatcttggtttttcaaaaatatgcaactctatatgttgatgtagaactagagtgattgaaatatactctttgacagagggtaaagttaagggtaatccactttttttggaagataagaataaaaatatggtttgctttattttgaggaagaccaaatggaaggagcagacaatcatttatttcacaaactctaattatgtaaggagattgattgattggtttttggttgatatgggagaatgattttttttcctgccatgcacagcactgggcagtctagttcccttatcctaagggagtttataatctagtagaggtggtataacacacatacacatgggcacacacacacacgcatgggcacacacacacaataaaaatatgcactattagcctagtaaagtacaagcaaggcactgttggagagcaggagaggaagatgctaaattctcagcgcagtgggagaggttggatcttggggcgtttgagttgactttcccaggaaaatactgaggaaggagaggtatttcaggaaaataaaataaatgagaactgcttagagtgttctcagagactaagcccaatggcttaataggaacaaaatgttcatgacaggtgcaggtaagagttatgttagaaatgtaaatggagacagggcatggaaagtcactgatacccttgtaaagttcaaactgtatttcagagacaattggaaccccttaatatttggccagggtgtgttgaaggtggttgaaaaagatgggacggtgacgataaggaggctcttacaattatccaggagagcattaagaagagaaacccccaagcttgggcactggcagtggaatggagaaagaggatgaatgtaagagagattctggaacaagaaatggtgaactatcatagcgatttgatatgagggcaaaggagctgtagacaacaattccaaagtttcaactaaaaacattgtagaaaccactctattgcaatttcggcaacttttcaagtttgatttatttggagagtatagtagagaacacacattttctgaagaagtactagtcatatttgtcctttgaccctactttttataagacctcctttagtgtcacacctatgaatcatttatttattcaaaaaattaatgacctcctattctatggcaggcataaacaggagaaaaatagacacgatcccatttaccttcacccttccacccatatcctctccccactatctgcccccagtgcttttcagtttggataaggagaaaatatcagtagaaaaactgacttaacccattatatcccttgatctaatagtattttttaaatatgtatttgaaattgggtccatttttttctggatacataaattattagttcctaatctgatctgcaacaatttcaggaaacaattactgaattatctgtgcttaatttgagcagatgatagctaattccatgtgcccagaacctatctttgtaaattattttgattattttttttactagagagatagaagttttgcaggaagttaacatggatcaaggagtggatgacacacacatatgcatgtgcatgcacactgttatacaattgatgaaaatgtcataaggtgtaaggagcagtagaagtttttattagatagttcacctttaaatcctggttttgcctcattgccatgtggattggacatgtcagttcacctctctgagtctcagtttctacatatatacaatgggactaatcttcagctggctgtaacaagaattaaattagataaatctgaaaatgattaacacaactgaggacataatatgctcaataaaaaaatcatttgcaggtcttttgggaatggtacaaactggacctaaatcaagttatattattatagtacgataatttgagttatatttatataatatgaaaattattaataaataattgtaataacatataataatgtaatataatatagtataattaataaaatattacctcctacacactggttaaaagtgttcatgtactattaactctagttaaaatcttcgtgtgtttcttctgatcttagatcaagaggaatctcataatatttgtacatactgcccattctaagtgggctactagtaaatatacaaagaagctgtaataagcatatggcttagtatagaagagaagaaaaaatccagtaaattacgattttcttctaaaaaacaccatctggatgctggttcagctgcattatctcactaatttacattttattttctcaagagacaaaggtatattcaataaaagaagaaaatccagtttagaatgcttgtctctggaacctgtcagctacacttaatttctacgtagatgcagaaatgaggagtttcctcatcaatgtttaaacaaagcatagaattaatcactcaacattcagaagaatcaaagtcaaaatcaaaataagatactttattgaatttatctctccctgcagtttggaatttaatcctgactagaagtcaaaacaaatgcactttttagatgttgataagatgaaaatcaatcaatcgatataggtgttgtattgtattaaaatggcttaatggggttaattaaaaaccatcttagaaataaagaagataaaatacagattactattctaacagtagaagggactaaatatcgtgaagagtcttacagctgaaaactacctagaagctgagtaataacggacatttgaatgacttgctgcgctttcaagaaagtaaaggagatccccaagtttttgtttttgttttgtattgtattgttttttaaaaaggactaggagcagaaagaggagtggtaggagtggtaagtaagagctgaggctcaggatgacttgaaggcattgtgaaaattaatagccataagagaaaatggaagactagaccttgaacctggacaaagatacgtttgaatctgagatgtttgcataaagttagacactaagaaggttatattcgtggtgaaagggtggtccaggaaaaaaatccacctgccagcaaagagagatgtcataaaacctggctatgtccatgactactacaaatggaaaatgaaagtagaactaaaactcagaattcttcttgaggatttgtaactatcgacattgcttctgtggctttgtggttcaaacccttagcacagaaataaaaatgatttcttttttggaactaccctctggcaactgacagaagcaacagtaaatgctgtgtggaggaaacatgcttagataaaataactctcaatacgtatttgtgtatgtagaaaagttatcttttaagagcaagaataaaatagcatgatttcagattaacaaaaactgggtaagtttataatcaacaagttcttcctaatatagcatgcattcagggagaaacacaataattgaaataatatcaaagaggtttataagacaagaaagcttggtgataacaaaggagaaatcaagtgtaaataaacatgactgtataaaataatatgcattaaacattaaatttggcattaaacaaattagatacaacaaataaacagaataccatggcaggtaagctgaaaggtagatgatctaagttaaagcattttaaagcccttatattgtttacaaggagattaaaataatctgtaaagtctagtaaacactgaaactataacatgaattttaagtttgaattgaacagaatagggtcagggataatcagtgaatccaaagaaaagacataagactggaaaaaagagaaaataaaaatgaaaagacatatagtttagctacctcaattatcaccataagcataaaaagactaatttccctggttaaaatacagagattatcagaagattaaactattcaggaaaaaaaaagaactttatactatttacaagatttgtcagaaatactatttaaaaagatatgatgttattagacaatcaaagattgatatgactgttagaagaaatgaacaagtctataattttagtaggagatttagaaatagcattctcactaattaagaggtaaatctaatacaacaaattagaagctttgaatagtacaattaacaagcttgtaatttacataagtatagaaacctgatcttcaaaattagaaattaatattttctgggatttattgaatagtcataagagttgaccatattctaggccaaggatcagcaaattatggctgacagacctaatccagctcatgtcctgtttgagtatgaccctcaaattaaaacctttttttttttaacatttttaatggattgtaaatttttttcaaaaagacaatgtatgacagaaaccacatgtggtccacaaagcctgatatatttactatgtaaacctttacagaaaaagctgactcatgttataggccatagagaaaagtccaatgtatttcatatgtcatcattcaataaatatttatcaaaacccattatatgctgggcaattctttaggcactgaaaatgatagcacagtgaatgaaacagacaaaaatccttctgaggacacttgcattctactgggggaggcagacaaaaagtaaagtaaataaataaaatacatagtgtgtctgatggcaatcaatgttaagaaaaaaaatcagagaaaataacaattgttatttcgcaaaatttaatactcaaaggacatacagtgagccctccatatctgtgggttccacatctgtggatttaatcaactgtggatagaaaatattttaaaaaaataaaacaaaagttacaataagaaataattcaaataaaaatacagcataacagctatttaaataacatttacattgtattaggtattataagaaatctagagacgatttaaagtatacaggaagatgtgtgtacattattttctaatatgccattttttataagggacttcagcatttgtggactttggtatgagaaggtgggaaggagagaggccttgaaccaaccccacaaagacaggaacaactgtaatttattggttaaaaatcataataaaaatttaaaaacacttagaactgaatcataataaaatcagtacatattaaaatccttgagatgcaatcaaggtgtatgtttaattttacatgctatattagaaaaaataaagattgaatattaatgaggtgtaaggctaattgaagaagtaacaggctgggtatggtggctcatgcctgtaatgctggtactttggaaggccaagacaggaggaccacttgaggccaggagttcaaaaccagccagggcaacatagcaagaccttgtctctacaaaaaataatttaaaaaagttagccaggcatggtggcttgtgcctgtagtttcagttactttgtaggctaaggtaggaggatcacttggtcccaagagttaggggctgcagtgaactgtggtcaggccactacactccagcctgggcaaaagagcaagactgtctctaaaaaaataaataagccgtaaaaatatcaatatcagcataaatgagctagaaggaagaaagaataagaggtagaaattactgaagtcataacaaactatagagaaaattgcagaggccacaattcaacaaaaaagttgtttccttagaaatagcaatgaaatatctgctgagattgatcaacaaatatatatataataggagtgaaaattaaaatataaatgaaaacaagcgacaaaaacatttcacatataaaggtaagaaagacttgacaccggctgggtacggtggcttacgcctgtaatcccagaactttgggaggttgagacaggtgaatcatctgaggtcaggagttcgagaccagcctggccaacgtggtaaaaccccatctctactaaaaatacaaaaattagccaggtgttgtggtgtgcagttgtaatcccagctacttgggcagctgaggcaggagaatggcttgaacctggaaggcagaggttgcagtgagccaagattgtgccactgcactctagcttgggtgacagagcaaaactgcatctaaaaaagaacaactagacacaaataaattcggaaacttagatatgatgaacaaataggatccttggggaaaaaagtgtaatttaccaattgtgacttagaattattgtatctggttttgtaaccataaaacaaattaattcagtagtacaaaaactttccccaaacaaagtgacacttattatgcgcaggcaatttctaccaaactttcaaaatcatttcaggattatttcataaaatcattccaaaaatatgcacgtttccaaacttatgttaagaggccaatataatcttcatgcccaaacccaacaaaggcagtgcaagaaatgaaaagtgtaagaatataagggtttttttaacattaagaaatatattaaataattttaccgtatcaaaaattcaaaataatatgctcaaactagaagcagtccaaatgtctatcaatcaactggtaaatgcaatgaaaaggaagaaactatggatacatattacaacatagatgaacctcaaggatattacgctaagtgaaagaagccagatgcaaaaggctacatattgcatgattctattgatgcgaaatatttataaacgacgtatccaaagcagaatagtggtttcttgcatgcagctgggggtaggaacaggtattgactgcaaatgggcacggaggatctttctggagtgataaaatgttctaaaaccagattggttggacaaccctgtaaatttcctaaaaaatcactggattttactacagtggactgaatgtgtacttccaaaatttatgtgttgaaaccttaagccccaatgtaatggtattaggaattaaagcctttgggaggtgattaggttatgagggtggaggcttcatgagtgagatgaatgcccttatgaaagagaccacagaaggctctctcttttctgaaatgtgaatatgcaagaagttaggccttcaagagggcctagaagagggccctcactagaacccaagcagcctggcatcttaatctcttccagcctgaagaatgtaaaaaataaatttccattgtttataagtcaccagtttatgctactttgttataatagcctgaacagactgagagatttatgcttaaaataatttaaaggagacaaagtataagatcatctcaatagaaacaaaaaaaaagtataaaatacaacaatctatgcatttttttaagaatttcaaacaaattacagataaaagagaacttctttaactagattaagggtatttatttagtcttaaatatttactgttgaaacattacaagactttcctttaaaaatcagaaaaaaagccattcaagattatgatgtgggtcttagctagcaaataatttcaagaaacagaaatgaaggttttaagttaatacttaaattattaaatttaagtattaacttattaaatttaagtattaagtattaatttaagtatttaatttaagtattaaatttaagtatttaatttaagtattaaattatttaagtattaaatttaagtatttaatttaagtatgaaattattaaatttaagtatttaaatttaggggaaaaatactaaaattattctctgatgaacttattgtctacatagagcaaaaagaatcttcagaaaaattactggaattattaagaaagttcaacagagtttctgggttaaaacacaaaaaatacattgagtttctatacattaccaaaaaaagtgtaaacagtcttttaaagatacaagaagtgtgtaaaagtgaagtaaacgttataacacttctgaatataaccaaagtattgtatatctcaggcaactacttacttctcttaatagtgctcttttaatcatcctagctttatctgtatttgtgaaaactcataacccctacttagcattagttggtaaatgttgaaatttaagataaccttgtttcctgcaaagcactgttaagtggaatgctctggttccagaacattttattcttcctcctcctcgctgtattcagtcatacatcccagaagagatcagcaaaaaattaggaagttagaggtttacatttgtctttaaaacctactcaaaaaaatatgctttttacaattgctcttcagaggcctcccctgctctcattatctactataattacattataccttctgaaattctatatcaaaggtcagagcagaccctttaggcatgaaatgattcccagctcttcacggactagaagttcaaagtgcaaaaaatataattcactcagtttatcctcatggctccacccacccaggttttttcttacaaacacaccagttctgacaacctgatgttctttaaaccgtgagtagagatattgaagtaaatgagtctaccaggaacagaatttcacattcagaaatattaggttgtattcttcttgagagcaggacatctttttacctttgcagagaccacaaaatctggaaaaataagcactggcagaatgtatgtggaatatgtaaaattagatacgaagtatacaaggtctttcctctgtccccacacctctctcaatcataaaacaaaagtagaaataataaatagcatgactaggtaaactggcatttgaaatacataattcttataaaagccagcatgaccgtggggtgtgtaagagtggtgtttatgttactagcaaagctccttgctcaaagcctggagggactaaacaataatacttcacatcagcgtgatgtggtggagcgatcactgggctaaaaatcaagagattctgggcagttctgaccttggagacggcactgactatttctctgtcacctcaggtaagtcacttactttccctgggcctcttgattttaatacatataaatcgagggcattctaggatcctaggatcctatgccaaggatgaatacactttctgtgctgccaaaagtttgccgacatggtcagctaaaagcctcttcctctctccacattgtgggatgtgtgtgtgtgtgtgtgtgtgtgtgtgtgtgtgtgtgtgtgtgtgtgttgacatgaattatttccatcatttaaaaactcagaaagatggaattgaaagcagggactcgaacagatgcttgtacaccagcgatcatggcagcattattcacaaaggccaaaaggtggaaacaactgctatgtccattggcagatgaatggataaacaaaatgtggtagatacattcaatgaaatattacttagccataaaaagaatgagccaggtgtgatagtgagttcctgtagtcccagatacttgggaggcagaggtgggaggattgcttgagcttaggaatttgagaccagcctaggcaacatagcaagactccatctcttgaacaaaagaaaaaaatgaaattctgatatatgctagaacatgaatgaaccttgaaaacattatgttttgtgaaataaaccaaatccagaaggacaaatatcatatgattctactaatatgagatatctagagtagtcaaattaatagaggtagaaggtagaatggtggtttaaaaaggctggagagacagaataatgggaagttattatttatgggtatgagttcaatttgggaagatgaaaaagttctggagacagatggtgatgattgttgtacaataatagtgatatacttaatgccactaaactgtatacctaaaattggttaaaagggtacattttatgttatgtatatttcaccacagttaaaaaagcagctcaggaagatgaacaaaagtagcttgtgtttgtatttcatgctaagaatgcattctatttctcttttcccaacttttttaagaataaagttcttcagcatgacatcagatggaggggaagaggagtggaggactatttcttgagctactcaagtgaaaggaagtgcaatacttttcagtaagctgaaaataagctggagattttcagtttttatagtcttttttggcctctggattgctagagttcattaacagagccacgttcttggctaaggggccaccgtttttcttgaaggaagtaactgcaccagccactatcagggtacaagacatttatttgcaagaattaaaagaattagcacatctctgggatgacccagttattgcagagggatttaagcaaggaaattgtctagttttctctaagaagaaaaaaatcaagttgtctttacttaatgaccactgatgtagttttagtcatatgtcctgttccagtatatctgtctttttattgctatgcacttttagcaaaattacaagatgctttattgatgataggcacaaatgacctgaaagcttttttttttccttttatcagatgtgggcatttccctcagagacaattctggtcttttaatgaagatgaatgtatcagtgaactttgttatttattgatgactttcctattttctatgatggttttgttgtcactgtattttacttaggttagttatatccatcaacataatcttctttgttggaatactgggattaagatcaatctatctctctgttagttttatgcttttgctgcccaaagaaagcaacatgcaaaacacggccatgttgccttacaagccagatggtaatcagtagttaatagaattggaagtacagttaaggtttattcttgtaatttattcaaaactcaacaactctttaggttagcttgctaatttataactatctagtttttcctaaattcctaaattgaagataaagctgaattcttttttcaggataatagagcatgtattgttcagggttcaatttaggaagaaaaaccacatgaatattatgcaataagggacttactagtgacctaagaagtcatacaatatttgagaaggtagagaagtagagattaaagcatagcatagggagatcagagaaaagtcactacctacccttctgaagcactgaagcctacaaggataaatgagaagtcaggtaggaccagcttctggagagaaactgcagaggaactgttgtgcttgcatctgatgatgggtctggtgggcctggtagtcagcagccctagaggtctggaagaagagctggctgtgcacagggagagttaggacatgctggctcctcaccatctctgaccaggaccatgaccacctgaagagagcaagggcagctgcaccaattcatcctcagagctcccacagattcatactctggccaactcaaaccagagccatttaagttgggggactctgggaaatgcaattcctgcacagccatgtgacacagtacaagccccaaagaacagtgttttcagttgtcacagggaagaaactttagggttagcaaaggcttttcagcttccccagagaaaagctgctgaagagttgaaaataccaagtgttccagcattaacatggtgctgaacacctagacaccaacccactgctggctgcccagcttagagagagagattggcagggctgttgagcaccaggcagttagcctgggtggaaagttttactcagtatggcagggcggtcgctgtcatctaagaccatggaaaatttcagagaccctaagctagagtaaagtaggaccctaagacgacagccagagagaggaggagagccaagcaaaatccccctgggggacctagcgtggaggaggatcctaagaatcttcttcccaaatcacttaagttcgaggtttctgtttattggcagtacttagactggcctatttcatcatcatggtctctgtaacctcttcctccatcactttccctccatctccccctctattactcctccatcacttcccctctatctctctccctttgtctttccctccatctctcctcctccaccactgtctctctagctccctatccaaatttgcccctccatctcctcccctccatccttcccccacctttctccttgtgtctctctttctccatttctccccttccatctctccttcaccattgctctcctaccttcccccatcactctccttatcaccccctgaccccatagtcacttttacatagtaacaagattcaataagctctttgtagtattagaatcttcacaagttgcttcctgatctgcaaaaacttaacttgtactttctttagcccttacatcccaccatcccactcagtctctcttctctctctctctcccctctctttctctcaattgtttatacttcaggtctcagctaaaagtcacctctccaaagagactttctttgaaaacactttaaatgaaatatgttctcctccttctatcccattattctctatcactgtgttttgttctgaaatccttcctgacattcccacaacttaaatgatgtagttgtattttcatggctcctttgtcccacacactacactctaagttccctgaagactggaccaggtccctttatcagcagtgtctacccagcagctagcacaataccttgcacatggaaggtgcttattaaattcttcctgaataaataaatgagtgaatgaataaaaaatgaatgaatgaatacagtcaaattttagagctttccagaagggaaatattaaataagcatattctaattaatttttttcttaaaagacctaagctcaagatggtttcccattttgatttttgagatcaatcataggagtcagagaagcattcataagacagtgagaagcttctaagattctgtcatagttaccagggatcccaaaatgtgtacaacagtggaggaagaggcaaaaaggaaaaatctgcaaatcttgtagcctcagggactccagtggaaaaaaaaatggaggttggtgggagtcagttaaagaaggccaaaaatctggagaccggacaaaacaagttggggaaggaatattgagatctaccaagagaaattccacttgcctttataaaattggtaaatatttctttccttctctttccttttttattttagagagagggtctcaacatccagttgtgcagtcatagctcattgcagccttgaactcctgggctcgagctatcctcctgcctcagcctcctgagtggctgggactattggcgcctgccacaatatttggctactgttttgtttttttttcttttgttttgttttaattttgtagagatgggatctcactatatttccctggctggtcttgaagtcctaggctcaagccatcctctagacttggccttccaaagttcttacattagaggcgtgagcccctcacttggcaaaacttgtaaatctttatggagtgcctctcttgaaaaagatctgaacattgactagtcaagtgcagattaataattatcagcaatttattagcaacctgccagtagagccatactaaaatgaaaatacaattaattggggaagcattactgtgtatgtggcttgctgaaaatttactattttactaatctgtaagagaaaatgcttgaaagctttcatgcatgttatgaataagtttgcccccatatttcaagtgacataaaaaccattcaaaatgaacagaaacttaaaagaatattaattaaaaaatataacgtgaacatatataaactgtgtgtgtgcctgtgtgcgtgtgtgtttgtgtgggtctgtgtgttaaactttttttatctttttcagggactcaaatattttgcaaattttaaataataaatctatgaaaattaatttaaccctagactcaaagaaattatccattactattcaactttatctaatatataattaattttgcacattgtttctaaatagttgcaggtttggattatgatttcctgaaaatgcttcctttgatatttgcttggatgagaaagtgagaactcactcactgtatgtttgctaaacagacctatgtagttaaagagaagctgtccaaaaagattctctatttcagcccaatggagcatattcattatcagatcaaagtgataggattttttttatcttctcctaattgggggtaggcaatttccttactcactttggcaaatcgaaggaatgtcttattgtagagaaagaggctgtgatccctaaatgtcaatgcaaaaaccttcatcacatcactcttgtcccatgtagcacagagaatccattccattaaggtgaattctggaagctggctgaatttcaagctgtgttttaattcaatttttttttggcagacagttttaaagggaagtcaaaggttatagcttgataattgggtataaatacagtcatttcagtgggcctcagattcagtcatgcagaaccaatttttagcatggtgatatcacggttgcatatttttaattgaagcactcataaggagtcctactgtaatctgagtattactacatttttacccctcatgaactcaaagtataagttaatggtatacaatgaaatgttgcattgttgactttatctttcttacctacatgtctcctgaagcatagacttcgagataaaatgttttgttcattggttaaaaaagtgtctgtattctctaagctactaatcaataatagaagtttcttttataagtctgagtgcagcataatttatcactgaaaacttacttcattgctaaagcccaaacatatacacccaagacttttaaatcatgattttcctaatgcttattgtgcatttaaatggtaattttagactatgtagattattatataaatgacaaatttttattatttttacactcaagtgcaatgtctcgtcttaatataaaatctttaaatgtatggtttcttcatatctgttctgctttcttctatttgtaacaaaatgttacttgtggcctttattatttaggagaagaattttaaattgattaagataataatccagcacatattttttaagtaaaatatatgagcataaaagatttgcatggccacattttcttaatccagtctatcattgttggacatttgggttggttccaagtctttgctattgtgaatagtgccgcaataaacatatgtgtgcatgtgtctttatagcagcatgatttatagtcctttgggtatatgcccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtgtcctgactttttaatgatcaccattctaactggtgtgagatggtatctcactgtggttttgatttgcatttctctgatagccagtgatggtgagcattttttcatgtgtttttttggctgcataaatgtcttcttttgagaagtgtctgttcatgtgctttgcccactttttgatggggttgtttgtttttttcttgtaaatttgtttgagttcattgtagattctggatattagccctttgtcagatgagtaggttgtgaaaattttctcccattttgtaggttgcctgtttactctgatggtagtttcttttgctgtgcagaagctctttagtttaattagatcccatttgtcaattttggcttttgttgccattgctggattaagaaaatgtggcacatatacaccatggaatactatgcagccataaaaaatgatgagttcatgtcctttgtaggaacacggatgaaattggaaatcatcattctcagtaaactatcgcaagaacaaaaaaccaaacaccgcatattgtcactcataggtgggaattgaacaatgagaacacatggatacaagaaggggaacatcacactctggggactgttgtggggtggggggaggggggagggatagctttaggagatatacctaatgctaaatgatgagttaatgggtgcagcacaccagcatggcacatgtatacatatgtaactaacctgcacattgtgcacatgcaccctaaaacttaaagtataataataataaaaataaaatttaaaaaaagatatgcatggcaaacttttacaatgaatatagaaaccatgaatagtcattttaccacccaggtttcttgtataattacactacttaaaatgtttagttgctgaatgctaatggtagacttagtcatattgacttagctattggaaaattcatgaaatataagatgactttgtgcctgccatttgggggatgaaatagaaatttcagagagagaattcaagcaaagagacattacaataatttatgataggagttttcatgtttagttttttatactgatggcagtggcggcccatctggaggagccactgcaaagacactggctgcaatggctaggtgcaaccatggctgtgtgctccatagagccagtgggggccaggaacaggcgggagccccagcccctaccaagttgatggggcaggagcccagtgttcctgggtgcaacagcagctgcccgactgtggctccagacctgggaatctctgcactctcggaggcctgggaagccctcctgccccaacaggcttagaagtgcctgcttctgccccctggcctctccctgctcccagtaccctctctgctgcagagcaaagttgtggctgaggctgggtgctgttgcaatgtggccaggtatgtgtattctcagaggtgctgacacgccagccccctgctgccttggccccctctagactttgggaacccaggagcatgggagggaagcaaaggaggggctgagggcagcttagtgtgggcctgcaggtaccccttggcaggaacagcctgggcgttgtggatggcatgttgatggcagcagaaggcagacaggctcctggacaaaaaggggcaggtccctggtgaaatcccaccttcaagcctgaagcctgtgggctgggctgccagttcctgatgaagtctgcagcccagagtgagaacttatggtgctttttctggccctgcccatggccacctatggactaatcagcatgcacttcctcccttatgagcccataaaaaccccagactcagccagacttgaacagacctcaggactaccagctgcaggaaggagctactgcctacgagtctcctctctgctgagagctggacactcttagggatgacctgcttgtggaaatgagcttcccacttcgggtctcctgagggctgttctgtcactcaatggagctcctctccacattgctcatcccccaattgtccatctatctcattcttcctggatgtggaacaagaactcaggacatgccaaatggctgtaacccaagcagaactgtaacaaacagggctgaaacatgctccccctccttccatgttgcaggcaatgagaaggagagaagagctgcatcccttcagggagtccagacctagggaatcccctagccagagctgtgacaccctctttggggctctgtggttcctggcatctccaaggttccagatgccactatattcccctcatctagacatgggtacacacagcagaagctgtgtgcagtacatctggtccagttacagccttgaatggagctggcacctgtgccagtgtctggagctgcccaccctactgccacagcctgcatgcctggctgtgcacagtgaccagaccctgcactcacttgcccacacacctctcacttctctgtgcctggctcacctttggtaggtgtgggatccaggacagtagcgtgagctgagtgcagcctgctgggccgagtgggtggaatgagcccagtgggcgtgaacaatactcaggcagaaaggtttctggctggcaaagagacactccatagatcccatgacaatactatttgaattgtgaggaaacaccagattgttctagaaggttgaatacgcactggtccaaacagatttcttgccttcctccctgcctgttgggggtggagtggaaaggggaaggtgaagattgtcattgtgtatgcatttgttttaaacctctgtagcctgactttccaaattgaaaaatacaactctgccattctgtgttcacacatgtcagagctgctgcagaaaactcctctttgactcattcatcgccattgaatctgaatttattttcagtggtatcctgacaggaactttaagactgaactctgcattttttctgttttcccagtcatctgcctcattctatgttgagggtttcactaatgaatgtgatgtttgctggtaaataagtaaataaatgcacctgtacaatttacttccttttctggaaagacagaaagaacagaatactagcacaagaaaactttttttttccctcctcttgcttggttctacttcagctcagttacttttgacaaagaaaatgaaaatttaaatttccattgaatgaattggtgtcatggctattatttaagagtatagaaattaaagctgcaattgggtcgtgtatcatttgcttaccctagatgcacattatatcctggtataatgaaaaatggcatgcttttttttttttctttctctgtagtgaaccataactgaaagcaggaagcattggtttacactttgcatcagagttgtgggatttctatatgggtacagtagtcagaatccattctaactgtgaatgccagaaacttaatttctataaaatgtaagaaaaatatgagagtgaatgtactgcctcaggttacttaaaagccgaagcagtgattgtgacttcaggtaaggcttcatccaggcataaaatgattgtcttcaggtctccagttctttctctccttccttctcttgatattgtattactttatggggactgtctcatgcaggtacttctcagctggcaggaaagatgcctctaccactccactctaaagtaaccttagtagtggctaccactctgtaagtgcatcttatgggcatccttcttcaaactttaatgactatgaggtatttacttaatcctcacaattattctgtgtggttatgacatttgtccaaagtcacagaattataaagattggaagtggatttgcctagctagtttggctccagcacctatgcatgcatataacccttgctctaagttgttacgctagagcttgagatctacagaggagaaagatgctttctctcttttaacctccctatcaatcctgaaaatgggatctgatgtctctgcatgagtccttgctcaacctgcaccaatctctgtgtcctgcacctcctcccatcagcatatgatattcatccacaacagctgaggggcaggttcagaagggaaaatgtgcatggcagaataaaatgttacaaatgaccactacagcaggccaagctgccaattttccagaaaggtccctggcattgcaatgttccatatggaaagcagctcatctgggtaagcatgcttttccatggctctctatgctttgtggtaatgggtagtgaccacagtatagcaggggcaaattgaacagctgaagaagaggatggaagagaagacaggactatgaggaagcataagggaggattgggcaagatggaggcagacatggtgtggttacctgagcaaatactgtagctgctaaaattcttagataagcctgaggttactttaggctcctatataacctagattgagctaatcagaatttcacacaaaaatccagaatagtgattagttacctttcgtgagagtattgactggtaggtggcatgaaggggctctctggaaatattttgtatcttgcctagggtggtggttacctccatgtaaatatataggaagttatcaaatggtacttaaaatttgtgcactttacctcatgcttgtgctagcttatttttttattgacagatataaacaattctacctgtgcagagacaagccagattgtttagtaaattaccatccagatttcctggattgcctagttaacaagctacttggaatcaaagccccccactcctcccaccctctcccggaggagtgtctgcacctgaacccaagtttcacaaattgccagatgctagcagctaacactcccagacatcagccctaaaaaggtggcatctgggtgcagactgttttgcactcacccccagactgtttttaccctgcttacaagacagctctcttctcattctaaataaaggaaagtggcccttctccaagaacagcctacggtgcatccagctggcccagccccaaggataccagtccacaggatgctgagagcacagggactctgggtactctttttccctcctacctatgaattacagcatgctgcaagtgatgctattaatgtgtttttggcattgccaaggtcattcttactaaccaacacctaggccttcttgcattttgatattattggacaatttaaagattcccaaattgcatctctgcgttaatgtgttagggatgccatgacaaaataccacagaccagatggcttaaacaataggaatttattttcttacagttctgtagtctggaagtccaagatgaaagtgttggcaggtttggcttcctctccttggcttgccgatggccaccctcttgcttactcttcatatggtcctccctttgtgcacctgtgcccctggtttctctcgcttttgtgtctagttcttataaagacaccagtcagattgcattagggttcatccaccctaatagcctcattttaacttaaccccctctttgaaggccctatctccatatacatttatattcagaggtactggggcttggggcttcaacatgaatttggggtgggacacaatttaatccataacagtctgttttgctggaatcaactacaatgactgttgattacaaggaacctgaaaatacttttttttatccgtttagctttttgctcagtctaattgaattcgtagaaatttagatggggtatagttcaagctaattatggtgcctgtgcacccagacaaattgtggtacaaaatctaaacttctatctggtgaattaaggataagtagaaaattaatatcatgtaatgtttgagaatttcagaaatgaattcccctttatttcatttgcagctgttagcctggaggaatttctagttcaacagacacaccatgcacgatcatgtcactgggcctttgcatgcaccgtgccctctctgggaacacttttccccctatagctaattacccagcttttctcttctctagaagctagttttgtccttacatctaaatatctacgctccgtggttacaggccagactggtgtcaaactcctgacctcaagtgatccacccgccttggcctcccaaagttctgggattacaggcgtgagccactgcacatggccagcatacagttttaattcaacacctcaaaatggacagcatcataaaattaagaaaatgtgatatgttttttctagttataatcatcatgttctaagtgcaattttatattccaattttttattaattatgtcgtaaacattttctgtgttactacagtgacttcttaatgattttatatgcagtggtcccattaatttagtagaataaaagttacacatgtttttattgtgcatttgggctgtttttcattacagttgtccctctatatacagggggaccttgaccacaccaaaatcagagcagattcaagtcctacagctggccctgcagaacccgagtatagaaaattcagctctccatatctacaggtttcacatcctacacagactgtattttcgattcacgtttggcggtggatgcagaatctgcagatacagtgcattgattatatttattgaaaaaagaaacctcgtataaagtgggccttgccatttaaacctgtgttattcaagggtcaactgtatttgcaattatagctaatgctgcaataggtatcttcttcctaataatagctattaattaatagaataaaatatcaggattcaggttgagagacaggaccatattgattactctggattaatattgtcattaatgcttgtccaaagtactcaactgccaaaggccaacagcagtgtgttggggttatatgtctatccttttggattaaatgttaagcaatgaattttagaaagtgtgtgtgtgttttccttccttttacatatactatgttatataacctttttttgctaattctaagaccggcccgttagaactattttgttgttgtatttggatagcatgcttggattactatagatggtgttccttattttagtactttctaggaatgcattttgatgtgaattttcacattcaagtctgagaaacattcctcttcctgttgccttatatttttacacatctcaccatgtccatcccttgactttgctttttattgctaaattcaattcctcttggaaatgacgggcctctgcatttgcagttagttatgcctttgaagaagattatttgcctcccttgagtttgtgatttcctaaatccagtgaatgctctgctcaaagaaagtttccttttgttgagaatcaattcatcactttgaaaaaaaaaaaaacttatgacaaaataggtggtcagatcatacccctagagtacaggaccttcacatctgttctgctgtagaattgagtagaatgaaaatctgaaaccagatttgtggttagcaaaagaacagaccctaaaaggcaatagtctaagtaaaactctgcatccaatttttattgcttctgctgttttgcttcagatatcttttcatattcctaagctgtcttcccatagtaacaaaactataaattcatttagtgggggataagaatagtggagagagggaggggaataaaaaatcaaatgggttgttggagcaataaagctattggtaagtttaatgctgactttaatctccagggtaaatgattgtgcaattgtgtcttacatttacaatctagtgagctgtgaataaaggtggtggggaaatatgtaaaaatgtgggccaggaaaccagctaacaaggtcataagctcagacacaaagaacctagttgattttcctggggcggaagaccctgaatccaggatattctaatcttggctcattagaccttaatgagggaagaataatttatatcaataagccaaaaatttatcttttctggcactcagagcacaggagcattatttataacttagaggcatgcaggtgtgttcccctaggcatctctttctatcaatattttaggagacttcctgatttgccgtggagaaaaactggagacatctggtattgtgtaggatggttgatacttttacaaaattcattcattcacatagcatttctttactcattcatttaatcttctggcgctgacatggaggtactctatttaggatgtgttcaccgtaagggtacatcttaaacatacctatgctttcattgatgtgacgtctataaacatgtacagacaggtacctgcaggtaaatggacaaattaaaatatcattatgagctacatggtcaattcatcattttttccagtcagaagctttacttggtttactttgttgtaaaattgtaactgcttttgtacaagctgccttctgtcctcccattctcatttccaccaccatctatagaggtatttggttgcatttcttgcctttattagcccacatggaatggtggccagatcccagaacttcagaatacacttacactgcttgtgttaagtaagagggaagataatgcagtgaatgggaacttgttgtcataaaaataatcacagaaattctacattcccattcctcagcagttaaaaattggatcttgccaggtatgatggctcactcctataatcctagaactttgggaggctgacgcaggaggatcgcttggggccagaagttcaagaccagcctgggcaacataatgagatgccatctcaataaaataaaataaaataaaatagttaggcatggtggcatgcacctgtagtcccacctacatgggaggattgcttgatcccaggagtctgaggctgcacactagcctgggcaatagaacaagaccctgtctcttaaaaaaaaaaatagatcttatttactatattgcactcggatagttattctggattatcctttccccatgccccatacctctagtatatactcaaataaagctattctttctgaaataattatcttttatgcagaagtgaagagagcagagagtaaaacctcctgatgtccattgcaatggctagaccagcaacattgtcttaagcccaaaacagtaggcagcatccagaatgataggcttgtggtgttcccaatcacatcctgaacaaaagcccttgttttatcacaccacaaacattttcacaagtgtgcatcttcccctggaacagatacagccactacctggaacaagatgaggataacctatcaaataaacacacagtcactgcatgggcctggagccccaattcttaatggcttaaaacgaaggagtgtcaaactcaactatctgctggaactagactgggtgtgaggcaggagggagtgggggatgctgcataaagttaaagaacccaggccttatttaaagggatcagatgctactcagtctgaatcattccggatagcgaatgtttcaaggaaccctccccttttaaaaattattagcaacaaaaaattcaactgtttataatactgtgcggaccaacactgccttagacaaatataacatccaaaggaatagattgggcccatgagcttactgcccctgcttcatgatatcctaactaaaagtaagctaagagaacaattctatctttaggggaaatactggggttgggtgccttcccatggatttgtaaatctaactcatgtcatccccttcaaaaggaatgacctgctctgtccactgccccctgtttttacctatcaatattttacccacatgtgtcagtcagaacagggtagttgctataataaacaaccccagcatctcagtgacctgataaaggtttatttctcattcacacaaaggccaatgtcatcctcctagttgagtgagtctcctgtaagcagtaaacttggggatttagggtccttcaaacatgtggttctaccctcccaagtcctccacttctagacatgtggacaaaagagagaaaataaaggataacgtggaatatttcatggctggacctgagagtggccttcacagctttcatcaacattggccagcactcagccacctgatctcagccaggtgcgacaattctgggaaatgcggtcttcccagttccccaggaggaaagtatcaagttagttttcacaggccagcttaaaaacctcactgatccaagagcactctctgataatgctaattagaaatacgcttgcccttccattcaattaatatatgtttaaaatacacctgcaagtcatattgttggccctagagacaaaatgataagatgacctccatatctttcgggagctgttgtttcagtagggaggcaggcattcaaacaactctatgataatatgatgggagctttaatggactactaaatacagtgggggcagatttgaagaaatgctctttaaccatgtggagcttgacactttgttgattgcatgcacatcttgtcttgttactgtatcataggatccttaagtacatagatcatactctatttatctttgtatcctccctattaccagacatctaggggttcccataaacatttgtcaaattgatgaatgaatgagtttctgatgaaaagggaataaacacagactcaccatttgagaagaaaataattagtctgtcagcttttaatagtttaaacttttggtacatgagataatataatattcttttgaattcttttctttctgatgcctcgaaatgtctatggtggctcattctatgatttccaaatagattatcttcaaataattcacaacatttagccctaaattacagtttcctgagtgtgtaacaagtggtgatttcatttaagcaacatgctgtatcatttatctgggctaaagtggatcagattaagtttcaaggcaattatgtcatatttttggtgagtatagtcattattagcttaggaactctttaaaggaagtcagtttcaaatgtcttctgcctattattaaatttactacataattaatttataaatataacgacttagatggtctgataacaaagttaaaattaactaggctgtcccttctttgtattgttggacgtattcaataaaagcaaaagaaatctcagtttctaaactatgaaccagaggccatcctcctgcttagttcagagtcgactaatctgttgtttgctaaataagtcttattctaacagcaatactagaaggaaatgagtttccaccatttatcatcaagtttcaaagtggatattcaaactcctgtcgggaatttgggggagaaaacgtttaggaatgcagtattatatatcactcactcatgagaaatgactccttgtttgccagcctaggaatcaaacttggagccatttatgtcaacaaaagactggggtatgtgtatgttttcacagatggatggagagtgaatgtaaaccaaagacaatggggtctttgcctgaaaacctgcctttatgcttatcatgcagtgaaaacaccttttttttctggagcgccctgaactttgtctatttagtctgggcctttttgatatattgcttcacattttgggggtatctgctttggctgtgtggctctctatctagatttgaaagttatttgttccacttgttctttctctccttcatcatacctggtggattaggcagtcagcagacgaactagcacccaggttctgttcacctgcacacctgctttaatgcatttagcattcagttggcaccagattctagacaaccttgccctccaatgatctgaagtctacttttttcttttatggaatattttaaaatatcagtgtgtgtgggtcttgtcttcataattgaattctaggctccataaaacaggaactgttcactgtatttcttccggacttaagacagcagcaaggaaacaggaagtgctaaataagtatttgttggagatggtatacccaaatatacaatagtatatgtatgaatgcattattgggttaaatctggtaaatctggggtctgggattcaaaatcctggacccatgaagtagaataggaaaaaaaaatttttattgttcactaactactaactgaaatttatatgtccttcaatgatgaatgtagtccttgaactccaaaagttaacagcagtgcctgaaacttggcctcccatggaagtctcaggtatttttgtgtcacactccacttgcggatatcttagaagtctcatttgtgttcctaactgcttcaaaagtatgctagctattaaaacttcaactaaattttattcatgtgctaatcatgacgcatattttaacatctgataagtttttaaaatatctatgcctattttttaagaagcatattttagtataaatcattttctttgtaatcctatatattgtattttattcatttggaaacactactatgtgaacagtccatagcaccaccaaactgccaaagagccagcgacatgattgatggttgagagccactgcttcagatctcactggcacataagctagttttaggaggctgctttggagtccagtgaactggttttagaagccaggattttcattttactgactgtgtgactttaggcaaatgacatttcccctttatgatgacccgaggtcttttccagctgtgaattctgtgatacttgttttcagacatgttaaaatatgccttacatcaaactcaataattttattaagcacttgaacacacaaaaaagtaaaaaagattcacaatataaataagttttaaaatggtttagataaatccttggctaatagatctattatggatcaactaaagtcagcctaggaggaaaggaaccttgtatgcacacccagcatttaaggttactggacaatgagacagctgtccccatgcacaacagggaccatttcaatatatactggaacatctctcaatgataaccaacagcttttccatggacattcagtgtagttaaggagaaaattagccatattttccttcagtgcctttgattaaactctgatgatgttttctgaaaaggaacatcaaaaactaggacctctggagacagacatgttgtaattattattacaaatacttagcatttttatcatcatcattaattacatttctcctttaagggtttatcataatctccaagcctgctatttgttcatttgttcataattatccatgagtaagcaatttgttctgtgttctcagaaattggttgtttaatatttggttcatttttaaaaattgtttcacaagggaggttcaaaaaagttgtgtttttcttcctttttcttctggtattaaggatacttctgatgtccttaattatcctggattctccctccatccatcccctacacacgaatgtaatgggggctttcagaaacacaatcgtaggatttttataaaattcggcacatcaatctaggaaaagaacattcaatggtaagacagccatcatctttgatatattaatatatttttgcataaagtcctcactttctcatataaattattccagtcttatttgacctttgttgtcgaggctgtctatcattgacaaagcagaactgaccacttgcctcaattccgtatcaaagtttattttccttcacctccctctgcccccagttcaatgctgaaaaggagccaggggagaaagaagtagcagatcaaaatagaaaatacctactttgtgctcaaataacaataaaatatccataatggcgtgtgttcaaacctctgtatctccaaagagtcgagcaacatggttagtatattaacctattagggttagccgattctaatcaggttcagtgtctgggcagggccctctgttttttgtgctagcagtttcccttgaagccagactatttagtggattcagcactgttcattttgtgtgaaagcccgtattcttctcttcatacttttcaaagatatgcttttctcattgtaagcccaggtcataagatgatgcctcaagtgcattgcgaaacatttattattctgagagactcaggtgatgaaaactctatgtgtttggtgtgtgattccttaaatgagttgtcatttatgacaatgactttatttataaggcactgttcctaagggaatatgagttttttgaccttgaaatacatgtagccaatctgcttggcaatttgtaattgtcccccctaaaatagtaagaacttactcttgctctttttttggaactatattcagccttgggcagtaaactataactcagctaaagttacataaaccctgaagggaaataaatttcaccactgttgattggtaaatgtcacagacatcagtgctatttatcaaacatttctggtttcctgccatttagcccaaagataagattttaatttcctatcccctttagggttcagcatggtcatatggctggatttggccaatgacatgtgggtaacagtgatatatttcacttctgagtgaagggattgagagctaatccatgatttatcatgccacctttttcataaggtaataatgaaagcacctagccaacttggagcctccatcaggctgagtccctgcatgactaccatgaacagggcagaaaccaggacttattttttttttttttccatgaccaacatagtgcttggcatattattaaaattctagaaatacttataagtgtatgggggtatatatgtatgtgtgtaaatatatgtgtgtatgtgtatatgtatgtacacgcacatacacagagagagaaagagagaagctgaataatttttctgagaatcaaccggaattcgggcaatctagcatgaaaaatttcacttgtagctgtgtttgtttcccttggtttcacttggttaactcagcatgttttataataacatcataactgctattattgactttattctaaaataggctattacaatttctgagtaactactttaagctagtgtgtccctcctttttgatgcctccctggctgcacttcggtcaggctggaatatgagaattcagtaggtgaaggaaaatatataaagagaaatataaaaatatcctggtgttcaagaaataacttaagtacttatatcttgaggagaaaatacagatcctcttcagtgcattagtcatgtaggtataataaatgagaaagatggaattcaggggacctgagatcattacagtgttatctcaccgagatgattttttttttccaacggtagaacctcctggcctgatcctattgaagaagaggagataaattgctctcttttgaaggtgcattaaccttaggttcatttaatgaattacctctcccaatgcactaacagataccctggggcctgagatgaaaaatggcctctcttctcactgagaggctcaaatacatactacttccttctttctcttcaacttgttttgactttcattctttatcctcttgtgatgtatatttaacatataactataatgtactctcagtttaaaaataagaatgggaaatctatcccctaacaagggcagtatgtgtttcttattttaaatagattctcttaacttaatttcttgattttcttaacctcattttctcctctggcatcttatggtgcaagctacctgccattcatgattctccaagacaccttaaggaaaggagtgctgggtgataatacagtaggtgctgcaaggatgtgagacgtgtagttaaatggctcagcagatgagctcagtgctcatcccatattcatagtcccctcagtagaggccattcaactgaatgctcttcctcttcctcctctgtagaattacctctcgagcatcattggatcgtgcattcgtttagaaaatatgtataggtaatcatcagtctttgagttcctctgaaatcagagcctgagataagaatctgggactattttaaagcatagatttcattattcaggtattatgaggccaacaggtcaggaggtaaccagcattgaaaagatagtttgttactcacagttcctaagaagagggggcagccatgccctgtggggccacacaggatagcaccaggcccagtcagcaggcaaaaggagtgaggggaaagggtgcacaggaggccttagagtggtttctgcaggaaaagccaggcaaggcaggatacgcaggtttagaattggcatttagggaccatctctagtggtctggtaccttgccctgggataattatgggaaagaactattgacccctcatgtttaagagtcatatagttcagagtatgcggtctggatgggttggtttggatatgaaaagcatgctccccagggctcatttgctatctctaagaactgactaaccctgatagaggccatccctccttggtcagcaaggccgcagtgccaaattatcaaaaatatagaaaactgtatacatagttaatccagggcacatatagtttatttgggaagtgatccccagaaaacaaaaatgaagaagtggggagagtgagacagtgaagcctggggctcatttccactgaggttcctctgggcaactatgtagaatgtacctcagaattgtccctacagagaacaggaggcagaagtatttattcactgactcccagcccccagtggttgagggttgtctgcagggacattcacatctatgcacttctgggatgagctcacacacacaggctgtgcataaggcttcagagaaagccctgagatagaagatttgattgccctgaaggcatttgaggtgggaagccattaggatgccaggaacagttcacctcttgactgcagttatagtgaagaggtgggccaaagggtgtggcgtggggcagccaaaactgtgtgctgcagcacaagtccccgaacccagcccttcactgaggaacatcaaagaagcctgctctttgagatgtaaaccataagatgatcaacacaaaaggggtcagagcagccacatacaaagtcaccttaaacgacaaatgaatcccaggctgcagggcataagccattccacctgcctaaagaaaaaaccctctgccaatcagaaatattttctgtcggctatgaaaacagagaaagaaaaaaataaatgtgataaatgttattatgcctttctgagcattgcacagggaagataaaaccccagctcaaggattaggcaggaggtagggatatcttcattttgaaggtgaaattttgcctgattcatgaagcatttaagttatataacaacaaccaaatcatcaaaaatttagaaaactacacatatgtgtatatatatatatatagagagagagagagttaatacatatatacaactttatatagttaaataaattatataactatatgtgccctctattaactatgtatctatctatctatctatctatctatctatctatctatctatctatctaaaactctctctctctccatatatattagtttatttgggaattgatcccagaaaatattaatcctctcttccctttccttcccacctttctcattcttccccttttccgtctcctctgtcttcactccttcctctccgcctcttcctttctgttcataactctcattgtttgtacatgtaacttggatcaccttctgggttggctttccaacactgccagcaagccataacatcaagatagtagctctctgtcaattacattttaattcacaaccttttcataattttcacaagaacaagtacaacggaacatcaaatctttcaaatcaaactgttgttcctttctagttggatttacattaaaattgtactgtgagagtgatgtagacctttaacaggcaaatgaactagaagacataggcaaaaagtgaggcaaacgtgctcctaccagcaccacctctgccacctcatatgtccacacacctgggcttcaagctaagaagcctccagtgccaggcatcctgctaatactcagggatcccattatcacttagccataaactaaattattagtgacatacatcctggattactctgtctgtatctcactccatacatccagacactgacacttaattatgttgttccacagtagatcaagttttacagcagcaacaaagattaaaactgttttatattggggacatttagaggataaacagcagagggttctaggagagaactatagtcagctttgtggccatctgggagaaaaccattcaagtgctattaatatttaaaaaccttttagatttttatagtttgcaatgttcctaacaaactgatctctaactccgcagtgaatttttggtgtcaaaacacactgctaagctatttctgagtctttattaacagagacagagctgtcagctttgtgctgtcctggtggcctggttgaaagttggtgtcattgaagaagcaaatctgagttttcggttgtgcatgagaatacgtccactggtcatcagcaggctctaggtctgcatgtttgtgtagttacctcccatcttctttctcttctctctcctttattctttttctttacttctttctttatcttgttttcttataagttttctgagtctatagaaatatgtattagagtattactttaaaagaagttcttccaaaatctatatcaaattaacttggcagaaagagccatagttgcttcttcccaaatagctctttctgcttgaactgtagtatagtatcaagacagacttcagagaaaagaatggtagctaacatacagttgatagaactgggagatgcttggaaggctgaggtgggaggatgacgtgaggccaggagtttgagactagcctgggcaacatagcaagaccccatgcctacaaatataaaaataaaaaacttagccaagtgtagtggcacacacctgtagtcccagctacttgagaggctgaggtcggaggaactcttgagcctagaagtttgagactgcagtgagccctatcactgcactctagccagcctgagtgacagaacaaaaccctgactcaaggaaagaaagaaagaaatgggagatgaatgatgaataaatagcctgccgtcttgcacgctggctcccaccctcatcctctcatttccccagccccgctgtcactccttcattctcctactctcacagccctctcttggtggttatgtacaaaggagcgggtgagaaaatctccaacctggtgtctatagtaaaaagcagcatcaggtattggcagaatcaccagattagtaatgagatgatggttgctgaatctttccatgcttcaattgggggagaaaattgtttatactgtgaaagtttaaaagaaatcaggtaggccaggtgtggtggctcacacctgtaatcccagcactttgggaggccaaggcaggcagatcacctgaggtcaggagttcaagaccagcctggcaaacatagtgaaaccctgtctctaccaaatatacaaaaattagccaggcatgatggtgggtgcctgtaatccctgctacttgggaggctgaggcaggagaattgcttgaacccaggaggcagaggttacagtgagctgagattgagccactgaacttcagcctgggtgacagagcgacactctgtctcaaaaaaaaaaaaaaaaaaaaaaaaagcttcttccagaaatcagtcaggtaaagctagataataaagggaaggaaaagaattgtatcaaccatacagtgttaaatcagagtttattagtgttgttatggatgaccttgattacatgatttcatgcatgctttaactgattcttatttgtgtagcattatttttaatcttctactttgaaaacttctagacttacagaagggttgtaaaaataacgcaaacaattctagtacacccttcactgatttctcagtgaaatctatctttaccatgttttttaatcattccataacatcaataatatgtatatattattaactcctgaattatttgaggtaacttgcagagttggtgctctttacccttaaatattttagagaatatttcttaaaaacaattatattacataatgacagtaccatgaaattaacattgattaaatgctattatctaacctttagatcttagtattccttatttttttcactaatttctgttacagtggaaggaagaaaaacacttttctagtccaggatccactccagagttactgtttgcatttagctgtcatgttcttccagcctcgtggttcctaatccttttttctttcataatcttgaaatttttaagagtataggcaaattattttgtaagaagtctttcagttttaacttttgtggtattaaagaatcgttttctaagcaatggggaaaggattccctatttaataagtggtgctgggagaactggctagccatatgcagaaaatttaaagtggaccccttctttacatcttatacaaaaattaactcaatattgattaaagacttaaatgtaaaacccaaaactgtgaaatccctagaagaaaacctaggtgataccattcaggacataggcataggcaaagattttgtggcaaaaacaccagaagcaatttcagcaaaagcaaaaattgacaaatggggtctaagtaaactaaagagcttctgcacagcaaaagaaactatgatcagagtgaacagacaacctgcagaatggacgaaaatttttgcaatttatccatatgacaaagttctaatatccagattctataagaaacttaaacaaatttacaggaaataaaacaactccattaaaaagtgggcaaaggacatgaacagacacctctcaaaagaagacatacttgcagccaacaaacatgaaaaaaaagttcaacatgactggtcattagaaaaatgcaaatcaaaaccacagtgagataccatctgatgccagtcagaatggtcattgttaaaaagtcaaaaaacaacagatgttggtaaggttgcagagaaaaaggaacgctgttacactgttggtcggagtataaattagttcaaccattgtggaagacagtgtggcgatcctttaaagattagatgcagaaataccatttggccgagcaaacccattactggatatatacccaaaggaatgtaaattattctattataaagatgcatgcatgcatatgttcattgcatcactattcacaacagcaaagatatggaatcaacccaaatggccatcaatgatagactggataaagaaaatgtggtacatatacaccatggaatatgacacagccataaaaaggaacgagatcttgtctgttgcagggatatagatggagctggaaactgttatcttcaacaaactaatgcaagaacagaaaaccaaacactgcatgttctcacttataagtgggagctgaataatgaaaacacatggacacacgggggaacgacacacactggggcccttaagagtggagcagggaaagggagagcatcaggaggaatagctaatggatgccgagtttaatagctaggtgattaggtgattggatgatctgtgcagcaaaaccatcatcgcacatgtttacctatgtaacaaacctgcatatcctgcatgtgtacccctgaacttaaaatagaagttgaagattaaaaaatgaaaaaaaaaagaattgatttcaaaaaaactaaaaatataacatacaaatataacaagaacatacaacaaatgcattatttaattcattaattaataaggaaactagtaagatgttaaaatcagtcttaaggagcatttgaggagctaagatatatggcaattttacccgagatgttagaataagatttctggcttagatacaaaattggtgaatgtcttagaggaccataaaccataatccttgggattataccttccattgaaaagaaataatttacatctctactggacaaaaatctatgggttaacgtctgcattctaagagttgtaaagtagtccaatcagtagtaagccaagccaaacactactctgcaaaaacactttcacctgttccaggttttggatatgtttttgacagtggtttttaaattatgtttcattgttggccaggactgagcagagggaaaactgtgaagaaggtacaatatgtacttgaaatcaggaagtacccacttcagccaccccataatatttctctacccctcccttctgccttgaagtgcctgagtcttatccataccagatatgccactatcgagaagcagatgacaggctcaggccttaccagggatgcacttgccacattttggaaagactacataaaaaacctttaaaaattggagccctttgggcctcaggtatccaaagagcacattttttggaaactcaacactcaggaaggtcgcatagagccagtttatgcaggtgagtattttgctcactcttataaggtccttataaggtcctcttcatgtctggtttggttctccttttcatgccctggtgagtttccctgttccccatatatgagtgactcttttttaaggtacctttaatcttttcttcatttagtttgtcagttaaccatgaagggctttttgctcaaagtttggtttcaatgttcatcataaaaatgacatcccaaaggagaaaatttacttttctatattttacacaaaaagagaatactagtaaatattgctaataattaaaatagtatatatatatatgtgttttcatagttttatagatttttaaacattgaatgatattcttagcgttttaaacagattatatctcattattgtgtgttaccattaggcaacaatgaaatgtttaaaatatttttaaagtattgtattttagttgtatcgagacatataagcctttcttaatttaggggaacaggaataagactacccactagacaattgaatctctggcctacagccaaattttacagagtttagatttaatgcttatcactttttttaagtgattattctttttaatttccctaagtcccccaaattagttttttgatatttactttttctgtgattattttgagaagtttccaatctttattttattttactttatttttgagacagggtctttctctattgcccaggctggagtgcagtggcatgatcatggcttattgcagcctctgccttctgggctcaagtaatcctcccatctcaccctcctgagtagctgggactagaggtgcacaccatcacatctggctaatttttatattttttgtagagacgggtttttgccatgttgcccagcctggtcttgaactcctggactcaagcaattttcctgccttggcctggcctcctttttttttttttttttttgagacggagtcttgctctgtcacccaggctggagtgcaatggttcagtctcagcttactgtaaactccacctcccaggttcaagcgattctcctgcttcagcctcctgagtagctgagactacaggcgtgtaccaccacaccggctaatttctgtattttcagtagagacggggtttcactatgttggccagacaggtctcgaactcctgacctcgtgatccacccgcctcagcctcccagagtgtttgaattacaggcatgagccaacgcacccagcctctcagcctccttaagtgctgggattacaaggtgtgagccactgtgcctggccagaagtttccaatttttaaaagttaaggtagttcttaattttctaattataagcattgccaacgcgtcagttctaagtgaatatgtttattagaaggcataataaaaagcaaaaattcgtcataaatttactgctcagagataattattgcttacatttgacacttggcatttttattattttttatacctatttatttacatttgtatactagagatcactggatatacaactgagcgtcttcatgttttcaataaaatactatatcattagtattatcctgtgtaaactttctcataattattatttaataatggtataatattcctttgggttaatggactataattcatttcactgctcccttgtggttggcagtttattttttcccaatttctcttttgtatagaatcctgtgagggcaatttttatgaaccccacaatttacatttacaaagttatttccatagaagagactccgtagagtgtagcaatctgctgggaactagaagcatatcaaaggctcttgacatgtgactccaccagtgcttatgtgtgcttatctcatggcctcctgactgggttcgagtttcatagattgttcagtcttttctaatagttgttttaaatttaatgtcattgaatagtggcttcattgagcattttttttcaaatgtgaattagcatctggacttctttttttttttttttttgtacgtgatctacatccttttagatagtggcaactggacagatgtaacattaatctgcactgtaggccaagtgcagtggctgatgcctgcaatcctagcactttgggaggctgaggtgagaggattacttgagtccaacccggccaatatagagacctcatgtctacaaaaagttaaaaaagttagccaggcatggttgtgcatgcctatagtcccagctacttgggggactgaggtgggaggatcactctgagcctgggaggtcgaagctgcagtgagctgtgatcgcaccaatgcactccagcctaggcaacagaaaaagatcctgtctcaaaaaaacaaaaaacaaacaacaacaacaaaaacactgtgtaaatgtatgtatgtgtgactccaggtgacttatttaacctctttgaatttccattctttcatttgcaaaatgacgataataatgaagacttcacagagtagtaagaattaaatgagatattataagcataatacttagcacaattcctggcagtggtaaagagccgttaaatgactttgttataattgttactaaaattataattaacattttttcaagtatctattggggaaatagatattttctattggcgtacatgagctttttatggattaaatacattattcatttgtcatatttgcttatggaaatattttccagtttgttcatgctgttttaaagtttgttaaattattttacctctgtttctgtgttttgtcaaaatgaggaccaaataagttgttacagcacttaacagaaacaaaaagtagccacaaccctttgggcatcctctaagcatttggtcattactatcattagcatcaggggacaggaatataaagagcatacagcacctactattcaataatgaggcagaagtcaagttgaaaagttcagttctgaagatgtcattcataatgataccaactcagattgtagttattttcaagtctaaacacttaaacatttattagagtaaataaccgttaaaaataagaggagaaaaattatcttctttcaagaacctgcctccaaatttatcttaacctctgaaatgcggccttcgtagtttcagctaaggccttgtttcatcagcatactgggtcataagttgaagaagaaaaaaactggagtaaaaaacttgaggtttcagatagtctcccccaccctctgggaattcactggtgactgatttaaatactgaaacttcacatgctactttgatgactatatattcagtcaccttcctttggattaaattgccatactcttattttttcaatctggttttctttgcaatgtttgaccctgtcacccaattacctcatttttggtggggtaaaggtgagaaaagatcaaatcactgttagtagctgcagaggctttaaaagactcatttaccagtatggttgtatcatgtttaaatttctaaatggctaagcaacatgtgccactctctgagtagacttaaaatgatgaaactaagtgaaaccatattaactacgtaaggggatcactaggatcccaggttgtgctatttgctagcaatcattacagtttatttaaactccgtgtgctagaaagttataaaatggcacaaggcatgatcccgatttgtagttcagagactaaatctatgagatttcactataggtaatctaactggtatttgtttaagttacagatacaatcagagcagcccttctcaaactttaatgtttatacagatcctctatacatctttttaacatgcagattctgattcagtgggcctgagattctgcatttgtaacaagctctcaggagatgcccctgttgctagaccatggaccacactttgagtaacaaggggttagaagcaaattatcaactgggagtacataaataattcactaggaagctcattaaacacagatttccaatgctactcccagagactgatttagcaggtttagggtggggccccaagatttcgaattcccaaccacctcccaggtgctgctgctgctgctgatctgcaaaccataatttgggtagctttaatttagaagtactcaaactccctgcatctcggacataaagcaaaagttaattatggtgagatgaaacatgggttagtggaaagtctcttaggttgtctagaaggaaactgggttctttgacacagagcttctctacagatctcagtttcctcacctgtaaaataagccaaatgatgagtgcccccctccccagatatctaacataccaagcagatgaatacacttttaatttgacacataagttttaactattttggccatgtctcctctaacattcgcaggacccaggacaagagtacaaatggacacctaatgccatatggataaacatttagtagttatacattaagccaacaagtacatgagacaatgatacaaattgcttattattgcaataggtgacttagccaatacgtgcaactgtcacacattcaactctaattcatgaatactgcccaagaccacagtttgttacatgaaagaaattgagatggatagttgtttctcctaggaaacaacactttattatttgagaatcttttgcacttaaggtattttagagaaaggatttgacaggttaattaattatttttccccttacctaagcacttctattgctaagtcctccctccactctgaaagggtgtccatctctgatgtctgcatttgcacaatccacaaccctttgtgacattcaaatgcagtctccttttattctgagatacaggaaaagagatgtaagcacctccctggggtctgaacagtgttaatgatgagatcagatgtttaggattatacatcacattctgccagagctgaacactgaatcccagtgaccaaagtaaattggcatgtgtataaaatacaggacccacggaaggggcacctatttattggatctagggcagtattattttggtggtcataagggaactgatacctgaacctgaatatcactcaaagatcactcatggtgcctgatatttggaagagacatttgaaggaccagacgaaccacttattcttttagatgctctaaaattgaaccgtataaaaagtagactatgccgaagtcatatcattttagctacatggagaaatcttgttccaaatcaagagataatgatataccctctggttctttgatgacagtgtggtggctatatgcagaatgtttctgcaccatttgcataactactgcttaagatatccactatgtcattcaatatcccttatatgagagttcaatgaggtagacgtccttaaatttactatcaggttaagaaaagagcagattgtctctttggacaacttcgtgtatttctttctttagctgcctggaagctcaacactaaatttagtattcatctgcaatacttgactcagcccatggtttttacacattaatatttcttttctctaaatgccttgttggaattgtacttttaagttcatctattttttaaaatgatttaaaataatcacattaacccaggaagaagcagcatataaaagaaaggaaagaaacaaactgtttaatgacctatcttgctgggttcctacaactcaagtgggaaaatatgtgcatggtagaattatgcaaattactgtgtaaaacttcctataatttgaaaggtattatgatattttatctacctcatgacccaagatggctgctggagttccagccatcatcaggttagagtatgtcagtgtagacagaaagaaaaaggaaagtcagaagagcaaaatgaaatcattttgatgtttttagcttttccagaagctctatgagacacttggtcacatgaccacatctactggcatggactactgaaaaatgtaacattttattcctggcaacagtgaacttagctaaatattaagtttctgttactttgaagaaagaagaaaaaatagatatagaaaatttcaatccctgccacaattctttgttcatattgggatgggaacttgttaattttttgttgtagaaatcacacatttggtttttcaaattgtcataaagttttaaaatatctgatgccacattggatagatttttattcaaatattttccacattttagacattcaaatcttacatcgcaaattagtataatttttaacaacaaagtaaatgagacggacaagacaagagacagataacttccagaattgttcatgtacaatttggctttgtttggggattgaatcaatggtttattttcataaatattgatttcttttcctggttgttttatgaaccgagtgggaagggccattgtattcagtctttgttttgttttcatttagtcacagagtgcagcagtgattgtggataattccttgactatttgtactttagattcacatcagatgataaattgagcatgagaaatatgttattaaattgactgcattgtaaattggcactttacattttttatttataaacatggtaccttttactcaatatccaggaaactttggataaatatgaatttccattaacttatgtgttaactgccaaaagctattatttatatctgaaatgaactaaactaagataatttaatcttctagtccaaggtcaagtgcattacaataaaacatgtttcatgaataaacatcattaaaaacacacagccattacatagcagtttttcataacacaaaaatctgcaaattgagtaagcaaaatctccactcactgaacttttaaaaatcctatgttaaattaataatctcacttcttctaagattatatactttattttttacacacagatagtaatgaatagatattcattgattctgatgtaggtggtgtataagtgactacgtttgtgtgtatgtgagtgtgaatggtataaaatattgtgctttgggaaagtcaaaattgggaatggatttaatgtctgtgtatcaatcaaccatgatatcaatgatgcacttataactcccttccccaataataggttttactttattaatcataattttttggtgggggtcactattagaaatttccattgtccaattttctcaccatgaccagccaagcatctatcacttgtttttaacttctcaactagttttcacaatttgttgtcctgtaaagtaataaatggcccaaattttccacacgctaattaaaattccatttctcatgaattctttaatcgagtgcaagtcattatgtgctttgttgatatcttaagtgcaaagataattgcaatgggcagcgtgaaaagggtttgattattgcctgtcgacgcttgtgaattctaataggtctaattgcatagcatcaattcatcatctcagcatcacttctttttattattagctctctgaattgtaatgtgctcataaagaagtgttgtagtatatcagagatgacatggtacctggcctattataattttcagcccttaccttgtgcaactcttgaaattaaaagtttattatggagtgccctttttctgaaactaattttaaaatgctcctgtatgatgaaatgaatactgtccaataatctacatattaatttgcctttgtaataattccattaaatgactgccaagacctttttcgctcagattgtgcctataaattcagaacataatgcattagttggaaaacatttgttaggctttttaatgggaattcctggtagcatttctcagagaatttctatactagagtgactatcctaaggctaaagaaagaaaaagattccactgcataatgatgtagaatcttccacgcaccccaataatatgactaaaggaccaccagcaattgagttgccaaacaccctatcatttgcatgtagggaatagaacagccctagtgtagagaaggaaagtaaacctttaattactctacagataaaataatgttctatatatgtgaggaagtgtgtctaataataatagacacaaatggggacttacaccctgtgtcaaacactgtactttaatcgttatctcaaataatctcagggattcttatgaataaagtttcagtgtgataattttacaggcaagtctcaaaatatcaccgaagatcaccagatggtatgtggcaaagctggaatttaaacatctagacagaagactcccatagcttgtctgctattttcaacacacactatggcatgactcagtcaaattaatgccatcagaatcagtaacagtgaactttggaagaaggatgatcatactgttaaagtgtgagtccaagtaaacccaaaaactaaatcacacttcaggggcttctatttttttttttaggataatatggtcagaagtaattataatccatgttaaggaatgagtcaagttcctagaaggagcatccatacagcaaatattccaagagatcaaggcaaaaccggtgaggcttatcaccttctgttggaagtctgacaacagccaacttagctaaatactaagtttctgttacttcaaagaaagaagagaaaatagatacaggtctgttggaagtctggcaacagccaacttagctaaatactaagtttctgttacttcaaagaaagaagagaaaatagatagaggtagagaatttaaatccctgccacaaattctttgttggtgttgggatggaaacttgttaattttttgctatagtaacaatatatttgattttacagaatcacttcaagatattttattggttttaagtattgggaagggatttatactccagcttttgttaaaggagtggcaaggccacattgccaaaaagcaaatgagctgagacatattgttttgggcatctctgggtaatacagcctgccacagggaatgagtcaacttggtgttactgcttgttgggcagtaaagcaatttgcaaggaagcagtcccccagcaggtataaattattgtttcaaacatctctctgaaaattactgtaatgagaaggtacccctttgccttgtgtgtgtgtgtgtgatgacaagcaaaagtaaaacttaattcattttctacagatcaaatgtttggttcttttttaaaaaaactttcaaactacgtggtttaggtataaatattttattgaatatattggttcatttccaaatataaaaaaaatcaagaagcaaatatggattctaaatttgctgtaccataagtaatttgcaatgaaacctacatctgaatagagaaataaattaccactcaaaaatttccattacttatgttctactttgaaaatcataggttggaacttacatggagctattgcttattctgtttaaaaagtatatagtcattctggttttaagaatttgagtaaaatttacagaataaaatgcaaaaatcttaaatataccatctggagttttgattacgtacatacatcaatcaatgtggagaatatttccatcacatcagaaagcattttatattaagtaatttttattgttctattttccctcatggccaatccagtgaatctttacctctcaaaggcactgctctgacctctatcaccatgaattatttttttcttttcttaatgtaaatggaaccatacacaatgtactctttgtgtctattttgttcagcatgaagtctttcatattatctatgttttttttttttttttttttttttttgagacggagtctcgctctgtcgcccaggccggactgcggactgcagtggcgcaatctcggctcactgcaagctccacctcccgggttcacgccattctcctgcctcagcctcccgagtagctgggactacaggcgcccgccaccgcgcccggctaattttttgtatttttagtagagacggggtttcaccttgttagccaggatggcctcgatctcctgacctcatgatccacccgcctcggcctcccaaagtgctgggattacaggcgtgagccaccgcgcccggcccatattatctatgttgtcacatgtatcaatgttcattattcttcattggtcagtagtatttcattgtatgaagcacaattagttcttccattctcccatatttttgctttttctgctattttttctagtttcctgatgcctcaaaattatttccttcatcacaccctctctgtttcaagaactttagccattcttgtagggtaggtctggtctgctcatgacaaattattttagttttcctttgtctgagaatgtcttcatttcccccttcattcctgaaggataagtttgctggatataggattctgggtttgacagagttttaattttatcatttgaaacatattttgccacttctttctggcccccattacttcttttgtttgtttgtttgtttctggtttttttttttttttttttttcagagatggagtctctgctctgttggccaggctgcagtgcagtggcatgatctcagcttactgcaacctctgcctcccaggttcaagtgactctcctgactcagcctcccgagtagctgggactacaggtgtgtgccaccacgcctggctaatttttgtattttcagtagagacggggtttcaccgtgttagccaggatggtctcaaactcctgacctcgtgatctgcccacctcggcctgccaaagtggtgggattacaggtgtgagccacatcacctgacccctctggcccccattacttctgatgaggaatccactgtaatttaaatggtttttctccaatatagataaggattcatttctgttttgctgcattcaagattttttctttgtttttagttttcagatgtttatattttgtcttagcatgaattcctttttgttgtattcagttaagttcactaaactttttgaatctataggttatatcattggccaaatgtgggaaatttgcagtcattatttctttgaatactattttagccccactttctttctgttcttctgagatttcagtgatatgattttagatcttttgtaatagtttcacaggtccctgaaactctattttttttgacgtttgtttagcctattttctattttctccttgttttccactttaaataatttctattgtcctgtcttcaagttcactgattcttccctctgtcctctccattatgctattgagtccagccactgagttttttatttcagttattgtattttttggttctaaaattttcatttggttcttctttacatcttctcttctttgctgagactttctatctgtttgtttgtttcaagcatgtacataactgtttattggagcatttttaaaaatgatggttcctttaaaatcttagttttaacacctgtgtcatctctttgttgggtctgttgattgcctattctaattcaagttgagattttcctggttcttggtataatgagtgattttatataataccctgtatgttataagactctggatctttttaaaatcttgacttagcagactttctctgaaactgtatcacactcacagggaaaggggattctgcctcattacaactgccatgttgtaggggtgaaggtccagttcctctttcggcttcctttgacactccagggaggcaggggtgttttctttctgctgagaagagttgggatttcagaccctgctgggcttcagctagtgccaccttggctgggaggggaaacattgtcttgttactactccccagttagcttccactgacccagtagtgaggaggcctgctgggtggtagtaaaagtgccagcttcctatgtggtctgctctgacattatatggggaggggggttgttaccaccagcaagggctgaaattggcttcctaaccagcctcctctgataccactcaggacaggaagtgcctcggtacagtgaggtgcaggtagaaatctcagctccccactggacctttgatgacaggggaagggatgaagccttggctttgtctgtgctgtatggttggaataggatagtttttatctttctgttttgttaggtcatccctttcctgtggtggtggtggtggtggtggtggtggtatttatttatttatttatttatttatttattttttagtctgctcttgttagcatttctgggttgctggcttctttgggacccaggctgaaatctgttaggcaaaaagaaaacccagaaaactcatcaccgtgttggtcctatgggctgccttcttctgttcacctttcagagtcttcttatatttgttttatgtatactgtccagggtttttagttatagttagcaggaggaatagggagaagtccatctgttcaatcctagtccagagctagatattttttgcttttctgtgagtattttaaatactaggtcttggtgagtgctaaagttaggaaaagatgaaaataaccttaggcttagaacagtgcttgccacatgttaagcactcagtgaggatcatcttattctctttgtacaatcctagtgtctctgaaattctaatcttcttttgtaggacaggttacgcccaggtttggaagaggggtgcaaagggagacatatccaaaatcctcacctcactagtggatgcagaaaccttcccagcatttcttaatacacatcacagaggtagctgttcctggcctgttcatgcttgtggctgacagtacatgcatatgtataaacacacataaaacctccaacttttacatattgatgaagacaaacaaacctaaggccaagacatacagactctgaaaatctttccagaaggacataggaagggatctacttcagttcctaagaggatggtaacttttgcctatgaatgtttgacctaatgttttctaatgccaggatggttctccatagagtttatttgtaaaataaaacattgtgctttctatggagactctttgtaattctattcctaaagaaatccctgtgatcagctaacataaccacatctgagggcttcagatcttctgatggacttgtgtcttttccaagcatcactgtagttcatctctctctcactatttatgaactccacgtacattttcactgctgtcaattgactagtttgcactgaaatatccaagcaagctttgtgaaaaaatggaagtggctctcagtccttagatttgtaggcagttgtgtatggcacatagttttctttactatatgttctttccagttattggtaagaaaggcagtcacagaggatttgtccagtgggactccagtggcaaaggtttatctgactctttccagtagcactaaaaacacccctggacagatttcatggagttaacagactctgttttcctggtcttatttagaagtattgccttccgtgttttgcatattctgggcacagtcaatatcaaataattaaccatttcatctgttcaagcagccatccaccatctactaactgtcatgctcctgaatttacaggcacgtccagcaccgtttcttttattcttttcttctgtttttttttttttttttggtttattttgtttagcttttgttatggtttagacttgtgtctctgcccaaattttatatcgaattgtaatccccagtgttagaggaagggcctggtgagagctgtttagatcatgggggcagatttcccccttgctcttcctgtgatagtgagttctcatgagatcgttgtttaaaagtgtgtagcacctccatactctctctcttttctcctgctccagccatgtaagatgtacctgcttccccttagccttccactatgattataagtttctggagccctccaagccatgctgcctgtacagcctgtgaagccatgagccaattaaaccacttttctttataagttacccagtctcaggtatttctttatagcagtacgagaatggactaatacagcttttttcaaacgtacaattcagtggtgttggcacattcacagagttgtacaactgtcaacaccactatctaattccagaatatttttgttgccttaaaaaagattctatacccattagtagtcagtgttcattcccccttccccactccttgacaaccattaatctacattctgcctctgtggatttgcctattctggacatcttatataaatggaattatatactatattctcttttgtctctgttttccttaacttagcataagatttccatggttcactcatattgtagcatttatcagtactgctttcctttttatggctaaataatattccattagatggatatacatttggttattcattcatcagttgatggacattgagttgtttccattttgagctattataaataacgcagctgatgtggtttagatctttgtcccctccagatctcatattgaaatgtaatccccaatgttggaggtgtggcctggtgggaggtgttttggtcatgcaggtggatcctttataaatggcttggtgccgtcctcacagtaatgagtgagttatcactctatgagtccacgtgagagctggttgtttaaaagatgctggaatttcttcctcactctcttgctctgtctctcgtctcttaccatgtggcatactagctcccctttgccttccaccatgatcgtaagcgtcctgagtccctcaccagaagcagatgctggtgtcgtgcttcctgtacagcctgcagaactgggaaccaaaataaacctcttttctttttaaattacccagcctcaggtgttcctttatagcaatgcagatggactcataaaacagctatgaatatttgcatataagtttttgtgtggacatgtgttgtcagttctcttgggtagatcctagcagtggaattgttgagtgatatggtaactctgtgtttaacattttgaggaactaactgttttccaaagtggcatttccattcctatcactgatgtatgagggttttaatttctccacatactaacacttattaatatctgcctttttgttgatagccttcctaatgagtgtgaaatgtcatctcattgtagttttgatttgcatttccggaagaactaaggatattgagcactatttcatgtacttattggccatttgtgtatcttctttacaaccatttctcaaacccttctttgactcctccttaaatctattaaaagacaaattacatgcttagcttttttccttcattttggcctgttcactttttggcttattttagaagtatgctttctttaaacttcctttcttctcacaattagtgcacatgcacaccctgatctttttataatttaaattatttcaactaatgtctcaattaatgtcatcaatgctctgttgacatttaatccagaatgagctcttcctactgcaaaatgagctctttttttggcgctttgttataatttatgagaactaaagtagagagtagacaagttttacttttggacaagttttgcttccacatggaaggatttaaaatgatagcttgtcattagtgtgtgcgacaacagggcaaggcaagccaggagaggcaacacaggtcaaggtcattaacacaatataatgaatgaaagatcatagctgtgggtgcagttggtgtgagtctggtggacaaaaacaaggtcagagtcttgggtgccaagctgacactcaaatatcagtgatgggtaaaattttggtaagagagctgtacactgccatatagtacaactctacatttgacattttgagtctagtctagactggtagttttcaacctgtggttcctaggccagcagcatcagcagcatctgggaacttgttaaaaatgcaaatcctttttctccacccctactccattccagacctactactgaaatagaaatactgagagtgtgacctagaaactcatgttttgttttaccagaacctttagatggttttgatcgccctcaagtttgaaaactactgaccaagacttttaaggaggtgcaaaaagaaaaggtggttggagatgtcgccagagtttaggattaagtgagaacacacaacaacaagggtatggctgtagccaaaagcaagttaagcatagcccatgctacactgctaccatggaattaggcaacattcacttagccagaatttacttagtgactggttgttggaataggagagtgggccctagaatgaaggagacctgattattctggtgcagggaggttcaaggagagcaacccacgtccttacttgtcttcaatttgttatccctagtgtatcaggcattctgcttgttaaagggatctgttatattttcttctttggacttaaattactcagtataaataatcagcctcattctgcatgcattaatgaactccattagaaggagggaccattttttttttcctatgttggttaaggaggcctcttagcaaaatctaaagggaggtcttctccccaaagaattgtttttgtaggccttttccagtcaagaactgtgacagagattgagtttatgctgggtgcagggaaacatggagtaagtcacgtccataaaggtgaaggaaggccaatgttttggcatgggtaagttgctaagtacagtgtgggtgcatctggctctcacccttattccttgagtgaagtcattcatccaagttggcaagagcaggtcataggaaaaatgaggacatctggaagagtaaatggtttgtgagaggggccatctctcagataggcccataggctttctctggaaggatgtcagaaagccacatttatcagaagctgcaaacacagccagccatgtcctaggaaggacagtgctctttctatcacaagagaattccaagggcaattttctgttttctttttttttttattttttgtttttttgtggagacacggtctccataaaagaaaccagattggtcttaaattcctggcctcaactgatccttctgccttgtcctcccaaagttccgggattacaggtgtgagccatggctcccacccccttcttttctgacagtaggaaaaataaaaacacttttatttcatttccagcttctgtgctttctccagctctttttcctatctgaagaagtacacaaaaaatatctatgtgacaaagctcccaagccaggatccagtatgactttatttttctctggctgtgtccaggatcatggtgacttgacccatttagaggaatgccaccatatgctgctagcaactgctgaggtttggcatttcacaggtttctcagaacctaagaactaagtgaggactccaagaatattccatggactctaagtccatggctagattcccaggcccagaggatacatttggaaaaggaccaaagttgtcgtcatgaaattctatacattgcaagcctgtaatcccagcactttgggaggccgagatgggaggatcgcttgaggccagaacttcaagaccagcatggtcatcatagcaagattccatctctaaaaaaacaaaacaaaatgaaacaaaacaaattatataaaaagaacattaaaatgcaagaaataacaaaacatatttgatttaatcttgtgaaaactttcatattttcctaccaataaaattgtctatgacaattcctttagaatggttaatttggttgtttaggatttttattgtatagcagtgtcaaacacattcttgccattcacttattctgttaaagagaactattgacactctcctaactgttgctccttcaggaggagataagcagtaagactgttaaaattctatcaaaatactctattgatatcatgtgctgcggcttcaaaacactactcagtaaggatgctttggaaagtaactcagctgcctaatgtgtttctgctttaaaatatctctgggcagctaagtttgtaacaaggcatataaatctaatgtttagggtaaaaataaatatcccttttggtccaagcagtttaaatagtacttgtaattaatgcataataattaggtatctaaaaacaactcttcaaaactgaactatagttttctggcaaatgtgtaaatccatgtttatttaaagtgtattatatttataaaagatgaggtataaaataaatcgggcttaaaacaatgctgtcatcaattctaaatgaagcactatgaaacagctagttcaaagtcatgaaaatattgaatattttttttctcctttttctcctgtattttgtgtgtgtgtgtgtgtgtgtgtgtgtgtgtgtgtgtgtgtgtgtattttcaaccaggaagcatatgcttttttatcatgttgggaaaataaaatcctaccttttaaccttaaaaaaactatgaagatcttagcaatttctacaattcagttgtttgttaggtgaggaatacattccttgttaaaatatctatttgcataatttggtgagcaattacattactagtgttcttttcttatttgagatactctcccaaggaattgattatttgcattacaaataaaaccctgatgaaaatacataaaatacataaaatttgtataaaactatatatttatataagttatcagaaaaaagtgtgaaggcatatgttaagtgaattaaaatccactaagggcttgttattaccaagtcttgacctaggcaacaaacatatttatatccagtcaaaaggttggtagagaaaataattacatatgacaaaagtagaagttataaaaatgatgttccagtaagaagagaaagaacaaccagagaataaaaattcttggaaataagaacaaaagtttcagaatgaaagaatgcatgatggaaaggaaacagctgaagacttactgtaccagaagaataagtcaaggaaatactctataatgtacagcagataaaatatttgagagaaaatcaaaggaaatgagatttactcctagacatataaactcgcctattaagagttctagaaagaatggagaaaatgaaagagtagtaataattttataactagaaggagaaaaatgtcctgtcctgaataaggcatggtgaaagttcaaaatcccaagtataaaaaacagttagaaagaatgaataagacctactatttgataatagtacaaaggaactatagtcaataataatttaattgtacattttaatataactaaaaagtataattggattgtttataacacaaagggtaaatgcttgaggggatggataccccattattcatgatgtgattattacatattacatgcctgtatcaaaatattttatgtaccccagaaatatatacacctactatgtacccacaaaattaaaaattaaaaaatttaaaaactgagaaaagaatttcaaggataaataggaagttgataaaacttctggaaaggagaaaaaataaaaataaaaaacagcttacttatggaggtataaaaataaaactgtctttttctcacagtagacgtgaatgaagaaaaatcttcaacattcggagagaaaaaataatttttaaaaattagaaattgagtatcttacataacaaaagaaatgagtagtattacggaagtctccaatttcttcccttttcatgtttttaaacccactctatattgcactttgtcctcaggcttcgaccctcacgacggtaagctgactgtgacagcgacaaactttcacactgagaagtcaaaggcagaaatgatggggattattttcctcactcatcttattttgagagtaagcgcttttctcagaagacgcccgtgaaactgctcctcacattctctgcccatttgcttctcaccacagtctatcctttttctttgcttcatttttctccttagcacttgtcactgtttgacacactatgtattttacatctttcttgagaaaaattaattttgaacctggaagcatatatgtcagaaagacagcattcagaattgagaacaaattaaaaacatttggaaatgcagtggcttaggaaatttccagccacagaccatctctgaaagaattactcaagaatatacaccacccgcaacaacaaaaaatgagtttaagagtgagaagaccaggcatccaagaagtagtagaagcaaagaaaccagtaatatgtcagttctgacataattggttaatatgtataatcatgaactttgagagtataatgatgaaatattgactaaatagagaagaatgtattcctatcccatgtatgcacgtggtaaatgcaactacgtagaagtactagtgataagtagtacttctcatcacctcccacatgccaggtactcgacttgatgctttcacatataatacataatttattccccacacaacaaacttgacaagcagatattatcctattttttagagaggaagaaaagtaatttgccccagttcacacagtgagtgagtggagtgtgctgttgggttatggagacttgtttttcttgctctctcctgatatcatgctgtctgataataattacacattctattgatcttttttttctgatattgtcagctactgctgtgtaacatattttcctactcataccaaatcttcccatttttactgccgctaatttctttcattatagtgcctctcaagccattttctcatatcatctcaaccacaaccccatttctaaataaagaacgaaaattgttattaattgacctgcatgacaacagtatattatcagggagccagtcaccagatattatttattttcaggtttttttttctttttaaacctgatactcatcaaagcctgcatgcaaacatttcattcttggcatctgaattactgtggaaaggtctcttggttttcttcgagtgcttttacattaatggtttctactaaataatctcgcagaggcacatgttgacctctgtgctcttagtctcgtaatgaattatgttggaaaggctcagtgatatattctcttcccctcactgattctatgtcaggcccaaaataggcaaagaaagggaaaagttaaaaaagaaaacctgtcttgatactgaacaaaatgagttattttttattgtccttttttcttttactcttaactaacacttctcttattcttgtcccctttctgcatcttatttctatgttgaggataggctctcagaagacctgacaagcactgcagtaactcacaccccaattctatttccattctatttccctatttctgttactaactcagtcacttagagtcaagctccttgaaatcaatttttacactttgttttctcttttcccatccactctaaaaccatcatcacagtttgccagttcaactctaagattcttgaacggtctgcctctctttttcacgccttggactctgctttcatgtcagctgatctcttcccttttgtagcctccaattcattctgcaaaggagtaagcatgaggaagtaaaactactgtcatgattttgcatgggaattcatgttcccaaagaatatctcttggctttactccatgatgtcttatagaattcttgtttaaaaagctgctcccacccttctcttctccatgtgaatcagtgtatctgatagcagtcatgttggacttttttccttgagtctttgcaaactctttaagaagtgcttttccattctcaagaggatggtgagtggaaataccccgattatctcaaagaagaggaaaaagcaattactccggattttgaagattgagcagaaaacaattgcatttagttaaaattactcttaaaaatcccagcactttgggaggtcgaggtgggtggatcatgaggtcaggagatcaacaccatcctggctaacatggtgaaacacttgtctctactaaaaatacaaaaaattagccaggcgtggcggcgtgtgcctgtagtcccagctactcaggaggctgaggcaggagaatggcatgaacccgggaggcggagcttgcagtgatccgagatagcgccactgcactccagcctgggcgacagagcgagactccgtctcaaaaaaaaaaaatcccttaacctacataaaagtgaaattggtgacataccagttcaaaataagttcaatacaaatgattctccctatggagtcgaaagacatcactgtttcttcaaacttgaggacagataaaatagttaatgatgttgcattggaaaagtaaatattatttattagatctgcacagtgagaagctataatgtagcagttctgaaagtgtcaccagaaagtttgaaaatagctctagtgcacagtaaacccattatctctgaaaagtaggtgaggatattgactgatctactgggcccagcaatgtaagccaccctgctcctactcctgctgtaacactcactcatttaaataaatttaaataaattgcccttattatttaaatattttatcattctcagtccaccaacactttgttcatattgttgaatttaaatgagttgaacttgtaaaataatgtaacttcacagtatagaaattttcacatattcttttggctagaagttatgttaatgtaattcttgaagtagcctcttctcatttgtcttttctaaatacaacagttccttaagaaaatgagatgtagggcctggagtgaagacgtagagcctaggtttagtgcagagctgtcctatgaatggatcaatttcagagagaaatcagatccgctttattttggtggagaggtggattcattatatctaaatgctactttttaaagaaatgtgaatagtgagcccattaattccttcagagggtgtctagaaagtctgtcatgttccattttgtgatttgagagccaaaacctatctctaaaacaaagcagatttattctaaaatgagcaatatgcagatgagggaaatgacaggtttagagaatgcacttatttaatcatctcctgaaaaaaaaaaaaaaaaggcaaagggatcactgcacattttttttttttttctgtttgagtctttggatagaatctcatagcttttgttaaagagtgtgatagtgttagaatcttatttttaaatcttccatagtgcagtcattaggagatttttgatgaggttttgatgagtctttctatgaagaaacagcttttcagctctataaaatgtatgctgaatgagctgaaccagtataactagatgccattgcttgcccagtctagattatcccttctacctcattgttttctctaatctggtacatcattcctgattagattgattatatcgggccaacttttatttaatcacccacagattcactaattatccattaagcaactgttcccatagaattcttggctttgtgggaaacacagacatagatttgtcatattccctgcagtggaagcatcgagtcactgcaggaaaacagaaatcacagaatcatgacattgcagagttagcaagaatcttgggacataggtagtcatatcggattgccttgaatgatagggcattccctgctgcctaaggcaggatgccatatgattggagagctctgaccgatggaaacttctcagaaatgttcgtgttcaaagtcatattaatggtttatcgtaagtgatattatagagcaacagaggtgaagtgaattcaaactctgttcatatagaggaatttatggatctcatctttaaggaagcgaaattcttcacagtgtaggaatctccatgagaaactatttcataagaagaattttcagagaaaaaaatggggggggctctccagaaatggggaaagtcctgtagtcagaaaagcacagacctgtttggtgagagtcatggaacaattgccctatgcactggcacatagtgggttctcactaaatatgtattatataaaggacagaattaatgactgagtggatgattgcagaagagtctttcttgtccaggcgtgtggtggcacgggagtggtaaaggaatgctgacgacaagcacatgcaacctcagcatcagcctgcgtgtcccgacattgacccatctgcacatttcagtcccagcctagattctgcatttgtagaattacccttgcagtggggactaatattcattcattttacccacagtatagagtctttaaagccgattttctcctcacatcttaataaaatactggttttgcatctctctgaaaaggctgcaagttgctgacatctcttgaaccagaacaaagatcttattatcatcttccttgaaacagtcatattgtctatttggaccttcacctcctctcacccctgctattgaagcactagaaatgccatgcatttgactcacttccttctgggatgtgttctctttgggttcattctaaaatgacatgaaatgttggaattctgcagataattcagcttcccacatttcctctgagacccctctctgttggaaataacactattgtgatgcagatgcccccaataccctgtggaatctcaaaactatcaatggctgaccacaggatatcccttttccatgagtttcaatctgtgttattaaaaagggacccttacatgtaggagtccaatttgaaacaggatacagtcccatcaacaaggtcagtctcaaatagatttgtgcaggaaagggagagctgataaaaaattaaacatgagctttgcctctttcttttttaatatagaggatggcattttggtagaaattgattgaatgatattttataacgtgggcttaaaacatcacagctttgaagtcaatgaagaataaaacatattatcagcacatgatgccccaaacataataacattatcacattctcatgtaaaaatggaaccaactttccagttgagctgaaagtatgcatttgagctttggcagtgcattctgtatgcctctatcaactgtaaaatgcaaatgtttagttgctgtgtatgtaaccttagacatagatatcttatttagagaaccatagcatcaaggagggtgagagaggtaaaccaaaagccctttgtaaccaagaacagtgaaaaacagcaatgggtcaactcacaaactcaaaggaaactagatttaaaaataacattgtgaattctagtttatcccaaactcatgcaaaaagttgaatgactatagtctttccggacatagacagaaatccttcatacagctgaagaaatgtatgagagtaatccgaatttagaaaaatgctgcagggtgtgttgaagtacattttcaatgatatcttcggcagattgaaaaggaacatcttatagacaattgattgtttcttgaaatataataaaaacaaacttcgaaatgtgtatatgaaaacactgacctatgtggaaagaagaggcagcatttactttgtaatgctatcaggtggtaattcaattttctgttaactgaacttcaagtattctgtttcaggtcatagattggtggtgcttatataaattggccagtaagatttacaaatagtacctttagtgctcagttttgtggttgtatctctaaaaaagaaaatcagtttaattccatgcattggttttcttcttaaaattcatgcaatttgatatgattgacaaggcacagcattattatgcagtctgttagaaggaccgattatgcttatgaatacaagaatggagtgaatgaaagcaatgtgtaattgattctacacttggtctgactgttcattaacagtttgaatgtagcgcagttgcttctcaaatggaaaatgatgagagcaacctatctgtgctctctcatttgttttaaaattcattatgctaatattttttcacagaatgtttttgctgcatttgttttgccaaggataagtctgattgaatctttgtaaataattctactgctttcaatatttatttggcatttcaatcacatatttttcaatttacacttttggaaatgaaagtaggctctcccccacacctctttcaaagaaaaccttatatcctatcctccttttctctataattcagactaatttcccaggataaataggagtgggggagtgcaaagtggtgcgatagttatctcttcagaacaaagaagctgatttacagactgattgatttcagaaatagatgagcaaaaacagattccatttgtcttgccacactttagtctgatgaagcacaaaagggcctgccatctcattttccatagctcttcaagaggttgcatttgaaatgctgattaaatgtacaaatcgcattgctgttttcgtggctttcctgagtgctgtaggagagggcttcagtgcacaaaggctgcttttcctttcttgaatgtggagctggacactttagggaaataacatcactttcaccactcataggaagttatgatgctaattctgtgacagccatgtctgccctttcctctgtccacaggttcctgccacattataaaacaaaagaactaaaccagcactgtgccagtcatttctatctaggggctacaattacattcattattcccaaattagattgtgtttacaattaatactaatctcatgtttcaatctttggctacctcagatttttattaaattagcagttgactgattgagataataggtctgagaactccatactggtaaagttttaatcatctcagccttttctctgatttcttatttatctgccacctgactttgtacttggggctcaccaaaataaagcgccaactgtctggggagtcctgcattatagctgttttaagatatgttcaaaatttttttactgctcttcccatcaagaggtgaggtctaggtccttccatctgaaaaaatatgagatctttgtgacattggcaaccagtagaatattgtggtagtgatgctgtgtgactcccaagcctgtgttataaaaggcaacatggcgtccacctgctggtacacttgctcttagagccctgagttgtcatttaagttatccaactgctctgaggctgctgtgcagtgaggaaacccaaactagcccacatggagagtccttgagaccacatgaagagagaaagatgtcagtccagcctttggctcccacagtcctccactgctccagtgccagccaccagttgactacaaccaaatgagagaccctaagccaaaccccctagccaagccattgcagaaggtctgacccatagaagccaaaagaaataataggatggtggttgctgtgttaaaccaccacgttttgtggtaatttgttgcatattgcaacaaatctaaccacaaagctaaccagaatttgcatgtatacaagcatgaggctaaagtaatgagattcatgacaaacatgccaaaatgtatacatacaaatgtatgccattcatttctttccataaggagtcaccttgagaggaacttactcataatcatattgtcactgtgatgttgtcattgtgatgctgtcattatctccccacattgatctctgactttgggcacattattctgtctctctgggttgcttgaaaagtaggcgtagattaaatttttacatagtcttttcttaatctctaaaaattcttgacaattattcaaaattctttggttgttgaggtaaccaaaggaggagataaccaaaggaggagcataagaagtatgctctggccgggtgtggtggctcacgcctttagtcccaacactttgggagaccaaggtgggtggatcacttgaggtcagcctggccaacatggtaagttcgagaccagcctggccaacatggtaaaaccctgtgtctactaaaaatacaaatattagcttggtgtgatggtgcatgcctgtaatcccagctactgaagaggctgaggcaggagaattgcttgaatccaggaagcagaggttgcagtgagccaagattgcaccactgcactgcagcctgggcaacagagcgagactttgtcttaaaaaaaaaaaaaaaaaaaagtatgctcctatcctacgttaccactttaatatgtaaactgatgtcacactcagtgtacatattaaaattatagtaaaactttaatggttgatgctggccatgtaggaaaaaaatgccctcttgttcatcatttaaaccctatatttatctgaaaataattttttaatataaagaaattattgaggctaggaaaataaaagaaagatatacctaggggagtcattctgttaaattccttgaaattatatctatctttttctttaagagtatttttatatgtgtaatgatataagctcatctttggaaagcacattaatgatctttacattttataaggacagggtaaatgggattccagaatatggattaataaatcatatactctttgtttaaatgttttatttaatttttgaatagctaatgtattcacataacttgaacatcaaaaaataaaagcagtgaaaagtttcctccccatattccctcccccatcttcatagtttctgtcactcttctagtaggtaaccactcttattaactgctagtttatccttccagagatgttttatgcatgtagctaaaacaaacctatattcttccctacatcggtagaggaattttttttaacactaatgttagtgtgcttttctgaattttatttttatgttgtaatgtgtcttgggtatctttccatatgcatacatgaaggccttctttgtctattttacagaagcctagcatttcatagtataaatgaaccatcgttttactaacattgtttagtctgtcccctatggttggacatttagctgtttcccatcttgccttattatatacaatgtttcagggaatgacctgtgtaaatactgttctgcatatgggcgagcatattatctttaggatatattcctaggaatagaactgctggatcaaaaggagtctacatttgtaattttgttagatatgattaaatcattttctctggagatagtgccaatttgcacttcgctgtataatcgtgtttgggaaacgtgaaccatgattgatgctcatttatctggacaaaaatgaattaaacttcttagaatctttagctcagttcctgatagacgtgtacagaaggagatgcacttgagagctgcaaaaaaaaatgttattctgatttattccttcttttgactttgaatactgaaggccaaagaggagagtgacttgcagaaggtcacgtagctgattagtgacagatctgggacttacaacctgtagtcagatcttaggattggtgttctttccacatgagtaaagagatggtaactttctgtcattcctgcctgtgtgctgaggactccttgtacactgctgctgttgatgatgacatttaccatttcttgagccttcctatgtatcagactttgaatttaatacttctatttacattatcttatttataccaagggattcaaaacccatgtgcaagataaagcattgtccatagactttgcatccatgtatattacatatatatgtccactatgaagatgctacagtgtttaataaaacataaatcaatacaaatcatcattaaaattataatagctgtttgtctctaacatgttctcaatggattttgaaactattgtgaaaaattagtcatattttgatattaaaaagaattcttatagtcaaaagcctatgagctgcttaaccatgtctcagatcacttttacctgcccagatattctattttccatccctctccattataaggttagatattaataatgctacacaacacagaagagaccacagagataatctaagcaggagatttattttataggtaaggaaaaaggcaagcaccactgaaaatgatgggtttatctaaggcacttgatgactaaggggctggagctggaattcaaagacaggcctcctgactgaatttaactactccacactgagaaaatgagaaactcagtgtggagtagttactcataagtactatggacaattaaaataatgaaggagatttcctgtctagcctcatattgattcacctccagctttgtggatctgagaggtcatcatgttggtcgataataacattcgatcttggatgctataaatttaatatagagcataaatacaaagatcaatattttaatgctgaggaggctcatttattggctgtttatcctcagtcctttaaatgaaatggagaactaaagaaatgcaaggaataatttttcataaatttcatttaagttttatagacgatgatgactaaaggaaagcaaaggaaaagtttatgatgtcactatttcctacacttatgggcttttctctctttctctttttctttctctcccttatccctccctcccttctccctccctctttcccttcctccctcgcccccgttaatatctctaagcctcttctttactttgctcaatgttttttattactccagataagaggcacttattcttgatcttctccatccacaaaataagagaaccatggtcatgtcccgttgttctttcatgtattaagtgtttgatgtttagaagcagtggggaaggggctaaaaagcatagactttgtcttcaacaatgggaacaagattgccaaaatggccctgaaacaacatttcccaaaggtgaaattgtggaaatctagtcctataaggtgttcttcaaagcacaggtttcaatcgtcaactgtatttaggaaacagagcattttatattctcctcctggagacgcacaactccttacggcattttaaatgcccactgaagtcttgcagtaaggtaactggtgtgatagaatttcacctgttttttttttttttttttttttttttcaaatttaattgacctttaaacccatatcataccgaacccatttggggaaatgctgctttatagaattgtgtgttattctggttcaatttttctgtcatttgtatccatcagaaaacttagaatatcatagttgggtataaataacaagtagccaccagaggggaaataaagtaaggctaagcaccatctccttcctttatggattctaacatttattaaagaaactaaagtacaatattcatataaatatttactatggtacaggacttgcattgcttgaatttatgcaactcttgcttgttacttttattacaaaaaaatgatatcactgtgtgctattttttttcctgagtacacctcaagcccatttatccttcacttctatattgtagtggttctcactttaaaagtaagtttacctgtgaaacaatatctgcgtgaacttattagtgaagttttgtatgcctcctttgatcacatgagatgagcccctcttaatatcggctgacaagggtttaaatactgtttcagaattaatcatggaaaccaatgctttaggtcttttctcaaacatcaaatagtatcaacatttagtgggcaaccaacagagatttttcttttcttttttccttctttctttttttttttttttttttgagatggagtctcactccgtcactaggttgtgaggtgcagcggtgcaatctcggctcactgcaagctccgactccctggttcaagcgattctcctgcctcagtctcccgagtagctgggactacaggcacacaccaccacgcctggctaatttttgtatttttagtagagatgggatttcatcatgttggccaggatggtctcgatttcctaacctcatgatccgcccacctcagcctcccaaagtgctgggattacaggcgtggtccactgcacctggcgagatttttcttttagtgacttatttgctgctattgaaatgccatatgcattttttaaactgtaccatattcttatttttgtatactcttattcttctgtcattcttgttggaattgagtggtaacgattagtcaacacaaataatttcgttataatactccaattacattagactgaatttgtctttgtgatgaaagttgattagttgttatgatttacaccaatgaaagggactaataattcagttcaccgataagactgggaagcaagacttacaaggcattttcaagtaaatttgattaaaacgtggggtttttcttctgctctttcttaaaatgaggacagtcccctttcactacattcctaaaattaaaagtttacgtgtgtgtagagattaaaagaatagcacaatggcttgttgtgtataaaaaatatcaagttttgtatttttcaacataaataggagttgaacagtatagattgcattaaaatgtttgaatgttttaataatacaataaaatagataattaactattaacctattaaaataggtatgaactattagcataccttatgtaggtgaggattggtaggctatacttcaaaattggcaggaatgttttgcaattattcttctcaaggttattaatgattattaaaaattctcttggtattttttttcagaaacttgctcttctttattgtgtacaatgcctgaaggttgtcttagaagtaagctaggctagcactggctcttcccgtgccaatccagatgttccttttgcaggcaattactcctcagtttatttccccagtttatttcccgccaaggatttgtctttttccagggagccaattatgcacgtcttatactataatctgtgtcacttgaatctgaccaaaaactatgaaacaattcacttgttggggattccttttcacaattatcattttcctgggaaattgcctactttaggaggttgtgctacttaagatcttctaccagagaaatatttgcgtcgccaatgtattgcttagcttgcttgtctccaggctctaacacaaatacctaaaataaataaagtattaattatgtaaaaaaagtgaaaaatacctcgcttatcctctttttccttccttttgtatttacagatgtcatccatactgtagggccaatagccaggggccatattaatggttcccacaaggaagaccttgcaaattgctataaatcatctctgaagctcgtgaaagaaaataacatccgatcagttgtaagtaattttatgttttttatttctcactctttttcaacctttatgctttagtaatctgtcttgtctaaagagaggtaggaaaccatttccaaacttttgagaactaagtttaaggatcttagtagccgatttggttatcatgactctaatctttgatgtgctataaatatttgctaaatttttcatgatgtttcagaatttaaaactataaaacctcagaactggatttatcttatctactttttcctctttattttgccacttactttcttttggagaaagtaaatattatggtagtggccagcagatttaaagaaggaaaatagcaagtgctgagtttgttatgatagcgcacatttaatatatattggttgtatgcttgtgcattctggagccatgtttaatctctatgtacatgcatgaatgtgtgcatgcattctcatgctagtgtcagacatgatttatctgcaggaaattactctgcgtatgtattttaacctgaatgttgttattcttttagatttattttactcttattaaactaatattctgtaggtggtagctgggtataccacagctcttctaagttttatcagtagacaaagggagttcagaaaatgtggatctaatctatttccttaccagtaggctgagatgaaaggaattctcttctagctggatttggaggtatttactcacctgcttttcttttgcaacatgttctacctttattacatctcaattacaccaagaaaatcaaactatagaaaaacacactgtaaatatctaataataagttaatttggctggaatcccttggttgttccccctcccccatatagattatagccttgctgaaattgtggggcagaaaaaatagttaaatgcttgatttcatagcagactgaatagatcagcattgcttgatagttcacagaggtagtggttttattatttgcatgaagaaattttgagaagcagatacatttaggtaaccctggatggttgttatgctttttgtgcatgattgtaattatgaagtgcatttttcaatgcaacattggtgattctgcttgaaataaggaaacttttcatgacctaattatatagccctttttaatctttggataattattaacagagctggatattttatttctctctttgattttctaaaattttgttcgcaaatggctcaatacataagatcctattctctcttagaggtgaaagctgaagttcaaagagaatggagcaaagtataccacaagaccagttggttaattttgttctctataggaaaataagaaaaatcaaaacaggtatgcacatttagggaataattaaaattttgtcaatatggcttattgatttaaaaaagcaaaagactgaagtgcttggaaaatggatatgtagagaagtttccaacttggaaaatatggattttgaggcctgaagagaatttgctagtggaatcactggcatctctaatgacttgtttttaaaagccaagaaaaagtaagaagtaagaagtttgttagaaacagtataaaaataacattcaaccttttaatagagaaaggaatctctaactgtaattatcttaaaacaatcgtgttactctatttgctaccattaggtaagcaatggaagaattatgggctaagttaactttttaacagatggcatgcagatgggctgaagtaatgctcctgtaatactctagtcattctttgataggaattagatctaccttaacatctttgatgattattttgaagggccaattacatattacttgaatgaaattagcaggtaaggctgaactgaattcatcccaatattagtaaataaaaatggagatagaaaatacacaaaatgtgggaagaaatgtccaacgaaattgatcatcatgttttgcatggtagactacagttgccatcaaatgtcttgtctcttttacacataaaaaagaaaaatatttttcttttctttctccctccttcccttccttcctttcttcctttcttcctttttttggagtaaatggggctctcttctttatatggtgtgtcatgttcttgatcaccattaaataaataataatgctaatctcatcacattctgattatgtagagggaaatagaaaactttcagaaacatgattatgactggatacatgttttatagtataggcttgtattttgtcaacttatcacaatagatggtagacatggttgatataaaaagcctggttattaggatgaaaaataaacttaacttgaactcatttatatacatgtcaaaaagaatttctcataaatccttttatcagagtggcttagtgtttgctttgccacttattactgtgtgactgtggacaagtaatgtcaacattttgtaactttggtttccacttataaagaatcagtaaattactactgttattgcagacctgtccaactcatgtggctgttgttatagggatcagtcgggataatgtgtataagataattggaggaatggaattctctgaaaagtatttgacaatgttacttcaaatataagatgttttcacacctcatgatttggcaatttaaggaaatatcacttatttctttgatatctattctgaacaccagaactctagacatttaccatgtaatttcttgatgtttttaaacaacagggaaatgtccaggaataaattaaatatttgataggcaccacttttctgctaaggttaaaccaaaggctttaggatcacagcacaggatccaacatatatattcttattcttattttaccaaaagaatagattcttcaaatatttttaatggatgtaagacaagtagtatgataatttatttaataaatatgaataagacctactgtgtaccctgacgttatcaggtaacttccgtgacaaagagaggatctagtggttgttttctaacaaaatgtgactccatcttatgaccacctagacaaataaatggacaagatcatcatgtccactgtgtgatttgagaatactctgtagttctcttatcacttttaaatatcttcccagagatgcatgaaattccataattaatgagtaatttaggatgttaaggcattgttctttctctgcaaatttcctttaaaatgcagatactcataagatcagtagataattaattttctaatacattaatatgaagaaatttatcaaattacttttcatgttgacaggataaattagagtatgataaaagtactgagcaccttagcctgggggaggagaattggagaaaggtctgaaaggagatggagaaaaacagaaaaaagagtagggtataaataaatttcacctacctctcagttttgctaagaggagatcattcttgaatagtagagagggaaatgttatagtcatacataattatttagaaataagatactgatttgggcgtaagatgtgttgtggataaaaatttttaccatgaaaaaatactatatattttattaacttaggggaaaaaattcattacatttctgttctccatgcattgtttgtaacagctgttttttcatacctatccacatttgctttaggtggtaaaggaaaaagataaattaatcaacaaatcaaatggctcattttacgatggcatttcttttatgaatgatgatttagtgcttaatatcaggaaatatttaaatgtaagattttaatcctgattctccttctaatcttaccgtaaatcgtttcaattgaaaaaatatgaccaatctttcatgcctcctagacctagtctgtgcaagtttatttcttccaaatattattccttattccaaatattaaagtcagttatttttatttaaccatgagttacccttggatccaaaaaatttatttttatatatatttatttatatatatatatatatatatatatattctttttttttttttttttttttttttttttttttttttgagacggagtctcgctctgtggcccaggtgggagtgcagtggcgcaatctcggctcactgcaagctccgcctcccaggttcacgccattctcctgcctcagcctcccgagtagctgggactacaggcgcccgctaccacgcccggctaatttttttgtatttttagtagagacggggtttcaccgtgttagccaggatggtctcgatctcctgacctcgtgatccgcccgcctcggcctcccaaagtgctgggattacaagcgtgagccaccgcgcccggcctatatatatatattcttgacaaccttgagattgttgattgcaagataggcaaaatttaaggcaccatgaagaggataattagcagtacaaactggaaattggagtgggaataaaagaaaactttaaaagaagaccagggagcctacagattttctctgtaaaaccttgggaaagacaaagatatagctgtcaaaaaagaaaaaagacccaggttgaatcccagaagtctaatgcatatgacctgaggaatgcatagtcagaccagtgaaatcaagcatctaaattatgttgatttctagaacaacagtatatcctgaaacaatgaaaactacacatatacatgatatccttggctatatatatctaaaacatactaacagaaatcgtgtatattggtgaaaatcttggtgaaatctcggggtgagcgtaggggtgaagacaagaaagaaaaatttctattgagccagggctggaaaatgaaaatgcctaattttgtatccaatatcaccacgcactgatggagaggatacatagatattttcttatatatcatgctgtctttattctttttgtttgtgagcacagaaatattttgtaatgatttttatgtgtttatcctgacttctgtttcccttcttttaacatcatgttcatttttaaaaaactaatccatgtcatacaaaaagtatcacagcaatttcttcttctagcaccagttaaaaggcatagatttatatttgtcaatcatattaggtatttgagaaaactattttcactgatgaaatacaatgcaccctgtctgacattctttgaatgacaacgtgtaatagagtagatgttttattttgaaaaaaacataatctgcatataagccagattttacttaggttaaaaattattttcccatgaaaataaatactaattgacataggaatttagtgattttatgtgattatgggcagactaaaacttgtatgtttgtttaagtggtgtatgctacctgtgatttccacaagcatcatgctagatgatttttttgaatgaaaaaacattgtaaatttttgttagtaggaaccacccaacttcaatagggatccctcagagctaactgatgttccttccttgagtcatagatcttgagaagcaagagcttccaatgggaaagatgatgggcctgcaaattcagtactacctctaggcattgtggcaatcaagcaattttggaattctgcatttagttgttccactgtagtgtaggttttcattttaaggcgtagtcaagtgaatcttattttcttatacaagttcccttctgagagggttgccatggcaatgagttctcagcctgaaattcttaaatgttggttttatttcattatctgagtttccattacaggccacatcaatcaatgcagttctctattcaagaacacgtctgcagccttaaaaagctgaccctttcatttggtacctctgctcctctgcctaacttgatgtcaccatttcccagacaactcttcatctccaagaaccctcttctacagggctgtcaatttgatcttttccagtttccttttaggcaatatctagtcttggttctcacctgtctcattttctcatttataaagggtaataccaagtctctatgtcttccctggttgggtttctaacagctgtgtgactaacaatactattaataagtaacaagaacaaaggcacttttgcatttgtgcatcactctacagtttacagcagtgtattcctatacatcatctcatttatttttcaaattctctaacttgctgccactgttactttgatttagccagtgtgggaaaaagctaactcaagacttttcctttcttcttttcccctacattcacgtttcgtaagatctcctcagagggcacagaggtacacaggttattgttactgggagtgacaagtgacaggacaggcagcagagtcgaggaggagggcgggcatggaatgatagtaaattcacaggctgtgccttggaaacagatagttatacaaccaaacccacattgacagatcctgcacaatttgtgtcttctggtggccacaccagagagatgatttgagttagaggggtgaatgagatcaatcattgagccatgaaatatagtaataagaatagcaaatgtttctgaactcccacttggtgccaggcactgtgttttagtcattaattctcaaaacaatcctgagttagaaaatgtgatttcttccatcttagagatgaggaatatgcaccagaaggaaactgccttccctgtggctcaattcctcatccaaggatatgagccaaaaccaaggtgatgcatatcgtgattctgtttctccactagctaagcattatgttgacgaccgtaactccatgcattctgtgggctattacactaacctgccatctgtaggttggacctgtaacactactggtcttagctcaagtgaattaaggtcttaccttgaacaaaaagttgaggtgggatttaaactgaggtagtctaaatctagtggcctaagccactgtgaagttcctttttctttcctccattattatgtgcctttttttgtctaaaccagtggttctcagtgggtgtagcactgccctctagggaccattttgtgagggtggttttgggcagtgacaacaactagggagtgccacaagcattttgtgggcagggacagggatgttgtgacatgtggtctggccaagcccacatgggaaaactgtccctcctcccacacaatgttttaacgttttgccagacagtcatataagtgaaaacctgtttataaacaccaagatacatcaaaacaaagcctctctctctttttcactgtatcctggactatcatgaaaattaaaggaagcttgtacttagtttgcttagaactttaccaagagtgcctgagaaaattatgctacagatggccatgcccaagcagcaggagagtttttcacacctggttgagtccacatttagagaattttttttgtagtgattctacgtagtgaagcaaacatcttccttcttcattgcgtgttctagtgtattcatgcccttgtctttacatgttgaaaatagaattttactataaatactttcattttaaatcattttcatatcacacttatggcactctattgattttttttaaattgatgtgttgttttcatttggcttcccttgggaacagaccctgagccaaggtgttgtgtgcacgtgctttctataggaggtgatgacagggaacagcgcagaggagtggggatgtgaggaagggaagaaaaagcagccaggaggagtgggagtgttataagttggcagtgtggacaagtggggctctgtcttgctggggagctctcagcaaccatgtagaacatgcctagaagtggtcccatctgagggaggagaaaagctggactattttttttttttatctttcccccttcatcagctggctgaggactgctcctgggtcattaacttcccagcatttcttatctgcccgcttgggcaggcagaaggaaaaagctcaggcagagagtgacagcaagggtatttgctagaagatgctgtggatgggcatgtgctagaatgatgagaactgggcagatatgggtggggcactgatgcctgtttcatgtgtgcagatgagtgttaatattgataaatgtcatttctgcatagcaaggggactttacaaaatatttgttataaaagggtttgctgagcctgatagaattgagagcattggtttaagttaaacagagtttctaatagagcaaagctacattgaatatgctaaacacaggttgctcaaagatttttattcttaaagttaggcatccaaattatctgcttctttaagcatagtgtgatatagatgtcataaaaatggtaattgatgtgactggccttatatcctatagaatacatggtcttatgaaagtgaatgtaatgcttagctaatagaaaaacaatatcacgtgttgtgtcaccttagttaaagttttttcaagatctcataatcctaacctttgattcatcatgcaaattacggaagagttggccacccaaggttgaatgcatgtaaagttgtccatcaatcagaagacacatattagaggtgagcaatttaagcaggagtctacctttgattttattctaatataaagtttctttcaaattatgtgttctttcaatgatttgggaaatatattgtcatatatttccttcaaaaatcttactttaggaccgtgatcaattctttttgtaagagtgtctgaaactttttgctttatttcatctacaatttgaaagaattatttttagtcacttgtatattctgcagatgtaagtctactagcaagaccaagaaaactatgtttaaaatgaaagtataaaacatctcaatttggctggatttgtcaacataattattttctgttcttttatcaggctagggaacattctcaggaaaatcattattggtttctacaacagtgtcttccagaggaaatactggcctagcacactgtcaaagagagtatattacagtgaaatttgtatagaaacagtaaagagatttgcaatgcaagctttcatcttgagtgctttatttttccctgacctgagcggcagttattagatcactgtatcatgaggaaatagtcaattgaagacacggaccacagagtcccaagcctgacattaggtttgaacaattgggcaattttggcatatatctagagggttaatagtatagagcaaaggcaatggctttaaaccaaacattttttcttgcaaatgttcagatttttttttttttttttggagagcaattgcaatgtatggaatctaagctattcttaaggtgttgaactcagaaaccaaaggagaaagaacaagtaaaaacaataaaaaatttaaaataaaaacaaatctgtcagtggaaagaaagctttcttgacttgtttatgtacaattcaatggagttgcaaagaggattttttttaatggaaaacatgtcacagattgggttcaagctgcactttagctatttttgtttgtttattttatacacacacaaacacatacccttcaaaactgtgcaaagtgaaatatttgctttcctggatgtcttatcaaagtggtatagtttgaatttataattatgaattaagttcagcagtatattaaacacctagatttcagcccatacgagtaactttagtgcagtctctccatctcttctgagcccatgttctgaaaatttccctgctcccagtatactagcaggtaagctatcccggaggatgcacaacagaaaagcttatagaccaaattaagaggcatgactcacattgactcaaggagaaagaagccaggagaaagaaagaaataggttaacacacttagactaggtgacaaatgtgtggaagaacctcattttctggttatgctgtgtttgaatgctctctttaccatctctaccctctcaatggtgatgtggttatgaggaccatagttgaggtttgaacaagggagcatggcagatggtgagtgcctggggcccactacacacacttgctctatcagaaagacaggggcaagtgggcctggccggtatctcatcagttcattggtgaacagcaggggggtttacctccatttctgtcagagaagatgtaaggccaaatgagactataatgagtatcaccaatgggaggataatttgaggataacattgctgtcactctagaggtgacatgattcatgcttctgacctgttcttaccattcttttccattttgaaatgacagtcttgtttgttccatcctttttatcatatagcatgtcttagaggttacttagtactgcatttaacacaattctatgaatcctgcctatatctcaaaatctgctcgcttagttattatcaacacttaacacgagttatatatcccatttgtttttattttcttctatagaagaattgaatattctcaaataatacagcaagcatattacactttttataagatgggatgacagctaggtgtggtggtgcacacctagagtcccagctactcaggaggctgagacagaaggatcatttgagcccacgagttagttatgatcgcaccactgcactacagcctcagtgacagagtgagacccagatacccagtctaaaaagaaaagaagaagaagaaaaaggaaaatgggataacatatatcagtaactaatcattttaactgggtgatgggcaggttctatgtatggactgaattgtgtcccatcaaaattcatacattaaatctctaacccccaatgtgatggtatatagagatgggacctttgggaggtgattagacttaaatgagttgataaggatggggccctgaagatggaattactgctgtgataataagagacaccagaggccttgcttcccctgactcttggcttctcaaggatacagctagaaggcagccttctgaaagacaggaagagagccctcacaggggaacagaattgtccagaaccttgttcttgttctttccaacctccagaactgtgagaaataataaattcctgttgtttaagcctcctggcctatggtattttgtatggcatccagagctgattaatgcagtgagtatgcaggcattcattatactattctctctgtttgtgtatgtttgaaattttccgtaacaaagcaaacttaaatgtttaaatatataaaagagaatgatagattataacagtatgtacttcctaggattattgtgaggctataaagaaggaatatttgtaaagttctcagtagattacatagcttattaaaaataatttacctgacagatatgttttaagcaactattatgtttcaatcactggtcaaagtacttgagatatagctgcccttgtggagcttacattctactgatagcagttttcattattgttaatagatggtttcacatcatttctagatgctgtgacattcattattattacattcttgggcaattatctcattaccattgcatttttttcttatttttgtgatttctgaatctttaaaaagctaagaaggtgatagaactgagtagagatccagcaagtggcaattctatgaaatagtaataatataaccctcagttaacatacatccatacaaacagacaactatgtaaccaggcctgtattactgaagatcatgttttattgggcagtatggtgaatcaatcaggacgctgtcttgcagaacaagtgaaacataccactacataaagtcttcaaaacaatgaaaatccagaaacagcttctcaagcatttgatgtttttcaatgtaaaaaaatagatatttagggtatttctctcaaaaaaaaaaaaaaaaaaaggaatagctcaaatctatgctaaatactttaaattccttgggctatttggctaccctagggaaacaaggactcatagaaattgtggtcagaagcatgaataaggaataggtgacatgttctgttgctcacaatagaaccaattctccattaggttcaggctttattttttttccttcaacaaaatgcaattagattctccaaggcatgtattaaatatgaaagaacagacactgactttgtagtggagaaacccagcagataccaccataatcaagtgatcaagattaagataatcagtaatgagatatgtcaacattatgaacctcttggtataatggatcaagaaagacactacatcactgctatggtattcttgccatagccacagtccagtcataaccatagtctaatcatgagaaactataggcggacctccaaagagggacattcaacaaaataggtaattaatactcttcacaactgtcaaaatcataaaagaaaatgaaaagctaggtttattcttctcatattgttatggcatattacattaattgtttttcaagtgttaaaccagccatacattcctgagataaatcccatttagttgtgtcatgtaattcataatcatttttatatgctgttggattattttttatataataagtgtttgagaatttctgcatctatattcataagagatactggtcttcagtttgcctttattgtgatgtctttgtttttggtgttatagaataacttcagaagtgttatctcttcttctattttttgagagagtttgtgaagcattggtattctttaaatgtttaggagtagatttaataatttttaagctatcgtaagaaaacatttatttagttcatatttgtggtatctaataaatgaccaagaaacaggatctagtagtatatttttaaaaatgtaaaaattagaaattcatagcacatgcattttggtttttaaattaaaaatatttgcttacaggttttattatttcacagctactttgccaagttttcaggttgtctttctcaggaaccactctgggatggaggttaatgtgcaggacgctaatatggaaatgtttttgcaatcaatatctgcagaagggaagaaggaaacagaattgggcagagggagaagtcacgtgatgatgcaatgtttatggagcatctggtgaccctactgggagctctaaagctgagatgattgtttcaaaatggttccaagttggtgtgaggagtctagacctgtacattctgagacaaccagttattaatgcaggctgcacccaggaacgaatgtgatcttggaataagtagctcctctcagtcaagggtaatttctggagagggctgacagctgagggctgtcttctggcaacatcccttgaagctggggcactgtcctgcacagagtctgggtggtgcatcacagcacgaactgggattcttaaactgagcatgatcctgctccaatgcccaatgtatttgacagttatgtattctctcttggatatggtttaaaatttaacagctctaggaaaataagaactgaggcaaaataccttgcttcaagtgatgaaaagggtaataggctgagtattctgtatttactggtcagagcagagtcattttgatctacatgcacacagtagaatcgaaggaaacagtcctcatttttcttggttatctggctcatttgcaggaataacacacacacatacacacacacacaggtcaatatatgtggatcttaaataaatatgcagtggggccaacttgtagtggtttatgagaactgattgttaaaatgtcaagaattctgtgagctggccgggcacggtggctcacgcctgtaatcccagcactttgggaggccgaggcgggcaaatcacgaggtcaggagatcgagaccatcctggctaacacggtgaaaccctgtctctactaaaaatacaaaaaaaaaaaagaaaattagcggggcgtagtggcgggtgcctgtagtcccagctactggggaggctgaggcaggagaatggcgtgaatctgggagatggagcttgcagtgagccaagattacgccactgcactccagcctgggcgacagagcgagactccatctcaaaaacaaaaaaaagaaagaaaattttgtgagctgattattaaaacacaggctttattaaaaattaaattttataaactcacaatttaataagttatattaaatatgaagataataagtactcaatacacagcaattcctaattactatattttactattacctatgccctttggtttatttatgtctattatatttatatggtggaaatagtatataatggtgaatttctttgcatcctttccaattctatgttcagtgacatcatatagatagtataaaattttccatgttggggctatttacatggcagaaaccaacaaatgctaaaaatcagggcttgatgtactattttgctggttaatgagacttaagaaatcttgtcagtgctataaatattagagaaaaagtacactagccatagtaaggtgatcatattattactcatctaatagcaacaccaaagcaaaatctgctaatttcatgcataagtgatggtttttgtacctggacagcagggataccaggggaaggctgtcagctgcctagtttgggtctggagacatggaagactttgaggtggggagtgccagttggtttgaggcccccctgcaccccagattgctgttttttatggttgaataggcagacacttctttccctctcactactgcaagtgtatcattccagaaggtatggtttggccaaaaggcatagtattcctaaagaaaggagttccaatagcttttctctgctaaaagatctcagggtctgattttattttgatattaagaattttacctaactaaaccctagtacaacatttttttaaattatgggtaattaaaaacttccatattttaaacagtagtaaaggcacactctgcaaacatttctgtctgcattacctaaaatttaatggatcaggcaaatgatacaaattaggcacacatttgccaatatttttaattagcctactggtttacctgcatacatttgttactgtaagttattacttataagagttacttcaaattcaagatcagcagaactctccataaaattatatacctgtggcactatcaccaaaatataacatcatagacttgtcataaataattcagagatttgttgtaaccattcaacatggtagtgttaatgtgagacatggagaattagcatttgaaatggataattccatatttatttcatgccttcatttattttacacatttaactgctttggtttaaatggaaggagaatcctttctcaaaattcaatctcagctgtcttcttttcaggttaatggttgatttctttcaaattacaaatcttggttcaacataaggatgatgacatattgcagaaatacctttctattgcttgaaatgagaaaatgtatttacttattttctgtgacaagtgagggggatgctgttatggcactcaaaatgtatttatggtatttctattagaaaaaaaatctcaggaactaattatgaggcaaggcactggcaattctattgttgtattcaaataactgtgtggcaacttttccaattttgacaaatttggcttaaataataattcaatgatgcccctcaagtttcaaatacagacagtcccttacttatgattttttagttttatgatggtgagaaagttatatgcattcaatggaaactgtacttcaagtgtccatgcaaccattctgtttttcactctcagtacagtattcaataaattacatgatatatttcacactaaattataagctagactttgtgttgaatgattttgctcgacggttgtctaatgtaagtgttctgagcacatttaagatagagtaggctaagctatgatgcttgataggttatgtgtattaaatgcattttcaacttaccatgggtttatcgggatgtagttttatcataagttgaggaacatccagatttgcacttttctaacagcctatgttgtgagcaaatttaaagacactgtgctttcagacaaattaagaagcatttttaggaactggatacttcagctttagataatagtgtgcatctttctaaaataactcatatgcaatggcatgagtagacatgtccagatgtaacgaaccataggctagaatcatgtcctaaaacaatctaaagaactacagacacatatgcctttaatgctaataaatcgtcttatctcagtgtcaaagctattactacaatttaagtttaacctctttggaaactttctgttagtatattggtattttggtgagtatatcattaaaccattaacatagtgaatagggtgctcatacatgaatgtaaatgtgagtgtatgtgtatgtgtgtgtgtgtctgtgtgtgtgcactgtgtatccacatcacttcctttccctgagttaccaaacctgagttttttaggggccagcaatccatgcctttacaacactctgatgttgatgtggttttataatatctttgtggtatcacagaaagaaagttgacctagaaatctgaaaactaatatttgagttttggcctttctaattaattgctgtgtaagcccatctttttatttttttttattagtgaaatgaggaaaacaagatcttcccttaatcaaatcaatgggaaataacaagggttaatgaggatattaaaaatttgaaactcttaaccactgcagtggatgcgtaagatgatatagttgtggaaaacagcttggcacttcctcaaaaagttaaacacagaattatcttatgatcaaacaattccacttctaggtgtttacccaaataattgagaatataggtctgcatataaacttatacactaatgttcatagcagcattattattaatagcaatagccctaaagtggaaacaatccaaatgtccaccacctgatgaatagataaacaaactatgatccatttgcaataaaaaagaatgaagtactgacacatggtacaacatggatgaatcttgaaaatgttatgccaactgaaataaaccagtcacaagaggcctgattccatttatctgcataggaaatccgtagatacagagagtagattaacggttgtcagaggctggggataagagatgggaatcagggaatggggtgtgactgctaatagggtatcttttttgaggtgatggaaatgatctggaattaaatagtgatgatgattgcataactgtgaatatactaagaacactgatttgcacactgttaaatggcaaattttatggtatttgaattatattacaatttaaaatttaaaaaccttgtcctgtttatcctggaggattgttgtaggaatgaaatagaagtggaaagttctataggctctaaatcatattcaggaatccatgccattgcatggtgaagcacgtaggcctcagtgtacgcaacttgataaagagagtttgcatgaaaagtcatctttatgttgggtaattgggggtgtcacatggagggttatcactcagaatgcttgctgtgaagagctttatagaagagttatataaattacacacaaaaaagtatttttttaaatggaaagcacaagagagatggagataaatcgaactttctgttgggacctgccactttctgctttacatgttaatagtgactgtataataactgtcttcctaggctgcgaaaccctgaaggatggaagcttcgtgtggttcatctccattactctgcagcaccctgcgtatagagagtgcacagttagtaataaatgagctttgacagatttttttttttttgagactgagtctcactctgtcgcccaggctagaatgcagtgacacaatctcagctcactgcaacctccacctcccaggttcaagcgattcttgtgcctcagcctcccaagtagctgggattacagacaagcaccagtaggcctggctaatttttgtatttttagtagagacggggtttcaccctgttggccaggctgctcttcaattcccaacctcaggtgatctgcctgtcttggcttcccaaagtgctgggattacaggcatgagccaccgcacccagccagacttttctttttaaacaatatcctgtttggaattctaagcaaagtcagcaggctactgaatggacttcaagcaccaccctctgggacttcacaggctgctcctctcttgtttaaatgtggaaggatggaagctcaccccaggactctaggcaaagccagaacttgaggtcagcgcatctcacactgcctctaggccaccagggcatgtcttttccaaactctcttagggctgctctctgtgactttcctggtgtgatcctcaagccgtcctccctgcatctgtctgtgtttatctcacttgagctcactgcagtacttgacacttgtggccattcctttaggatgcttgcctctcagcttccaggacaccactctcctctctttcctccttcctacttggctgtttcttctcaattgtctttgtggccacctctggcttaaaccctctgtgactcctttgttcaccctttgctcttcttgcacagcagtatatctttacttaccagtaccagtcaaaccctaacactggtggtataggggcttcagtgactacaagtccctgattcccaaatcatggctcggctaagacctctgtcttgatctccattactgaatatccaactacctggtggaaaattccattgcatgccccagagtccgctcagtctcagtgtatctcaggcaacctgcttggactcctgtaactaatgccattgtgaatgtcactgacatgagtcttatgcagtcagaaatccaggagctgttctaggtctctctgcctcacccctctccttccagccagtcatctcttgcagtcctgtagacaccccctcccccacaagaactctcatatcctttgtcttagtttctgttctctctgaagcaaaccctgagaatgagacaagtacttggttacaaggaatttattgggtagttcatttttcccaggaagctccatgagggagtagggaagtgagacagggaagaagcaaaaccaataaagagtgtgttaacaaccaggtgattgctaatggcaactggggcacagtttagctggggagcttctgagaaggcacgtggaagctgcttcagaattgccccgccaaaggacaaggacgctgaggtatttgtctaccaacccctgtcgcctccttgttcgagatctccctcttgcatagctagcaccttgagtcagtgatcaccctcaggcagtctcaggaggttatctgtggctatgggagtagtctgcaggggaacgctgcaaagaccaggagcagggtgacagcccaagagcttctgtggtactgtcttctctactctctcccagccaccattttctgtcacttctcagctgaaccactgcactggtctccttgagactttaaggtttttaaaatttctttgtaactttttgcacatcctgccagaaagattcacacacacacaactgaccatagcatacactccttccctctgattagagatcttagaggctcctcagagttttcaggatgaagcctgattaccttagcatgtgcttcccaatactccaaggcacccaaggctccatagcaattgcatgggggttggacaggatactgtaacatttgaaaaaaatgcagttctttaacatttgttgggcatcctggtaactattagtttaaaggcagtctacagtttcaaaattagatcatgcaacgttccttttcttgatgctacgttatttccaagttgagttcatgactattgctgtgattaaaaagcatatgcagaatgacaatccatgtggaaaaggaaacatgggcggcaggggccgagctggttcaaaggtttgaggatttgcacagcgccaacaggaccaccatcccattaccaaataattgtggttatttaagagtgaaatgtaggtattatttttccctttatatgtatgacttttaaaaataggtactgagctgttagtattaaacccttactacgttgtttagacttatctacttaagaaaagaaacttttaaggcatttctttacctaaggccctggccaccctcttgtgtctcctctgctgccactcttaaatacaaatttttggctacctggaaggtccaggaaggtcatcatgcctttgtttgtgatagcacagactattccatctgtcaagattaccttcctcacctccccaccaccttcaccagccctacaccacacagcttaaggtgcacttctgctaggatgagtctctgattagtgttttttgccccaggtattattttgttgcctctgtgtctgcacagccttttgtacacagcttttatgtggcaatattcttactatacccccactggtgatgtacttgtctatctgccacattgttccacgatttccatgaactccatgggcacagacgttgcattcgctttgactttgctggcattttttattgggattatgtccatttagcttatgataaattagcatgagtgcctaagatgggatatagattcttgaaaaaaggtgaacatataagtcaaaggattgagaaaaatgtaagaatgtatgtgaaataataagcctttactctttttcttcttgtttatcatttcaacattttatgttgtgattttctgtgtatatgccacaggacctttgcatatgccatcctctgtgtttagggggatcttccttctcccttcacctgagttacctgcctcccttcttatcctttggatctcagctctgtcttctcttccttgggaaaaagttttacatttatatttgtatgcttatttgaatatttttcttcttcctccccagttcatgagctccatgagggtagggacaaggtctgccctgctaattattggatccataattgagtatattgcctaacatgtagcaggcattcagtaaatgtttgtagaatgaatgtagaatgaataaatgaatgttgaatctatgaaagcttcatgtttgcatcaagacctgatgactattctgaagcagtgggatgtagtttttccaagagagagtaggaatgttgtctacattgtgagaacagaaaggatttaggcaagggccagcagggaatggaattttagttccaagcttgaaagaaattgggaatcattttaggtttccgaaaaaaggggtaggggtcagatgatcaaaattgggctgaatgcaacacagaaagttctgtttatttaaccacttgcaatatttcacttcaaaatggattccctgccactgagaagctgccatgttttcatttgctggaacgtggtgaagttagataaatgataatgccatgtctttgttcattcctcagttagaaagcctcagccttaaatgctccccagtgcaaattctcactgaataaacatggagtgtattgttttacaacatgctgctcaatgacattgcagcacatttggcactgctgagcatttcaggatgaggaggcagaaaataacaacagcaaaaagcccataaaacaaattgcatcccctatattccttaatgaaggacttgggtgtaagttgcatcaacgtcagagaatactcattcattgcaaaggtttgggaaaatcatatttatgcataatctccttgttctcaatgatattttattaatatttatttcccttttgcctttcatctggtgttatcttcttttctttttcatctttattttccaagtgactagctgaaaagaaaaacagtgaatcggtgctaagttgctattttttcaattttaagggactgattcttaatcaagttactattttaaatgtttaaattgagaaagttccgggtaacaacctaaaaaatgtaaatacataccacacagttaattaatgtttctgaattgctactgtttgaagttgataagccccatgtatgaattcctcagctcaaagctgagggagttatattaagaagacagtagaaaataaaaataattagctagtgttttgtaaggagggaacataaatggtatctgtgtggctctaactttatcaattcagtctgttgatttcaaaattcagtcatttgagatatttggtattatgcagattttaggcagcatgtgaacaaagggctaaggtaaggattattgtattgcatgtatttctgtgaactaattttgaggagctatactaggcttctgttttatgtgtatctataagcattttacaaaacaattccatatgtattgctaattaaataaattcatctcaaagtttgttacaaactcaatcaagtgtttgagatgtagaaggaacatatagtttaatcctgtaccagtcaggatagcctaagtcatgctgaagtggcaagtgatctcaacatttctgcagcttacagccacaaagattgagttcttactcaggctagatgtccatagaggcagctccagctccactacacatcaccttcactctgggactggctgacagagctgtctctctctggaactgttgcttgtcacaacagtgagagagagaaggcggttcttaaagctacatatggcttactgtcacatttcattaactagaagaagtcattcggccatacctacattgaacaggacagggagacaaagagggataatcctccctcaggaaaaaggtatcaaatacttgtgattagtctaccactcactccttcatattttggatatgaaaaacatcaccagaaggattaagaaacttggccaagatcacttgcaaagctgggattggaccacattcctgtgacccaattgcagacattcctgtgactacatccagtgtctccttgtatgcaaatttgtggacacaccatggcatccacagactcaccagagaaggatgccacctacagagccagctgctcaccagagcctggcttgcatcatggcatcactttgatggggtcagcatattcgccccttgactctgtaggtccaaaatttgcatctgttaatgtatgctgtatcagtcaggattcagtcatggaggtagaaccgtatacattttggtgcaaggaatttattataggaattagtacttaaaccatgtgggaggaactaggaaaatgaagaaacaagggaggagttgaaggccaaaccagctactttgataagccaagtgtgttcagtcatcaaaataggcaggaaagggaaggtttttgggagtccagtgggatgttgggcttcggtgtggctaccactgctgtaggaccaccactaaccatttaggtaatgcctatggctgcttttgcactatgacagcaaaattgcatagttgtaattaagactcaatgacccacaagcctatgatatttactatctggccttttacaaagtttcctgacccctggtctatagttcagaagattgatttgctgatctatagtaagaaactcagctatgcagcaggtccagcaactacacagttccaagataagatatcatttccccattgttaaatctatgtgcaaagctaacttatgattaaattatggtaagcttaactgtaatacaaggaatcatttcatactatttgtaaagcagtgaacactagcgtaataagttatgatcgtggaggctaccacctgcaccatccataccccgagggctggacactcataactatgggtgaggccattccttccgctggggcaagaataactatagatgcctatgggaaactgatacaatctcattctctacacttcctttatatgctgaaggtcacaatctttattcttgcttagtgaagagagaatcgactgagctacatccacacactattcaccataatgagaattggaatattacttcaaattctgcagtcaccgaagcaaaatctgtaacagggtggatttcaaaaattattttttatcaaggcataacctcatttattttaggttcatggatgtaattttattctccaaggtaaccttatcttcaaattttataggtctcatgctgtcccccatcctgtatcacctacaggtgacttttccttgatatgacttatagaacattaacagtgctttcttttcaatcatactccgatttggttagttccaacttaggggacacttactttaaaatgtctcttcaccctgcaggaaacgagtttattagtgaaactttcaacggatatttttattccatttatgccatttatctctccatgccttgtgaggcaaaggagtggtgtttcaccaggttaagaggtaattgatcaagattcagttcaaaaaaagtgtaaacagtacagatcttaactctcttcagtacttttaatcaaaaaggaaaatcaaagcgtatcagccagaatcatcaataactcttggtggatgttcaaatgcagtgacctcttgacacttccactgccttcagtttttgtttttatcatttgttgcttagcagcacggggggaaagagcaggactgtagcttggatttaagctcctcatttactagctgtgcccttttatcaaatcgtttaatactgggagccccacttttctcatctgtagactggggatattaatggctcctatctcaagcagttttaagagttaggtaagttgatattgaactaatttgacattaatgttaaatacttatcatagtacctgagtatacctgagggcatatccttcattcatctaacaaacaaggtgctaaagacactattataattatcacagtagttctatgaggttgctatgattatcttttttgtttgtcttttaacaaagaaacagagaatcagagcagttaaatgacttccttggtcataatcctagagaattttagagctagagatagaattcagatctatctgactacaaagcccaagcttgtggacttaccctccatttgtcaaacgtgaattccttgaattgtaaaccatttggggccaaagcacacctttttttttttttttttttttttttcagttaagaagctggtaattgagtgaacacaatatagtggtacttcagttaactggagctcctggggatacatcattctggacagcctagcattccagaaagctttgggtatttgccaaaactttaaaaatgttgtttaatttagatagaaccctccataaaatatatatttctctatcttcttaaacagattatattgaacctgatttaagattacattaactcagtcatttatcatcgtgaacttcatttttatcctgtactctctaatgtaagaagattctgaggttttattgaaataaagagggatatcattgacctagtctgttatgcatttttaagttcctgtgtttgatttgtaaagtttaggtgcttcctgtccaagcacttgccacttctctttgcctatttgaattgtcagtctcccacaagaccacctgaaaactctgttgacgaagcaaaactaggtttattaaacctatggtacaattggcaatcatcactttgacagtcttggcagtatttcaaaatgagggaattaggttgacatttacatggtagggtatgaactgggtggttttaaggtgagtctcacaagataggaaattgtctgggattgggtagagttgataacataagagctctggagggcacagtgaggtgaaagatttaaagcaagtgttgatgatcaagtcattggtagtaataagcaagctctttcagttgggtcacagttatattttacaagagcacgtatttctttgagtaagaagctcagttatttttgcctagttccaatattaaaataggcaggtatgtctgatcccaggattgtatggtataaggacaagaaagcatattgatttggtctctcacttgactctatgtcttggtgcttctacatgctatggcatgggacactcaaaactggaactgtatggcaacagagatccagtaaaagctaagtgggagcccaggaaactgacttacacacatgagttttgtgcttgggcttgtgacatccatttttaaaatgcagagactcctttttttcactcctttttttcttgcttaatccctggatatctttctaatgtcacgtagccaacaccatcaactaggtgagcatcagttaggtatctatttctgcactgggaatcttgaatttataaatcctggtcaaaagcgagttaaagagatttttaaacaattacacaaagtaattcttgtgttttatttattcagtttatattgagttttttgcagctcttactctcctcttcttttgtgtttgaaaatttaaaaagtgatgctgtttggacacgagatttgttttgtaaacatgaaatttagaatgtctggggattctattaacactttttgaaaagatattgccttgttctagagttcttgagctattatataattgaagtaaatagcctgagaacatagggatttggtgtggaatacatggaagataaagtgatcaagcaagtttaaaatatacaattagtacctaaaataaagtgagtattgttttacatcttcaatctagtagtcggcaaataataaaaaaaggtcaaaagtcccaattatatagtaactatcgaactggaaaaagaaatgaatttgactcttactacttaaaacttttagctgtttatagtaatttaaaccaattgaaaataaatgttccagccagcaaaaatcctttctaagaactatgtgtggtaagaggatacaataaactaatcaaacaaagtttctgaagtctcattaaccacggaatttttagtgaaatggcatggatatggtatacttggatttatttggaaatgacagaaatttcctaacaatatttgaagcctgttttggtgagtgctatcaagggctgtttttctttttcttttttctagttatatattcagtactataaattgttggcagctggcccagaaaaagagcctattttcggaaaaaaaaattattctgcaactttatgctataacttaaacacactaaaaagtgtgtttaaattttattgtcagattaccagcttttatgcaggtagactccgtggaaaccataggacaatgacaaagttgcttcttttctttctcttagctatttttttactctggattacggtgtggatattaatatatatactttttatcaagtatagggaacaaaaagaaaacctgcctgcacatgtaatctttcttacaatatacatacctgtgaaacaccagatgagaaaagctatgatctgatttatgtcatgcgaaatgaatgttaataaatcctatttagtcacacagatgccaaactgagacaaatggaagcctctgggggcaagtggaggtgggcaaatgggctccactgatttatgagtgcagagtcatgaaattgaattcggcaacctacaaatgacacttattgagaacctatcaagtgctaggcacccatgctggtactttgaatacagaaataaaaggtttggattgtaaaaatgtcacagtataattgacaaataaaacaagttaattaaacaatatggtaagcaatagaagtgcaccctgcataacaatgttttggttaatattgatggtcccatgggatcataatgaagctgaaaaatttctatcttcttaaggttgtaacacaatgcatgagtcatgtgtttttggtgatgctggtgtaagcaaaccattctgtgctgtcagtcacacatttatgtacagcacatatatatgtatagcacacaatacttaagataataaactatattattgttttacgaatttgctatacttcttatcactactttagagtatactttttctacttataaaaaaatacaagttaaatgtaaaacagtctcaggcagttccttctggaggtattccagaagaaggcactgttatcacaggagatgacagctccctgcgtgttattgcccctgaagacctcccagtgggacaagatgtggaggaggaagacagtgatattgatgatcctgacttctgtgtaggcctaggctaatgtgtgagtttgtgtcttggtttttaacaaaaagttcaaaagtttaaaaaaaaaggtaaaaatacaaaaaaagtttatagaacacatatatatagaaaaagtattttttgtacaacatacaatgtctttgtgttttaagctattatttccaaaaagtcaaaacgtttaaacaaattttgattttataaatttaaaaatttatacattaaggttactttattattgaagaaaaactttttaaaaataaatttagtgtagcctaagtgtacagtgtttataaagtctacagtagggtactgtaatgtgtgaggccttcacactcactcaccactcactcactcactcctgaaggcagcttctagtcctgaaagctcccttcatggcaagtgccctacacaggtgtaccctttaaagaaatcttttataccatacttttactgtatcttttctatgtttagatatgtttagatacacaaataccattgtgttacaattgtctgcagtattcaggaaagtaacatgctgttcacatttgtagcctaggagcaatagactttaccatacagcctaggtatgtagtaggctacaccatctaggtttgtgtaagtccctctgttgatgttcacacgatggtgaaatcacctagcaaagcatttctgagaacatatccccatcattaaccaatgcatgatgacaggtaaaaaggttgattactgccaaatagtacttttgaaaaagttaaaactaggactttcacacaaatatgaaatgaatatatgtcaaagattttgttaaacctattgataaatgagagaaccagtaaagtgatagaaccagttcaaggaacgtttgcagagctagatattcataggcaagttaataaaggaaaattaagataagattgctaagttagagataaaagcagctaatttcctacaggacaagagagcataacttttggaattatcatttcttctagatataaataattattttagtctctgttgaataaaagtctacaaatgtagacatgtaacctcactaaatctggactcttttatcaatagtaattggtaggttggacaaagctcatctccatagaaattcaaggatgcttctttccccccatacaacattctgctgcttatcttttgccttattttcaagttttgggtaattttttaacaacaacaacaacaacaaaatttaggagcaatagcatatgagacagaggaaaaacagtgggattccaggcttcctcactgggctttgttaagcagaaagttaaggagagaagacacctgagataggccttctacaaatgagaaaatttccaataggacaaaatgtggggggagctggcataggtagaaggaaggcaaaaacaggtaaatcccaagaaccatttgacaggcaatgttgtatttacttttgtaacagatatagcactgtgactgggggccagtttatgagagacattactttatactttgctgcatttgttgtggtgatggtttttttaagttagaaaatcagatcatctgcatactgaagagcagttatgagtcagttgtttttaaagccatacatttatatgttagagaatttaaactctttcagaggaaaatgcaaaagcaatgaatgtagaaggcagtgaagacagagatgattttaatgcacccaggtattaaaactgagcagagcctctaattattcaacattattctgaaattctctttcatcacaccataggcttttttttccctcttcttttctatttcacctccatttcttttctctctggccccagatatgaaatgaaatctgggagcaaccacaatttctgtctcactggctgagcaggatgcttctgaaagaagcagcatctatatatagtttttcttcttaggctgcaggtgtgggatggaatagaatgaaatggaacagaatggagcaaaaaggaatggaatgttatctctcctgaaattttttttatttaaattatggatgcataatagttgtacatatgtatgtggtacatgttatattttcatataggcatacaatgtataatgatcaaataaaggtaattgggatatccaattaccttcagcaatagtttttttgtgtgttaggaacattccaatggcactcttttagttattttaaagtatacaaataatgattgttaatcatagttgccctattgtgatactcaatactagatcttatttattctaactgtacttttgtgcccattaaccattccctctttatcccccctccccacttcctttcatagcttctggtaaccatcattttactttctatctccatgagatcatttttttttttttagctcccacatataagtgagaccatgcaatgtttttctttctttgcctgacttatttcacttaatagaatgtcctccagttttgtccacattgttgcaaatgacagtaattatttttaatggcttaatagtattctgttgtgtgtatgtaccatttttctttattcaactgttaaaagacacttaggttgattgcatatcatggctgcagtaaatatgggagtgcaaatatctctctgatacactggtatcctttcctttgattatatacccagtagtgggattgttgggtcatatggtagttctgtttttagttcttgaaggaacctccacactgttctccatagtggctgtaccagcttacattccctcacaacattgtatgaaggctcctcccctctctccaaatctgtgctagcatttgttattgcctgtcttttgaattaatctctttctgctgttaataatgtaataatgtatttacttagctccatttttctctttgatattaatttccattttgcaaaagaagtcacattaagaaatgtttattaatttaaaatctctttactaattgggctttgccagtaggtaataaactatgggccatgaggttattcaatcttgcagtattttttccaggaaggtggtaaaatatgaccatagaacaaactattggccttgctatatgagctgctgtgattagacatttccaagcccagcttaaggcaacatctaaccagaagagctctaaatataaaataaatgaggtgctgctctagtaatccatttatacacagcatttattttagccattttttttcatttgactgttggcagtcgatcattggatttatacggtttggcattgatcttggagaaggccagtttggtgcccacgtcaaacatgcccaatattctattgtccatgtgactccctagaattaattagaaaacatttcaaaagggccactctaggatttaatactatcaataatagttgtttaacccaaaatatgatgaatctttgctttatttatttctaattgggcagttttgcattttgccgagtaggattaataagcaggttaagtctaattggcttgctttgactgaagggctgaatcatttcaatatagaaacctgtactttttataatttgaaaaaaatccacccaaatcaatcctgaacaatttttattttactttctcaatttttctttttaggtcatttaaacatcttgggtccttttacatgaacagcaagactgatgctttttgaagaaaagtctgtcttcagatagaaaaggcttctgtttgtatagaacaattagctaaaattagcatgtaaatttgaacaatattatattgtgaagctgattgggcctggaggttgggatgcaagtaacttctcttgtttattgtatgcaaatatagccacttagctttaattggacattgaaacccagaacaattatcaacaattgctttagtattaatgcacagtgggaactgcctatcatgactttttatttttttcttaacatttaatttttaatttttgtgggtacatggtaggtgtatatttttagaaagtacatgagatatttttgaaacaggcatacaatgtataatactcacatcaggttaaatggggtatttatcacctcaagcatttatcctttctgtgttacaaacaatccaattatactcttagttatttaaaaatgtataataaataattgttaactgtagtcactctgttatgctatcaaatactagatcttatttcttctatgtaactatatttttgtacccattaaccatccacacttcccccttacacctacccttcctagcctctggtaaccatcattctactctatctgcatgagttcaattattttaatttttagctcccacaaataagtgagaacatgtaaagcttgtctttctgtgcctggcttatttcacttaacacaatgaccttcagttccatccatggtgttgtaaatgacaggatctcattatttttatggctaaatagtactccattgcgtatatgtaccatgttttatttattcattcacctgttgatggacacttaggttgcttccacatcttggctattgtgaatagtgctgcaataaatatggaagtgcagatatccttttgatatactgatttcctttctttgaatgtatacctagctgtgggattgctggattgcatagtagttctatttttagttttctgagaaacctccaaactgttctccatagtggttatactaatttgcattcccaccaacagtgtacaaggactcccttttctccacatcctttccagcattttgttattgcctgacttttagataaaagcaattttaactgggataagataatatctcattgtagttttgatttgcatttctctgatgatcagtgatattgaacacattttcatttacctgtttgccatttgtatgtcttcttttgagaaatgtctcaaaaccttttggccagattattagttttatttttctctatagtgttgtttgagctccttatatattctggttatcaaccctttgtcagatggatagcttgcaaatattctctccgattctgtgggttgtttcttcactttgttgcttgtttcctttgttgtacagaagctttttaatttgatgtgcttctatttgtgcatttttgctttggttgtctgtgcttgtggggtattactgaaggaatctttgcccagaccaatgtcctggagagtatccccattgttttcttttagtagtttcatagtttgaggtctcagatttaagtctttaactcattttgatttgatttttgtttacggtgagagataagggtctggtttaatttttctctatatagatattcagttttcctaggatttttttttctctttctgcaatgtttgttcttggcacctttgtaaaaattgagttcactatagatgtatagatttgtttttggttctctattttgttttgttggtctatgtgcctgtttttatgccagtaccacactgttttggttactatagctctgtagcataatttgaagtcaagtaacatgattcccctagttttgttctttttggtcagaataattttggtgattctgggtcttttttggttctatataatttttaggattttttatctatttctgtgaaaaacgtcattggcattttttatagggattgcattgaatctgtatctcgctttgggtaatatggatattttaacaatattgattcttccaatccatgaacgtggaatatcttgccctttttgtgtgtgtcctcttcaattttctgcatcaatactttatactgctcattgtagagatctttcacttctttggctaagttagttcctaggtattttattttactcatggctattaaaaatgctattactttcttgatttcttttttggattgttcactgttggtgtctagaaatgctactgattttgtgtgttgattttgtatcctgaaattttactgaatttgtttatcagttctaatagtttttttggtggaatctttagttttttccaaatataagataatattacctgcaaacaggataatttgacttcctttccaatttgaatgccccatcaggactttttaaatggcagagacttataagcaattgatactgcatccaaagaatgacaatctttgtgctcatcctttgcacaataaaatcaagtataggccaaaatctggccaataaggtttctatcagtgtctttccatttcctctaattgtgcctttttgctttgtggaaattaatggaagatgcctctttgaataaaaggaagttcaaaataaaatttactattttgagaagatccagaatgtggactgttttcaagcagatatttgacagttcttaatctggtgggattctaaaaggtcagtaagttggcttcctaccagttattgctggggcaaagggaaccttccttcattctttgattcagaatttcagtctctagaataaacttgagagtagacaggttaataggagaaaaagcatacacatttattatgtacatacacatgaggtcccacagagtgtgagactcaaagaagggcaagatgattgaagcttaaaaagcattttgagctacagaaatagggttttaaagactcttggagggtggtggcaacaagctatgaatgggtgaatggaggaaccacactgcagacaaaggatgtcttattctgcggatagtctcgcaggttgcagccctcagaagaataggtgaaaagtctctctgagcacagtatcctgggcatggagaccttttagtctcctctcctgccacaaagagttagaggatgaggggattaacaacaatctcattcctcctggaggaattttccctagtgaaataagggaacttcagagaaagccccctgaccaccccaaacttcatgagagaaagaggatagtgagatggacagactgggcctggggaatggtgagaagtgaagtgggaggggtcagagagaccttagatctgaggctgcttctttagttaaaagcaccatacttctgggtattgttttctgagcccaaacattattaaatcatattatatttgaatatcacaaatgaaaatcattacatgaattaatcagatcttgatgttcttttaacagtatggcagcacctggagaaaactgtgaaataggtatacttgatttagtctttggctttagaattgcaaggaagaggtgctaagaagtggctatttgatcaccctgcaagctctcctctctgtgttttcctgttcccaggttttctccttctgctttggtctgccagtcctaaagaggaaacacattcacactcaatcaggagtaacttacttccattcactcttccaggagtatttgagcatcaaaatgggactgtgaaaaggaaatgcattatctgaaggaatggatgccaagaccccaccagcaaatgtggaaatttgaggggagtgggttctgtgcacctcgaattcagccacatgtttacccatgctactctacctaaccaatgagctgccctttcttggcaattcagtcttctttcaatatattaagagcagggtgttatcatgtgactcattttttttcgatgtaactttagctgcttgcagaaataaaattgcttcttaatagcagatctaaagagggacaaatcacaagaatgttccagttaaatttatattttctgtaaatatgccaactgcacttgcacttctttttctttcttcttttttcttattttcacattttccctgaaccttctcttactgaaaagaaaataaaaggctataaccatgcacacagatattgctctgttttgaattaggttgctatgttaaccaaaagaaaaaaaaagttaccagctatcattgttccaaaggttgatttctgatttctctaacttctgttgtgtctgcatttctctcctcatttttcaaagaatgaccctcaatagcttaataaatcagctaacaaaatgttttagcatctgctaacattccctcagtgtgttacatgcatgttcaaaggctttgttagaaaacacaatgaagggaaaccacaggcaattctgacaggcaatatgatcgggtttcaaaatacttcaaaaccccaatctttacattaagactttgcttgtaaatatttacattgattgcccagatggtggcagaattggagaatgtggatcactttttttttagaaatgtctcttaataaacttaaagattcataagccacaattgcaaactttagtaaacacagtactacatgttcatgtgaaaagttttgcagctataattattattagttttttaaatcagagcaatgggaagtgaaaagatacaagttttcttcagattttgaggacagcaccttcctgcactatccgtcactaagataagcctgggtcttggttgcttctaaaatagttcaattcaagacaatgaacttgtgttgactaccaacgatgtgaccttcattgtgccaatgatacaaaatcactctaaagtgtagccaggcaaagaattacacagttaaaggagaaaggatgtgactccttctaagtaggtataatcaggatcctcagcagctcttctcttacctggtcagctgcagttatctcctaaaagttcttcttgcttccacttttctttctctctaaaccattctctgaaccacaaatgttccaaatctcaattccatgccactctcttgcttaacacacttcagtgaatccccatcactcccaggacaaagtccaaatcctaaagatggctttcaagacctcccatgaattgtatgtctcttggttacctcagtgaccctgtctctaccacttttgtccccatcctctacttttgggtttagccacacagaactactcatggttacctaaatagggtactctgcttccgtttctatgcaagacattcatccagacgcccttcgcacaagcctgtattctagagggcaggggcgcggggggcatgagaaggcatttagaggaattgttcttgtggcttagcagccattgtgcaaataatgtggattttattagtaggagtggagagaaacaactaggggctaaagccatgtgcaagaggggatgggcaggaaggaccagctctaaggacaagagcatgcaaggcctgcagtgaaaaacctctacgtccttcacgatcccttaaaaatctacctgcaaagcagtcattccatccccctctcctctgcatccccactccaacttggccaacccctaataactttgcttcagaggtcacctctctccagaagactttcccaagtctcaccagcgcttacctccctacccccagggaagggtcccccagaggtctctgctcaaatctggaagggtgtttctcacaggccattataatttgttctttgcttctctgccttctgcaccagactgctcaatttctggaggatagggacagtgccttgtctacctttgtgtccccagagcctggcatgcacactggcacaagataggagctcaaaacctttgtctccccagagtctggcatgcaagctggcacaaaataggagcccaaaacctttgtccaagatattgaataaacatgggatggcgtcagacattcactaagcatgccccagcctctgactcaacccccaggtagagaccactatcctgtcactctcctcatctcccctcaacagatttctaggcttttcttgctcagatttgaaaactaggtagaaaactgtctcactgagacagccaagtaaaaatggctccccagagaacttccgactgacctgagcactgggaggatgggacggggccttgggaagttcctgccagttgcggaggtggggaggagcctggcctctccggttcctgggtggacctgggattcaatcagtgagatgggggcctgtgaacaggaatctttctcgctttgctgagagttttgtttgtttgtttgttttgttttgtttggcccaataaattctgtttttctcacccttctgtgtgtccacgaacctaatctttcctggtcatgtgacaagaacccagtttttagctgaactgaggagaaagtcctaacaacatcagtaggtggcagatgagtgtgaaaagttagtgagtgaaatcagaataatatatattcaagagaggagagaggaagagaaagagaggaagaagctgaggtttgacaagagagaggggagagttttagtttcttttgagttgatttgcttggtttgagaacaggtgttcaagattagtgcaggatttcagaaattgtagcagagaaaaaaagaaatggaaaagaagttgactgttgagacttatgatcttgttgatacccaagaagcatcatttctgaattggaattctttcagattaaagttttatttaaaaatagattgagggccagcgcagtggctcacgcctgtaatcccagaactttgggaggccgaggtgggtggatcatgaggtcaggagttcaagacccagcctggccaagatggtgaaaccctgtctctactaaaaatattttaaaaattagccaggtgtggtcgtgggcgcctgtaatcctagctactcaggaggctgaggcagaggattgcttgaacccgaaaggcagaggttgcagtgggctgagattgcgccactgcactccagcctgggtgacagagcgagactcatctcaaaatacataaataaataaattgaaattcccttccctttttccttactggctttgaactgtgtttatttgtgtgagtacagagatcagactatgagaatcatggactctttcaagagttatgaataaataaatgagttaactaatgaacaaataaatgcatgattgaccttccttccttcagagtcatggctgcagtctccacccatgaactccccacgggaaaaaaaacagtcttctccccagactttggggaatatgaagcagccaaccatgaaaaagttgataacttttctctttctgcaatttgtcttctcaaaagaggaatgccatctgaattagctcccttaacacttcagagccacagcatcttctgaatagctggcacaattttcagcaacattcatttcaaatcctgttgactgaacatgtggttcagatgagagcttattatatattgttaaatgatttcattggattataaatcactgccttcacaattctctgtgggacacacatggaattctggttaaaagatgttcaatattgtaaccctccagagagaggcttcccatgacccttcctcatgcagatgatatggttaagcatgcatggccaggctggcctgcccaacgtggcttggatgaggtttctcttcccgaacttgagcaaggttttcccttagtacttgaccttgtatcatcctctcttggccttcagtccacccattccttagctgtcccttcaccttgctgacccaccatctcgctatggctcccttgcagctgattatgtcttgtccctaactgaaaaatagaaactaaatacattttgaaggaaaatggctaactactgataaatactgctttgccattaggggaattcttgagtaagatgatagtcagcagtgaatagtcagtgaaaagattatcatctcttctgcaaattgtccctggtggagatttgattatatgcttaggggccaccttcctgtcttttagaattttctggagcagctgtcattataattactgaggacctttatgtgaccttgtcatcttgggcaggtagctcctaaagggatttctgaagaagacaattcatattttctgtgcacctgccttctcaatattttttgttttcacttagtgtccctgaaactctttctctcttcacatttcactctctgcatcactaatgaggcttccatttacctctttaattaattaattaattcaatatttatttggcacctattaggccccctgtaggataataacaccttaagctctggtctcatttaggagaatttgcatttatgacaagactctagaagacttaaacttttaaggccccaagaggtaaatttctaatggttggccacccctgagttgggaggcactaatgtggactatgaactggatcatcagcatgtagaaccccagaggcagatttctcctgaagttaataaagctccagcctcggggtctcacactgacacagccttttttttttttttttttggctgtacacaagtgttttcggtcgctttatttataattgccccaagctagaaaaaacccaaatggcttccaacagagcaatagttaaacatccatatgatggaatactacacaacaataaaaaagccaacttttgatacatgcaactacttgtatgaattttgaaggtattatgcagaatgaaagaagcccgtctcatattctatgaagccgttgatataatattaacaaaaagacagaaatataataatggagaacagatgagtgactgccaggggttaggtgttaggggaggatgtgactgtaaagggagttttttgaggttatggaactgttctgcatcctgattatagtggtggttacatgaacctatttgtgtgttaaaattcataaaactgtacaacaaaggacaaaagtcaattttacaatacaataacctaaagataaaattaaaaaaataccttttgggcaaaaatataaattttgggaacggtattagagcttcttagctgcctctgtcatcagttctgtctttggtgcctctcgtgcttgatctttatgtactagaaataccagaatatttatagtaccccaaacacactatgcaatcttgcctccatgttgagccttctgccttcctgatatggaaaactccttttcatccttcaaaaccttactcagagcatgcctcctctgtgcagctattttttctgatttcttctcaccaccagatttaagcacacccttttcggttctacttctgcttcttgtaaattatttcactactgtgtcttacaacttattataatgacataggctagtttttgtaattgtttcttcttttcagtaaattggatctccaaaactgtgtaagcttcaggccccacaaaatctagaccccaaatgaccaatctctctctcaatttgttctagctgctgtaacagaataccataaatgggtggcttatatacaacccagatttctcacagttctggaggttgggaattccaagatcaaagcactagcagatttggcttctggtgagggtacaatcccttgttcatagaaagcatcctcttgccttgtcctcaagtggtagaaagggtgaggcatctgtctggggcctattttagaagggcgctaatcccattcatagaggctccactctcatgacctaattaccttccagaggccctacctcctaataccatcaacttggcgattaagtttcaacctatgaattttgtggggacacaaacattcaggccatagcagacaatctctttccaaaaacagaagatttgtgagatcaaaagccatgtctatcttatttaccagtttccaaaacagcacaggcacatggtaggagcacaagaagcatttgttagatgttgaataagcaattatacgtataatgtgcatagctcttttcctgacatgtagtatgggctcaataaatctttgttaaaagaaggattactttgatgaatgaatgaatatgaagtgaaaggtaggtgaaccctacatttctacacaaggagatgttctctctgccttactcttccctattcatctatggtagcaggcaagctgatttccctaccctaagaccagtgatagtccagcatgggtgaagccatccaggaatagttaaggcaccgtgctacctacacgtggttaataaacaggctcttgttaacaagaaacagttatgtggaaatacttcatttccatctgtaaagttctagatttcaaagtggagagctgggatctcttcccacttcacccactcctaacatttataataaagcattgcctaacacagaattatatttttagagaaaaatgaaacacatgcttgagaactcaatcctattaacacaattttttcagtagtggtaaccattaaacagttatgtatttaacctttgtattctttaagtctgctaaaatgtctaattagttaatcaggaaaataattatttgctaaaaaagggaaatttgaaaattgtgtacagatgcataaaactgagttcaaaataaacttctattttgaggctttagtgcaatcccaatgtattagcattttatgattctttgtattcattaaaatgtttttcacaaaaatattggaaagtttcccaaagtcctcctcatgttcctcctggtgtatatcaaacagaatattggactcatctactcaaatcatagttagaattgtattttgtaagaggctatttccttggaagttattcaaaagatacatgtagggaaatattctgatttataaggtcaatctttctctgtcacaaatcaattataagtaaactgttttcagaactgtcttttttgctatttataatagtcaacttgtgaagcacttaacacacagaaatgtgtctgacaccaagattattgttaagggctgttctttcctttttattcagcattgtacgcatgtaccatttacatttattacgtggataatgggaattcatggtcttgaaggcatagagtgaagaaattacttctgaatacagtatgcaagctgaaaagtagggagtgatcatttcaaggttatagtgagggcaactaattttttccaatttggggagtaaaacaattttataatgcatttccaaataaagtctattttatatggaatagtctacagttgccaatcaacctgcccatccaatgcccctttccattggctcccactatcctaatcctaattagtctcgacttgtcctggtgcttttggcaggaagaattacgtttgctcatgctgttcccttgaccatgacatctcttaaaggcaattcactatattgtctgagattctaaaaattaaacttccctactgggatgggtaatactgagtgtcaacttgattggattgaaggatacaaggtattgatcccaggtgtgtctatgaggatgttgccaaaagagattaacatttgagtcagtgggctggggaaggcagatccacccttaatctgatgggcacaatctaatcagctgccaacgaatataaaacaggcagaaaaaggtaaaaaggagagactggccaagcctccgagcctacatatttttcctgtgctggatacttcctgccctcaaacattggactccaatttttcagtttggtgactcggactggctctccttgctccttggcttacagacagcctactgtgggaccttgtgagcatgtttaatacttactaaactcccctccatatatatatatatatatgaaggatatatacatatatgttctgtccctctagagaaccctgactaatacacctacccaagctaatgctttctctacaatgaattgcaaagaaaatgaaagctaacaaagaagatgagtttggctttttaagaaaacagttgaccagacataaaagatctcagggtgaggaaaaggcagttttcttctgaaggcctacagatggaagggacagtatgggtagctaaggtgactgaattcccctctgcacttagtgtgtctggatacaattattggctctggcaatttgggtgctgtgctttcaggacatagtgtatggtgaatggtgggagaattcaaatcatagactctgacaaaaagtatgctccaattctgtttccccatctaataactacaactgtggacaatgtatttcattaccctgagctttggtttctttatctgtgaactggaaatactaatacctacctggccaggttgtcaggattgaagatagtatataccaagtacttatcacagtggtttgttagcaaataagcactaaacaacagtagctattattgtaatgacgactacatggtccttatccttctattcagggtgaggtgagctaagatagttctaagagtttaatgaagcagcattgcctcatgactggtaagaataagaagacatggggaaaggtgtttatcatttaaggaactaaggtgaacagaatcaaaaaggggttgtattgtatcttaggaaactaagataagactggaatacagccatcaggatctatttgtaataggatgagagctcagttgcaaatacaagttccattcatttgatgaaagagtctggcctgactgaggctgtgttttgaactcattacagttagactcctgtggctcaatacccatttgtgctggggctgtattgttcttcatttcaacagacatatgcaaatggttctgagaaatgttagagcctgttcttctaaagtgaagttagtctttctcctggttcttactctagaaacaataacattgttgggtgccccctgtctttcacctcacatctatttcatccccaactaatgtcagtggtgctaccagtgcgacagtagactaacgtcctctggtaggaaggactcaactattctaacactcttccacatttctcttaagttgtgctggaagcagaagtgattgagtttcattcattcagtaggtattcaacgcctaccatgtgttaggtgctctcctttgtgctgaggtaaaataagtaaagcagacaccgtccttgacttcattgagctcagggactgagaaagatgaacactaatcaaataatcacagaaataaaaaattttaatggcacattgtgataattgaaacagaggacaaattgagaatgttctgagtttttaaggggcctctgacctatcctggaagtttgaggaaaggcttcctggaagaagtaccactggagatgaggtgtggagctataagtgggcctataggagtggggtggcgaggcgtgaggcatattctaggcagtgtgggacaaagtccttagacaagaagcagcccagggtatccaataattgaaaaaggaggctggggtgactgggggtgggggaggtgctaaagggtgaagaattaggctagatgatcccatagggaacttgtaaaagttaactatgcccagacccactcctagacattctgctttaattggcatgggatgggtccatggcattgccatattttatttaaaaaccaaactaaaccacaaacacacaaacaacaacaaaaacaaacaaacaaacaaaaacaacctcccaggtcattttaacatacagtcaaagctgagaaattctgaggtacaacatgcagcaccttgtagccatagttttcatcctaacaacaatggggagtcctttgaagattttaaggaggggggtaattagtattaacattatcagatttgcttttgagaagagccctctggctgaaatatggcaatggatatccatggcatctaacaaatcttgctgtgcacccggtaaacatatagtggtagactcaaagtagactgggcatcaaatttactgcatgtgaagactctagatcaaaatgcaacttggtggtgatagatcctcctctgttgaataagcggatcatttcattcaagactgtaatttctaggtggaatgcaagcacagactttcaaggaagcttgaaattcctgacttggtttgggtccatttagagagatttacaaagagaagaagcgatatttagggcacaaagctatatctggcacaggtgacttgtgttagacctggagactcaggcctgtctcttagcattgaaggttcctgagctcccagcaggccatgtgtggctcccaaatctccagtgggaaatatggaaacactttgaactcccttcactatcactgaaggaaacagaacccgatttcagcatggatattgatttttaaaatgcacttcaaatgcacagaaacttgtagtgggaatgcaaggagaaagcagggcatcctgagaaccatgttacatttaggtcattaatcaatacgggatcagaaattgaggaggtgggtgttacaaaacttttcttaatagaatatcatatatgtgacgtaaaaagtcaattaaaaatctcattgatgaggctggttgcggtagctcatgcctgtagtcccagcactttgggaggccgaggcgggcggatcacaaggtcaggagatcgagaccatcctggctaacacggtgaaaccccatctctactaaaaatacaagaaattagctgggcatggtggcaggcgcctgtagtcccggctactcgggaggctgaggtaggagaagggcgtgaacccgggaggcggagcttgcagtgagccgagattgtgccactgcactctggcctgggcgacagagagagactccctctcaaaaaaataaaaaaataaaaaaatctcattgatcacctttgctaagaactaacttaactagttatttgaaaacttttacaaaatattaattatgtttccaaatgaccaagattgaaaaacaggaaagatgagtaagtcttaccataaagttatcaggaggctacacaaaaactaacaagtaattacacgaaaatacggggccctttcttctctcaacttcgcagtttcactcttcctggtctctcacctactctctatggtgtattttcagtataaatcaaatataattatctaaaaagaatgaaagcatatatatttcaaaatagttcacagaaaataaaagatagcagatgagaatagagggagaaagatgtggaagagaagaggtgatggaagacaaaactttgccagaagagacaaaagaactttaaagtctaatttataaattgctaatctgaacaaactaatagtctttcaatgcactcagtgattggcgtaatttatcttggctttaacaaacatgctgatattgcttcttgtaacacatttattaccagaagaaaaatataattggtatcagtgtgaatgcctttggctgcaagtaacatcccaagtcagctagcttcaacgttaagcaaaatttgttacctcaaagagcaaggaatcttgagatggggtggctttgacaacttccgtatttcctccctgccattttcaaccagttagatttgcccctggcaaccatcccatcatggttgcaagatggctgccatagttcctatcatcttaagacactgtaatatctactggtagaagacatacagtttcttcctatatgattcattataaaaagcaagaaatcctttccccaaggtcctcagcagacctctctgatgtctcattgtgaaaaacttgatcaaaagccgacctgcctgtgatccatttaccagcaaaataaataagatctctctgattgaaggattggtgctgatgaatgaggttttaaccttgaataatgtaggggatgggtgaaccaacagagttcttctgggtagcaagaaagattgaatatttcttaaataggttgctataacctgcaccagtgtttctcaaacttaatgtttggaatcacctgtgatcttgtgaaaatacagattctggttcagaagttctaggctggggcctgagatcctgcatttctaacaagctctctggtgattctgatgctgctggtccacagacaacactttggatagaggatctagaccctagacaatcagatgagaagcagtctagtataatatgattgaatacagcttatattagactgtctagctgggtgatttggggtatgttacttaaattatctaagcctcagaaaaaggaaggaattggggaagaagaaagaaagggagagagggaggagaaaagaggtgtgtgtggggaggtgagtcgcagactcattgatgagaatctccaaagcagtggtgtttctgttcgcttttctaattcattaagatccctctgtggtgatgaattagagaacttggaagaaaataaacagcgtagtgtttaatatgagcattcaggaagaaaataaataaactatactaataaaattctgggaatggtaacaaatgtatatgtatagcagaataaaaaacctcagggtcccagtgatagcaaggtatattgaaatactgcagtgatgttacagttacaaaacatactctgcctttctgatgcctaacaatgcatatattatgttctgagctatggagttctgaaggataaagctttttgcccctgagtcatacccagaaaggaactgtggcagacttagggataggttatgaggaaggagtaaaggaagaggaatcctcattatgaaataagaccaaatgacacacctaacccaacttcagggggagataggtccttacttgacagggagaggcaaatggctgtttcctgtcttgacagatcagatagaaaagtgaacaggatgcagtagcagaatgagggtatgtggaaagatttgagcaggacccctgagtctagatccctcccagtcctgcttttcactagccctgagtcgttgggaagttggcttaacttatcctagtctcaggtgtcttccaagagctactgaaatagtaatagaagtcaacgtacacatgataaaacaggtagcaatggagatccattatctcacctactacctccctgataatcccataatattggcatcatgattatgtgttattaactctctggggaggggtggtgttctataaacacatatgatttcgcttactctccgtaccaagtctactgactcctttctgccttcaatagcaatattataatagcagaagaacactttgcatcagttattttgttggtcttcattaggcattaaattcagtcaaatgaagtagtgattttgattccaaaacacttagtgtgacagtccttacctctgaccttgttttgcatgtgtcacagtgttttgtaaacttttcctgaatgtgaaatggatgcctcgcgtgccctgctttcgccttgcagtctgactattccatttctgtgcacttgaagtgcattcaaaataggcaatatctgtgctgaaatagagttctgtttcttcaatgataataaaaaagaatgtcagttttttgcttaaaacccacaacaggtagttagtggaaacttgaaggtacgagttatgagcgactttaaaatatattttcttctgtgttgttaatggcttacatatggggcttcttgcagggtgtaggaaacttctaaatagtcctaggagacacacatgaacaaaaaggtcatggcattttgaaccctcactgctgccttctttacaattacccatatgacctttggagaggcatctcggagaacaccagggatttgcaggaaagccgggctgcttggcctggctactttctacagaagccatgactgctaaaatggactctcagtcatccccaggctgagaagttagggctgcagcttgatttcaaagaatgcagatctaaggtccaaggtgcaattcattgtccacacatcaattaataatgcaataccagactccaagaatacaagacagcagtgtttttcaaatataataacttgaggaagttggtgagaaattgatacaaaaaagtaaaatatgagttcatatagcaattcccaatcatgataatacttctactgggatatatccatttgaatttactgagaaccttcttatattggggtagtttagaattagttctatctacaaatagtaattcataatgactgtggtattggtgaagatgatgataatggtaagtggtaacatcttttaagcatctaccgtatgccagaccctatgctaagggctttgtaggtatcatcttatttaacccagtgcaaaaaaattgacaaattctaggcttaggatcaacatgaggataataaaattttcttttggtaattacatctaaggacataagtacaattcacaaaccttgaggtcaaggacttcacctttcatcttttgatggtgctgcacagtgcctagcagagaaaagactccacaaatatttgttgaaatgaaagaagcaaggaggaaagttttcaaagcccagaaatctgaattatatttgtaaaactaactcagtttaataaaatgtgtcagtgttaactacatcatttaaatgattattactttattttctaaatttttataacaaggagtttaacaatgctgccttagggaaataacagcacaaatgcataaagatggttgggtaagaatatttgtttcagcactgcgtggtacagcaaacataaaacagagccatttaaatgtgtgaatagagaggcaaaaagaaaacaaggatgcaaacttttttttttattttatataattaaaagattaaatgttggggtaatagtcacagactaaatatcttatattcattctgcagacatctcagttaagcatttggaattatgcatgattttttatttatttccctttttctgtaattttaataccacaaatctttttgcaaaatgaagagtccatatttttgctacagaaaccaggagatcagagttgccaatgtggaattatggacattggtgtgtctttctgaagagaaatctaaggctgctacgtgtaccagctgggatcctttcacattaggataattttaatggtagagcacttggcacaagttatttccttggtcttcattaggcataaaattcagccaagttaactactgatgcttatcccaaaacactttcactctaagacttcttaccttggaccttgttttcaaatatatcccattcagatttttcctaaatatctcccatccaagtactaatcagggcagaccttgcttagcttccaagattagatgagactgggcacatttagggtggcatggcctctgtattagtctgttctcatgctgctataaagcaatacctaagactgggtaattgataaaggaaagaggtttaattaactcatagttttgcattgctagggaggcctcagaaaacttacaatcatggcagaaggcacaggagaagtaggcactttcttcacagggtggcaggacagagtgagtgcaagcaagagaaacactagacgcttataaaactgtcagatcttgtgagaactcactcactatcacaagaacagtgtgggggaactgccaccatgatccaattacctccacttggtcccccacttgacatgtagggattgtaggtattacaactttgggtgagatttgggtggggacaaagagccaaaccatattattctgcccctggcagaatctcatgtcttttcacatttcaaaaccaatcatatcttcccaacagtcccccaaagtctcaactaatttcagcattaactcaaaaatccacagtttaaagtctcatctgagacaaggcaagtcccttctgcctatgagcctgtaaaatcaaaagcaagttagttacttcctagatacaatgggggtacaggcattggataaatgcacccattccaaatgggagaaattggccaaaacaaagaggctacaggctccatgcaagtctgaaatccaatagagccctcattaaacctcaaagttccaaaattatctcctttaactccatgtctcacacccaggtcatgctgatgcaagaggtgggctcccaaggccttgggcagctacagccctatgcctttgcagggtacagcgtcccacccagctgctttcatgggctggcgttgagtgtctgtggcttctccaggcccacagtgcaagctgtcagtggatctaccattctggggtctggagaatggtggtcctcttctcacagctccattagacagtgccccagtggggactctggagactctaaccccacatttcccttccatactgccctaacagaggatctccatgagggctctacccctgcagcagatttctgcctggacatccaggcatttccatacaccctgtgaaatctaggcagaggttcccaaactcaattcttgacttttatgtacctgcaggcccaacaccatgtgtaagcttccaaccaaggcttggggcttgcaccctctgaaacaatggcctgagctgtacattggccccttttagccatggctgggactcaaggcaccaagtccaaagattgcacaaagcagcaaggccctgggcccagcccatgaaaccatgttttcctcctaggcctctgtgttgtttgtgatgggaggggctgctgtgacaacctctgacatgttctggagacgttttccccattgtcttggtgattaacatttggctcctcgttacttatgcaaatttctgcagccaacttgaatttcttttcagaaaataggtttctcttttttatcgtattgtcaggctgcaaatttttctaacttttatgctctgcttccctgtaaacataagttccaattccaaaccacatctttgtgaatgcataaaactgaatgcttttaagagcacccaagtcatatcttcaatgctttgttggttagaaatttcttctgccagattccctaactcatttctctcaagatcaaaattccagaaatttctggggcagaggcaaaatgcagccagtctctttgctaaagcatagcaagaatcacctttattccaattcccaaaaagttactcatttccacctcagcctggacttcattgtccatatcactatcaactttttggtcaaaacccattcaacaagtctctaggaagtttcaaactttcccacatcttcctgtcttcttctgagccctccaaactattccaacctctgcctgttacccagttccaaaggtgcttccacattctgggtatctttattagcagtgccccactctcagtaccaattaactgtatcagtcctttcttatgccgctatgaagaaatacctaaaactgggtaatttataaaggaaagaggtttaattgactcacagttctgcattgttgggaggcctcaggaaacttacaatcatggtagcaaagaagaagcagacaccttcttcacagggcagcaggacgaaataagtgcaagcaggagaaatgccagacacttataaaataatcagatctcatgagaactcactcactatcacaagaacagaatgggggaactgcccatatgatccaactacctccccttggtactgcttttgacacattgggattatggggattacatttgagatgagatttgggtggggacacagagccaaaccatatcagccccagaccctaattaatcttgaacctgaaataattttagtgttgcctctctaaccatttgtgacaaagaatgagtttggtaagacttagttcaaactttaagttaacagatattctttatagaagagaaaaggctctagctgcctctcttagaaaaatacatatcaaggccaggcacagtggctcacatctgtaatccctgccctttgggaggccgaggtgagtggatcacctgaggtcaggagttcaagaccagcctggccaacatggtgaaactccatctctactaaaaacaaaaaattagctgggcatggtggcaggtgcctgtaatcccagctactcaagaggctgaggcaggggaattgcttgaacctgggaggcagaggttgcagtgagccgagttcacgccattgcactccagcctgggcaacaagagtgaaactctgtctcaaaacaaacaaacaaaaaacaaacaaaaacaaaaaagaaaaagaaaaagaaaaatacatatcaaaaataattataaaaattacttcattgctttacttgtttttctgtacacaacccagtgagttctcttccaacattttatcatggaaaatgccaactatgtgcacaagtagaaacaataggataataaactcccatatacccattatatagcttcaacaatggtcatctcctttcctaaatggctttatctgtaccctatcccttattttcccagtccctggattattctgaagcaattctcagtatatcatttgacctgtaaatatcaccgtatatatatttctaaaatatagaatagtttaaaaataatactaatacaacactgaaaatttaatattaaatttcttttccttgatataataagttattattcatttttaaattgtaacttttttacatagtttgtttgaatcaagatatcttgtgccttttttaatctgtaggtttctgtctgtgctttctctcattctccagcctccctccctgtatcatcgctatgattgctgtttatttattgaataaatcagattgttttcctgccaaatttcctctatctagatttagggattaaatatctcgtctgtccatttagagtcagctcattgtattcctgtattgtcattgaatatgttcccttttttcttgtatttttcctaaattaatagttttgtagctaatggactaatcacatcaattcaggtgaggtttaaattttttgtgtgggggaggtggggagtttgtttccataggtaaaagtgttcttctgtgaggaaaatacatgaaatctatttttctctctttctgtgatatttgcagtctttgataatgtcatcttttcccctgtgtatttttgggtctgggatgaaattttgtctttggctacattacctgtctagggattatcagagtcctggccccttcattttgctgagaaaattttgcgagttgcctatgaaatgtatgctgtaggtaacccagtagttactccgatagaacgaagtaaggagataagtggaaagtgagttaataattctaccactggctgtatacccttgcctaggttaagccccatgactgccattttcatcatctgtaaaatgggaataactatacctatggtttttatatacaaacatatatggcacaaaaacaatgtttaataaatgatagttattttgttgctatttaaataatagtactttgataatgatatcttgatgaaataataatatagtttagtctgtcatattttaacactggtttgctgacggcagcaggtttggtccatttcttctatttttatgactaatgttaagaaaataatattacaaaacttggaaataggtaaaagaatgactacaagttctttcaatgtcacactggagtattagttaacagtcctgcccaatgataatttcattttctctggatagctattttactattttcctttggtttagatattttatatttctctaaaggtaaagactggattgcagaaaattaacagtcacataaataattttgtctaatagaaatgtaagtgaagtttgtctggtagaagagataacctcaaaggttattgtttaattatccattagagcaaaagctagttttttatctatcttagctatctacttccacatttccttagagccaatgcaaactcagtctctcaaattttctttgaactagctttatcatcgtgctagttctatcagtgagttaaatcaatcttggacacatgcaatttatattcgtatgacagcaatgtatttaaatttttgaaaatcgtacttcaatatgaagttttcaatctcattggtgaattttgctggtctgtttgatattaattatagattctaactacgctgttgccatttctctagaactcatgggagggtacatattaaacctcattaacacatcatgagctagaacctgtactggttttaggtatgtagccaaagactaaatatccttattaatatcaaataacttttatttcgatgtatggcagtggtcatgcattatgatgttttgaatttgtcaatatattctgtttagaaaaacagaagttcctactatgaaagttagctttctttggctctttatttttaaagtgctttaaggtgtagatttccattttttgggggggttgcatttattcatacatatgtggcaattctaaatgattaatcaaaaagtatcataaattattttttcattcctccaaagactatcctgtaatttccagcccaatacctaccccatctccacctctttcacctgagtaaaggaaggagtctttcttgcttggaaaaaaaaatgtaaaattcaactatattttaaaatgctgagagagaaaggggtggggaaacagatggaggcaagaaattcatcagagttgaggaaggcgaagaagagaaattttgtagggtttttgagaggagattatatgagtgttgtggattgaaaagaaaaagaaaatttaataaaatcagtgagtaatgtgttggatctttaaatatcttcgagaagcttgggtatagaatgaaattaccatgaaattagtttataaatatggtttgaccctaaaccatgcttcttgaataaggaagtacttgggaactaacaacatgattctccaggtttatcatatcatgtctttagtctgaaaatatttattgaatactaatgatgcactaggctctcttctaaagtctggggacatacacaaagacagagagcctgcccttggggaacttacattctcactggaggtggggaggagaacagagaataaacaaagggataaagataagatatgttttatatgccaggtggagacgagggctacaaagatataacacagggtgagcaggctggagagagagaagtgggttctgttttatatagtggggtgaagtaaggtcgccatttagtaaatagcacatttatttctagccaagaagacacagttcatcagattgagatcatctaagtagacatcagattgagtaaaagtttcttagatctggattctggtggcccagagtactgaatctgcagtatttcacatccctcagaagctagtgctgctattatatttttcttggtaaatttgtagaacccagaattattttgaggggtaggcatgggttggagatacatattagagaagagagaactagagtgaactctccctaaaatcactttttatttagaaaaaaaaagagacgctacactgcatttccctagtcaaggtttgtacagttccatgccatattcctacaacatgtttgctcatcagagaaatgaaatgtgaagcagttctcttgtatcagtttagagctcctttgtcaagggagggttattttccataaattcaatgtaaaaggaaggaaacataattcactttcaaggtcattaaaagaataagaaaagttagatcctatcaataaaactttaatatgctaaactaactggcagcaagaaagagagctattttctcaataaatattgtatacatgtgctttgtcaattaactttttttgactgtgaacaaaatgtaaatgtcatggataaatgatagctttaatgatgtttttcagcgttgtactgcctgttaccacggcttcttaacaaagatgttaaatcattaggagtcatatttcatgataattaactacaaatctggtaatattaccacttttcatttggcatgaaatgacgagggagaaccatgaggtttattggaggtacatgacaaaggacagagagacttaatgtatgtgtataaatcttataaaactacctattggacagcattttatgatggacataaattcccattcactctctgctagtgatagacagggaagtctgcagtggaagcagaaagctgagatgggaagtcaccctagagaataaagggggcgtatgggtttatttctttgtcttacttgctcgctcttgcaacagctaaacagatcctcattctcgcctaagttttgaacaattagagtatgcactgttattaattctcttattaaatgtattttattataaagtttgcaaagatgcttttatgattaaggagctattggcatttgccattttacactactaatcttccatctgcttttctttgaaccttttaaaatgttcagcaaggtcactcaagattttattgtagggaaataaaagatcaggaacactctgccttgttaatattttcattccagcctgttgttaatatagagagatagtgatatagggcggaaaggacacttcttatagagttaggtaacctgatttgattttgcttattttgttaattttgatattgaccactgtatcagtcaaggctttttctgttgcaagtgactgaaatccaatgcaaagtagctttagaaaaggagaagacactatgttggttgacatagttgaaattttgaagaattctggcacagctctcaagaacaaatcgccccaacagggccatctgtaccaggctctccatgcctctgctttgctttccttggtgcaagcttcattttcaggcaggctgtctccatggtgagcagaacggcagttccagactcattaatcttgatgcctagagatcccagaagaagactgcagtggctaattttaggtctcaaattgactggactaagggatacccacctaattggtagaacgttatttctaggtatatctttgagagtgtttccaggagagactggcatttgaatcagtagattgagtaagaaagatccacccttattaagtgtgggcagttaccatctaattggtcgaaggcttagatagaacaaaaaggcagaagaaaggtgaatttgctcctttttctcttccggaactaggatcccgttttctcctgtccttgcacattggaactctgggttctctggtcttcggactctggaacttgcaccagcagtctgcctgattctcaggcctttggatttgtactgagtcatgctactgacttccctggttctctagcttgcagaaagcttatggtgggacttttaagcctccataatcaagtgggacaattcctcttataaatctcctctctgtctctctatatgtctgtctgtctgtctatctatctatctatctatctatctatctatctatctatctcctctccatcctattggttctgtttttctggagaaccctgatacaaagactgtttctgacactattgaccaatatccacatcaagggtctggttggtccaactgttcaccttagagttcatctatgaagctaggaagagagaacatcatgctttgattgtccaggcctgagcctgtgcctgcccgcctcacccatgggatggatgctaatcacatggtcttaaaagaattaatatgaagtggaagaggagtggttatctgaagaaggaaatgtcaagcagtcaagtagcatggatccactgcttggcattcattcactcatttttttctaactaacttttaaaaattatttaaaatgtttagtcctccttcaagcattgtgctggtagtgacacaaggatttagaaagggagaacgagcttctaggaatttaaattttagagggaaatagttatgtaagaaacatatataatgcaatgagataaagtattcaaagtcaatgatatattaaaggaaggatcttatgggtttgcttgttagagtcagggaaaccttcaaagaacaaacttaaactgttgtttgatttcctctatgagaaccgggtgcacatcggggctagagtggttcgcacttcaggatgaaacaaccgtgaagaacaaggaagtggcaggagatggagctaaacaggtcatcagaggtagatcttgaaaagcccttcatgtgatcaaatgaaattttattattttttctttctgtgagattggtgatattgatcagatgaataatatatatcaaatgtgtacactaaaaagagcacttttatgggcatgtagaggatcatttgaaagagtaacctccccagcctcagaggactttctggctcactcactcagcaaatattcattgagtgcctgctgtgtactgggtactgtgtgagtcaaaatgtaaggcaatgacaatggaggtagaaaaggagacaaatgtgaaagcaatttcacaaagagtaacacatttgatgtcaaatagctatggtagggaagacacaagactttctggttttccagtctgagctattgggaggaggcaataacattccctgagccagggattctctgaatctgtttactcatacataacatgacaacaataacaagaagccagaatcacaggactattatgagaatgaaatgaaataatacaaatttaaaaggattttgtaagctttgaaacataaaatgagggtaaggtgttattttaaaatatatgtaacatatttaaaaataatctctggttgcttttgattccatgatgatgtaattttctccccataagaagtatctattgggcagaataaattaaacaaaatggctttgctatctaactaaaataagcattatttatctcaaaatgccagtctttaccagcctcactttctatattctggcttttttcccattatgcagagtgttgatttggaggggggagtaaaagccagttgagtttctcataaagtttcacactgcagacttgggcgacagtggttttgtttaaagctgattcattgggatttcctaagagatgctattgtataggtacaataactgtttagtgaggttctttatgagacactcaggattatggatccataatttgcattcattgcaaacattgtaacaacttcttttgagccattaaaatgaaggtattgaaaggctgttaagaactccaccaagccgtgaaatcacaacaggttcatttattggagaaaatatcattaagatacaagccagcattacaaatccagatctcttctacgcagttgtcacatttaacttttttccagcctctctgggcaaaggaaggagctgttatttgagtaagttggggccctgaaatcattttgcaatgcacccatccaggcagccatccattcatccactcattcatttcaattcctaggtgctggggcagacgctgaagaaaataacatgctattcctacagagcttaattgtagagacagacacataaaatatatttgcaataaaatgaaaacatgaaatgataggctaagtgtggggtgctttggatgctgctgagaagacagggcggtaggagaaagaagcaattgctgaaacaaaaagaaaaagaaaggctgttccaggcagccaaattaataaatgagcattgtgttgcaaatttgtgaattctgctccctgggaatcagtaattctatcagctagccttttcacttccattttcagaatttctgatttaaagacaaattaagctaaatgcttagttgctccataaggagtctgatgtgaaaaacccatctatgccatcactgggggttctcattgtttctcatctgtaaagtcttttgggatttagatggatcagctggctgacctttgctgctgtcctatgagacataaagataatattcctcatatacctaaatcatctagcagaaaacctgagacacagtaggcccacaataaacagcagatattatccattgacagaatggtggcttggcaaagtattttaaattgaaaagaagaaatatgaattgcattcccaattcctttaaataattgcattttcttccatcttgtaattaaggtctcatctgaattttgccccatacctataagacattaacaacatagattcatttaaacaaattaaaaataatttcaaatttatttttaacaaatggttagactgtcttttgcaggtgcacaggaaatgaagtattattattagtttaaagaaaaatcatgacagtttcatgactaaaaaagggaaaaaattgtggaggacacagctgcacctgatatatatcaataattagttcctaatctcatgtgtttgtaacatataaatcatctttgtttccaaaaataagagcatagtagaatatctatgaattaaaaatgactagttttattactactactaataaccaatgcattgtaatccaaataaagctatctttgggttgtaaataagcaaacagaatcacaggaaggtacaaaacatccctgtgattgttgcattaagtaccaggtctcttaagtctaaatagattgtctcttgttttttcttctctttgttttgttgttgctttgttttttgtttttagagatagaggtctcgctttgctgcccaggctgaactcggactcctgggctcaagtgatcctcccatctcagcctcctgaatagctgggactacaggtgtgagccaccatccctggccttttgtcatatttcaattgaaataatctgggctagttttacaatagaggtaaaaaattccaactctggtgctttggaattgtataactgtaaacaagctaattaacttatctaatctataaaaaaaagggatgatattaatggccactcatgcagttactgtgagaataaataaaggtccagcatatgacccagtctggaggaggtatttagtaaaaaattgttgcacctatctttttcttagcttatcactcaccccgtattagcttttgcaatgctttccaatttgtaacaacccatggggattatgggagctacaattcaagatgagattttggtggggacacagccaaaccctataacaaagtacactcctgatttggaatatgtaacaattcaaatgcataataaaagaaacgtggctcagagtcgaagtgctgacttctaattcatgatgaaaatgctaactgccttatgaccttaggctagtcacttagccctggggcctctagctatacaattagctacagttaaaaaatgctacatcattattataaagtatggtaagtaactgaaataatggatgttacttaaaacgttatactaatttatataatgactgttttttcttggtttaatgcttccattcaactgtattttttttcatttcctacttctttattactgttagtggaagattttctttgccttgtttatgaattttaatctcatcaaattcttaacatcaggtttggaagggaacttgcatattatctgatggagtgaggtccctgaggtgctatttcctgcttccataccatggtagatgtcatttgaatctctttagtgacagagaactcactgcttcttgaagcagtgtgttcctgtgtttgagaagtactgctatgagattctttctaacaccaatccatttctcagctacttcttgccaaaattctacctttaagggctacatagaataagtcgataatccctgccacatggcatctcttcagaaatttgaaaatgggtaacatacgtattcctagactctatttattcgtcatatgcaatgatttaggtatttcagaagtatccattttacccaagatttataattagtatggtattataacacactgccatatctttgaatgaattaagttttagaatattgcgttattcatatatctatatgcactgcttaaatatagagtttttctattttttctaaagttacaggaaccttatgttccaatccatatataacatcagcacttcggacacttctgctgaatataggaaaaaaatcttcaatccaaaacaactaaacaaaaaaagaacatgttgaagcttgctaggtcaacgttcaaagcagaaaaagtttgcatgattgtgcctgagggcacatgaaatggaaataactatttcctaatcaataagtgtgatcatacctggaggtgaggtcaggggaatagggagcaggtatccagggccctgtctaaaggacaccttgtaggccccagggaaagagaccaaacctctgatgcaaagaaaacaacatggaggccaagagggccaaatctgtctatagatgtactgtttgcatggcacaatgttacaaaaaatacaggaggctgcttttaaaaatcaggagatttggccaggcgcagtggctcatgcctgtaatcccagcactttgggaggccgaggcagatggatcacctgaggtcaggagttcaagaccagcctggccaacatggtgaaactccatctcaaataaaaatacaaaaaaattagctgggcgtggtgatgggcacctgtaaccccagctacttcgggaggctgaggcaggagaattgcttgaacacaggaggtggaggttgcagtgagccgagatcaggccattgcactccagcctgggtgacaagagcaaaactctgtctaaaaaaaaaaaaaaaaaaaaattcaggagtttttatataaactctagattgcaacttctcttgaagacttggaagtcctggcaatattgggcctgcatttccactaatcaagcatcggatgataaagctgatgggatgggacatctccaggtgacctctttcccaccttttcctatgtgtaatgtactgaacccactgccaccatctttattgtttgcctgattcctgtgggcattcaaacccccagttattaggtacctggggctatgcctgcctttattatttcagccacatccttctttcttctaaacctcccgttttctttaattatttactcaacccaagatagcacatgtatgtgcaagctttctcaagtgtaattcttcagacaacacagggtggcttggtgctcagatctcctcctctgacaaatgttgagacttctccccttcaccttttcacctgtaatccagtgggtctccagtattttttcctgccatgctgcctgataaatggtattctcctgtgggctacattctcacttttaacaatgctcacttgggctgccacaaggccaaaaggagctgcagctatgtgcccagatgtaacctttgtctcttccttcccccaactgtgtggaattgacgttcttggtttttagtgacagaaaaccagaagccagttaaaatatctttacctggcctataaacccattaaaaaacaaacaaagaaacaaaacaaaacaaaaacactctctttaggcatcagggagaggcaaattaaaaccatggtgagaagtttctagacatcggattgcttattgtattactctttgtaactttgtgatatggtttggctgtgtccccactgaaatctcatcttgaattatagctcccataatccccacatgttgtgggagggacccagtgggaggtaattgaatcatgggggcaaattttcccatgctgtttcatggtagtgaataagtcttatgagatctgatggtttcagaaagggcagttcccctgcacattctctcttgcctgctgccatgtgagacatgcctttgctcttccttcaccttctgctataattgtgagtcctccccagtcatgtggaactgtgagaccattaaacctctttttctttagaaatctcccagtctcgggtatttcttcatatcaatatgaaaatagactaatacactttgactatctaatatagttcctaataacaaaaattggaaaaaggaaaaacacaattcttcctgcctttcctttcttgctaagtgcacagtctgttgagatgagaaagagaatgtgttgatgtggctttgaaaaagaggtgctgggtctggtaaccaaagactagatggagggaagtttctgtgtataagtgaaatagcgatgatagaatgccattttgcaaacctaattaattcaaggatctatgcaatacttatcaatgtctgtcatcacacacacacacacacacacacacacacacacatgcacacaccccagaccttaagtgtgtcttatacatcatcacttataaagtactttagccaccactcacaccccccaactcaccaatcctccagacataattgtggagtcctaataaggaaaaagaagtcaggctggtgggaccaggggaaagtataaagaaagagcagataagctacaagcctgcctttcttcatggtccaggacatgcagccctcctgtacagatagctcataatcttcctgcacctgacttatcacgagaccctcggctaatagaaaaatgcaagttagctcactgccacattggcattatcaatactgcatgtagccctctccagcatgagcacaatcctataaaatccccagcaagcttttgtctcctggcagtcagctcctctcttgatgatctgcctgttgcacccttgcaacatattttcatactttctctaataaatgtgccttttgttacctacaactgtcttggtaaatttctttaccacctacaccaccagccccagttagccgctacccacaacaataactattgattaggaagtgcagagaagagaggaacatgttaaattataccatagagccagcaaaattcctactggaaaattctacagatcaaatgacccagctttttcaacataaaaattagaagagagggggatagaaagagagagacagaaaaagaatctatttaaaatatgacttaaaagacatccacctgaagcaaatgtaacaaaatgatcacttattaattctgtttgatgactacaagggtattacacagaattgttctccatacttctgtagcttagttttcataattatatgatgtttctgtggtcaaaaacaaacataaagaccaaatttggttcaaaaaataacagagagagggaagtgagtagaggcatacatggcattttaattttgtgtatattggaaatactccatattaaaatttgaaaaacaaacagaagcagagatgccaatctcccccactgcactctcacatacctgactgctagagggtaatgttctgtcctaataagactgtatctacccagtctggaaaggaatttggttgtttctgatccctaagaagaatatctcatttgcctttttctatggtgttatcagaaaatgctttgcagcaaataaatggcaactccataagtggatgttaatgaaattttaatgaatctgaggtgctggcaccatatattcctgcagagctcagttttttaaaaatgctgctttaatgctgaaagtttacagaagaaaacagcaacattaaggccaaaatgaaggtagcctcggttggggagatttttcccagcgtagtaaattgtttggccttcatttccctggtcccctggaggtctgcaagccccatggtcagataccctgtggtttccagtgctgggcggcttacacaggagaaaggatccatgatttctgctttcgtcctctgctgcctcttgatattgagggcccctgcatcacttaaaatgtttattgcagattgttcctttttgcccttctaagtagtctgtaaactctattccaggcaggggctgggagagttattgcctgttgatacactcacccaaataagtgctgagtgttctttgctacacacatatggactttggctcagggcccagaatacctgagtcaatttcagaatccaattgttacagcgggcttgtatttttagagaagaaaaaggtgtgcatcctaagatccaaaagctgtctacatttacattccaactttctttttaattaagaagatcacaaaaatcaatagagaatttactagcaaagagggccatactggaatgatttggggaaagaattttgctgcattgacagaaagagggcaggggaggtgtttaccaaaccatctgtaactggctgggtttttctcatttatttcagattccattctctctattcattctccatcccatcccatccttggaccccatctcttccagaatgttaactatgccccatagctatgaaatgaattttccataagagaacaatttcctacttttatggtgctagaacaattgtgtgcattgttagagacccctatatgactttgacttcgtcagaagagaatagtaactctccattgacaggtcctggtgaccgaaagtataatcaaagtcagtgcattattaatgactcttctttttaatgactcaatcacagtgtgaaatgtttttcaaacattttattttatataatttttccacttgggaaagtctgcccacaaattaagggaacacaatagctgaataaaaccagaaatattgtgctggatgttctccaaacaaattgtccttcaaagagatggccagaagttctgatcaattttttcatgacaagtgggggccagataaaggatatacctggatcaggttacctgagaacacagattgagaactgggctttggaatctgacagccctgatacacctggctttattatatactaatgatatgatctttggctccttttgaaaaagctctcagggttggtttcttcctctgtaaaatgagcctactgaagcctctggaacaggggttgtgtgaagatcctatgagataatgcatgtaaagtgtatctccctgggccttgggttgttgactccttattctgttccaagcacccagagtggagaaaaaggcagggagagcaattccagccgctggctgtccatactgctctgagctctgtgacaggtaccaggagaagaaacagtggcatggggatgggcagggaagagaaatggaagcaagagagagagagactggctggcataagaagagtaagggttacattcagcacaattacctttgagatgtaaacaccaaacaacctccaagggtaaaagaagttcaagaattccagacattggtcaagtttatgtagttatgtatgaatgactttaaaagactttgaaactagtgtgtgtttgtatttttagtaacttactttttaaaaatttgcattttaggtgggggtcacaccaatggttgttggttacattctgcattccctttaacactttattttatatattaaaagagtatttatggggtgcagtcatgaaaatggctaccagttaccaggtgcctcctatatgccaggccttatgttttgcactcttcacatatgagctcatttaatctttctgcaatctctcaatgtattattatcctcattttactgacaaagaagcagaggcccagaagactaggcaatttcccccaggtcacaaagctattaaatggcaaaggtgagaatttgaatttaagtttttgatccataatctctgttttgactccaaaacccattatacaccaccaccaaaataatggatgaggctactattttgatattgctaataactggaagtgataaactaagacacagaaccatattttaaccagggtttgctgtctggttatttttctaacactgttgcctctgaagaaaaggcaggtaaataatgtgtgggtgtgtgtgtgtaaactagtaaatttcacctaatttatttgcatcctttctactgctatttctaacccccatttttgagactatcttaagagtcattgtctagggatgcagctacttaaggagcaaaacggtcagggtcatttaaaatctcttaagcagagaacatttaaattttcttgtttctggctactggtaacaaatcttcattaaatcttaaacacagaataaacaaagcatgaacagattgtgactgcttcctaattcaacaaagagagattacggttttgcagatactgttaaatgttggaacagaccctgtggaagtcattttaaggcccagagtattttcatgtattttggcctctctaaatcagtttttcccagaggaactgacattgccaaaaaatatgcattttgtttaaagttgtctggacaaagatttatgcttctgtgaccatctgcattatcacccatgcaaggcaatcaatactgtcctaatccagtcatatgcctactgatgctttatgtatatttcacatacctatctgcacaagagaaggaagtaattgcacagataaggaaaagcaaaagtagcaggacccagtttgagattagatcctttgactgctgggtccagacatggatgggtatgggaacccacctggggtctacttgaatgagggagaaaacttacccagagagaatccaaattagaatgtgcaagtgtcaaagcctcattctactgagaagagaggaagctttgagtagaaacatctagcttttctttggacaggtcttagatttatttggagacatctgttatggccccttcttgctttattttatggttccctattcacttgacgtagtccatgataccaatatccctcttaaaatatagccatcctccaaactgaacttgatacgtaggtacagccagagtatgatggcaattactgacttttttttttaacttacaaaatttactgttattaatgtagcttaagaccttggctttgcttttgtctccatagagagttttagttacctaaagcctccacgtatttgtaattcatatttaggccttgcaaagatgctcattgttctcaaaccatgattccaaacttagctgcatattggaatcacctgggaagtttcaaaatagtttcctgtatctcactgccagagagggattttgtaggttcagagtgtggcctgggtttggggatttttaaaagactccagatgattccaaagtgcagggaaatttgggaaccactgttctaaccttccaattcaaagtgtggtccatggcactggcatcacttgggagcttgctagaaatgcagatgcttgggctctactcagacctactgaactagactctgaattttaacaggctagctaggtgattcatgtgcatattcaaaaactattaatataatcctgattacaagacttactttgaaattttattaaattccactttttttcttgagcttcaagaagaagctacagtttcatcactggggctcagaccacatgtgaagcaactgggttgggtgtcctcaagtgggtagggttaaggctggtcaatgataaacctggcatcagtattagacattcaggctaattctggatcaaagtgaacacaggaatcagaagaagattaaaatatagttttagctctttgcttgcaaagctgggctgaagacccggatggaatgggctgttccttgtcctttgatttcccccgtctcagctagttagtttcttgagaggggagagaacagaggcctctgctatgaagtggggaggtcctgcctgcaccttggtgagcttgcccccacatggcaccactggcagagaggagaacgtgttctgcttaagaacaacttcagaggaaggacagcgagcaaggtgacagctagctgtagaagtcagtgaccattcgcctgccttactggcccactgagtcactccttccactgggagggtgggcatgtagtttcctggcagctgttgctattctagggggcacagtggaaatgtaggaagaggatataagtcttttacctcatccctttttgttgattgggaccagagagcagttacctggcaggcctgcccaggaggactggtcagaaggcctcagaggaggaatgagacagaagagtgagccagcacggggcctggttgatgggttcagagaatcagagaaagcagctcaaagagcagctgggctcatggtcaccaacttgccttgttcccaaatgatgttagcttcctagtgtcttcttttactcagagagttgagagttgagatttcctttggtttcttgaatttcagacaggtcactgaaggtatttaagaatcttacttatcaatgggtggaagttagtaagatggtaggtggcctttttttttttttttttttttttgtagagacaagagtattgaagtgcccaggctgttcttgaacatctggcctcaagcaatcctcctgcctcagcctctgaaagtgttgggatcacaggcatgagccaatgcacctgcctaaaattatatctcttaaagaagtgatttgtctttcagagatactacctagagaggcgccaggagagaaagggcaataggcagttatttagctttccccttccatcagttctggaacttagtcattctctcgcgtctcatttttcctctaactttcagatgtgcaaaggatgtcttaaactcaacaagacaggagaacagaaaatcccaaacaacccaccagtataaaacacacaaatgtaacaaacacaagaaaactcaatactagctcctctttctccagccaaactgacaatctgcttgttggcagatctctgaaacgtggtcggtgctcactggcactacttcctcaccacagccttgctctttggctcccagcatctggcccctcccaaagggctcaattgaaacctgtctcccaaagggaacatgtggcgtcctcattgccaaatccaaagccgtttcttagctcccgctccatttaatgtctttctgaaggtcattcctttgacatcgttgactatatttcatttctttctcttctggtgatcaaatgcatgagcttaggaatcagacagatctgaacataaatcctaactactgctagtaatgtgaccctgggcagataaaatacacacacacacacacacacatacacacatacagatgtgtatcttttattttgctctatagaaacgggatcatattttatactcttgtctgctgtttgccttactcacttaacagttcattgtggaactccttccaaaagagttggtgtagaactcactcattcttaaatattatggatgtatcacaaattattcaaccattcctctgttgatggatattccatttgcttcagacattttctactctgggttggtgatttcatcttatgggataaatccccagttgggggatggctggatcaaaggacacatgtatatttaatttacatttagtgggtatatttaattttaatagatgttgccagatggccttctaaaaaaactgtaccatttcacattccaccggcagtgtatgagtagctcttcctcaaagcattatagtcctgtttaattttttacaaacctggtgcatttcctcaactactatagaaattgagcatctttacaaacgtttattagccatatttggatgttgtgttctgtgaacctgctacttatatccttattcaagttacttaacctccctaagcttcagtccctttacaaagttattatgaagattaaataaaatatttatgtgaaggctttgcccaaagcctggcacaagtgacatgcttggtaaatagtagctgctgttaattcttttaaattcctttttccttatttagttaatcttcatcttcatacctttaaacatgtatctataagcattttccaaaattctgcaaactaatttttctctttgacatcttgcattctttctttctgaacatttcaattttacagtctctattctgttaaaagaccaatttgaacctctaatcttgacttgtcttttaacagcagaattgacggtttcaataccttgctggaccccacagatttatcttaccatctactccctgccccagcagcaaactctgcctcacaggaacacaacattcccatctgtgctcctgtattcctaaaggcacccttttctccaagacctatgggcttgagatcataaagtcatcatgccgccttgccctagacgttcatgtcagtagaaaagctccataaatcccctttacaatggctcttatagccatcctctctttcattgtttttactctagttcactccatcaacaacaatcaaaatagctaactaaccagtttttcctctgccagcgtctcactttttcaatctatttgttacattccagggaaaatcttctaaaacaataacagaatcatgtcactcactcagaaccatttatcagtttcttctattacagagtaacattctcactggccttggagaacactgccccaattcctttatgcaccgtatttttttcatgcccccagtctctttagtttctaccaacacgccagttctgatcactcacaagtgttttttgctcttctggcctaacagcctacaattcctcttccttctccatctgttggaattttatttattttcagagcctctcactctgttaagatcttccacgtttactcacctagaatgaatcaagtattctagcagtttcctatagtatcccccaatttaattattctgtaatatttattattatagtaggtcattttcacaattcttcttggcctttcctcaccacaagcttcttgaaggccagaatttactttttgttccttataatattttctttcttttctgtgtttcccaatctatttcttatctagtaacttttaagtgctcctttatttatttattttaattttggaataaatgcatgactggggttggagattagggaaaattgaatctggtgaaagaaaggagcgagttgtcttagattctcagaggtagcaatgggaccatgggactggtagcaatggtggccatgggactggtccatcccatagttgtcttttatttgcttcccatacagtagtaagtgaacacatgttttataagttggtcaacatttaccaatcaggatgttttatataagcatctggcttctcttgaaataaggaacatcagcaagactggattggcattcctggacggtatatggatggatgtgaggtatgacaaggtttctcttcaaacagcctgatcaaccttttgttctttaattcccagtacccctccccatctctttcttcttctttccttctttctgcctttactacatgcccaggcatgccacagcaccagtggcgttatcagcaccagctcatattcctttccttatttggaaaaggactggctctctagctcactgcagacgaccccttcccgctctcccctctctcccttacgtgcctgccttatctaaaaaaaaaagtttaaatatttagccaatcgggtctagcttagattgtgaggtctgatcccagccaatggggaaaggacacaggggcaggatttgcatcaggaataaaaacttccactctcctttggtctgtgtgccctcatggcaactggccatacgggaggcacccctctccacagaagtaaatttgctttgctgaaaaatcctttgtctgagtgctcgtttgcttacaactctgagctttatttctaacaatggagatgagcaactgtagccttccttgggttggcacagtctctcatccttgctatagcccccacctacatctcatacccatgaatattacctacgtgacacctatgggcatctgagtctgtaatcacagcactaactccatgtgtgaccctgggctggccaatggatccttgggcctcgtgttctcatctgttcatactttataattacacaactttagtttatcaagagttccttttatttgttttttttttcccatggatctcatgtttaagatattttctccatgaaacagcgcacctattgaacatatttacattgtttcacttacactgtcctctttttccaaaatgattcagattttaaacaatagtccagaattatctggttataattatattatgaaatctcataatttttatcatgtttattttgctaactaagcaacagttaaggcacacaaataaatgcttatgcactgtttgttgctattgtttgctggggtttttttagttcactgccttctatcccaatcacaagtccagtcgagttactgtgacagcctgacatgggcctctggtatcaatggctgggtccaccaggtctgacaattcctgtgataccattaggagccagtcagagctattacaatgctgagttgataaaattgtgtgtgtgtgtgtgtgcgcgcacacatgtgtgtatagagacttgagtagcatgtgtggtagccttgtcgtgaatgtatggataatgcttattattgaaataaccaaataaacaactatagaccgtaacatataaggtaaaatttgaaccctttccactctcaatctcattcccagttatttctttattgttttgaatgtaatggtctaacctttttctttcccttgtgtgcatttaaagaaactgtgaacatactataaattctatcttttgatttgctcttttctcattacttcacaatgtgaattggatatcctttcattccaggacattttcatctgcctcattcttcttaattgcttcctatcattccagtgaaggcgagtatcaaaaagtatttagctagtttcctgctgatagacatttagtttgtttccaatcctctttccaatttaatgatcagttttcttgatgaagaaggtggaggtaaaatagttattacctgacagtgtttctggccaaaatgctaactactgataggtatttgaaagttgactccctgtattcttgcaatatcctctgaattattctgtattctgaattatttgtaactgaattattctgtagtttactttttcctaaatgagaatctggacttaatattggctaccctttttattcataaagctaataactcaggttctgagcacttattatgtgccatgcgcatgctaaatactttacatacattatcccatttaatccttccagtagtcctaaaggcaaatactatactattatgtcaattttacagaaatgtagacaactaatttgcccaaagtatcataggtgtttaaggggggagagtttgaatacacacaaacccaagctagaagctatgctcttaactttgattgatgagagcacagggtctgttttctcagggtctattttcttccctgaatcctcgtgtatgtgaaactctaacagcagagtgaggaagagaagaaaggacttccctgtgtgctgggctaagagtgtaatcaggagcagactgttcctaaaaacagggttgtaggagcagcagtaaaagctcatttctgttacaactttggagacccctgtaatgctttcaaattagaaacttttattagtccatgttgtgttgctataaaggagtaaccgagactggataatttattaaaaaaagaggtttacttgactcatggctctgcagaatgtccaagcatggcaacagcatctgctcagcttctggagaggccacaggaagatttaacttatggcagaaggcagaggggagcaggcatgtcacatcgtgagagagggaggaatgagaaacaggggtctcttttaaacaaccaggaaagggcacaaactcatccataaggcaccccaccccatgacccaaacacctcccactaggcccccactccaacactggggatcacatttcaacatgagatttggagagcaaatattcaagctatatcaaagctctgcaccaaagctctatgctgatctcttgagaacaaatttatgcttgttgcagaaacacaggctatagtagggaaagctttggactctgaagctatagatttgctgtggaccagctatgaccacggtttcctccaccagaggataaggcttggatcttttggtctctgacgaaggtttttattttgaaataatttcagaattacagaaaatgttcaaaaatagtgcaaataattcccatttccatttaccttccacacagaatcctcaagtgtttacattgttccatgtttgttatgttgttctgtctcctctctccttacacacacacgtatgtgtttgagtttagtaaatgtcattatcatgttatttctatttcccaacttttggggaataagatatgaacataatgccctttacccctaaatatttcactgtatattaagaaacagagacactctcatatataactgtagtttaattattaacattaataatagtaatcttatctaatttatgcaccttgttcaaattttgccagttgtcctactaatgtcctttaaaataaaataattttcttttttttctggtctaggatccaatacaagataacatattacattttttgtcatttctttatagtcttctaaaatatggaaaagttcctcacaaaacgtatgtttgtcttttgtgactttgacatttttgaagtgtataagccagttattttctggaatatccctaattttgatcttaggatatccctaattttgatctgttcagtttttctcatggttagactcaggttatgcattttttcagggaatatcacagagcaatgttgtgtccatcttggtatatgacatcaggaggcaggcaatggatgtttatttatctcattacaggtaatggtaagtttcaagacatgatatggatggtatctgctcaatttctttcttataaagctattattatctttttgtaattaatttatatctttgcagacatactgtggagacataatgtaaatatcctgtttgtcatcaaactttttacccaatagttttagcaacaattgatgattcttatgtgaaacattatttctgtgttgcttatcaaatgagtgctgagactcttgctttacaacttttacttacaaagcgcttactgaacaataataaaaaaattttagtcacttcagtgccatgtagataagttcatcattcaacttggattagccatatttaactttgcaaggtctaattatggataccatttattaccgagattaagagtaaatatataagaaagatatagttcttaacatactgttactttaaatagatttgattagaaattttgctttgtgaaaaactactcaaacttccagtgttaaagatgaaggtcattcacattggaatttacactcttttaatggcttatgtatagttgaggtccacttacttgccaaattcaaacatttagattcaaggaagaagtccaactgaatttcatgattgttctcaaggggacaaataaaagaaatatagacattcagcacttcttggctacaaagttaaccctagggattaactttccacagcacacgtagcctgtgctctctccagcccggctttcatggtccctactcagagctcagcaactccactgaagtcttcaggaaaccactgaatcatttgggtcagactggcttgactgggcctccttgtgctttgctgttctcccaaagcatggaaagttttaatctaaacaatcattctttaactcatgagcagcttttcacctccccctttggattttgggtctgtcgcttctctgtcctatacaaagcaatgtggtaacaggcgtacccattaaaactcgtccatatctctacacatttagctgttatcattcctaccttacaaacagatggaaaactgcaggagataacttgtgtgcattggaagccttttctataacttctacaaagttatttttcatacaaactcatgtgttcaacaaccagttgagaaaaatcttatagattaaatgtgaaatcaaaagcaatgcagaatttctagaatttgcttcattgattttgtcaagttatacatctccaaggaaaagggggtggccattatcttttcctccaggtcctctcttcattctctcttccctctagcagggggaaaggcaggacttaattagggagggcactgatagctgatgattaccaaactaatgctggcatcaccctaattggcacctagcaccttgtgttgctgagtaggagaaatttcttcctctaatttgtgcttctgaagcatctacagatctggcaatttgccttgtcttcttttagtgccagcaagcactaattactttattatttgatttacttcttaatgaattggtgacttgatttaaaaaatacttattatatatttgcttggtatcaagaactaagctatagagtggaatacaataacaagacagaatatctctgccttaggaggaaacagacatgagacaaataaaatattataatattctatatagagtattacgggaccatggagaaaagaacgatttattctgtctgcaaaaataagagaaggcttcaaagagaaagtgatatttttgctaggtattgaagaacaagaggagttcctcagaataagaagcgaataaagattttaagtatgtacttagaggtatataaaagtatagtgtattcagacaaaggtttagagtccaatgtggcttaagctaatgccatttggagactactcaaagcagtaaggatagttaggtagagtgtagaatcagaatcaagactaatgcaggtttccatttaatgtctgtgttttactagcatagtatggccagattaatttatttagtctttctaaccctgtattatctcatctgtaaaatgaagataatactcatttctcagggttgttgtacagattcaatgggaatatttataaggtgcctggcagaaagcctgggaaagagtaactttttaaattattttattttatttttcttttactatgctttggtctacttcccctaccaggtagaaaggtaagaatggcaactgacgagcctggaagtagaattggggcccaatgttgaaagcctaaaatgccttgctctggggtgtagatttcatgcgtctggtcagctttctttcaacaaattagatttgcttgaagctccaaaagtctactcatttggtttcactccaacccaaacaaattccatttccctgagagctgccaatcatggctaagtgtatatctgatatctaaataaaatggttcactggaaggcatgactatagtaaaaaagagaatgatgcaactcagaaaagaaaaaagaatcttcaacaacaatttaaggaagtgttaatcagcattcaggaagtgaggattgagaaaatacatattgccacacacatgcatgaacttgaaggacaaaattgtgttagacaaattgagttagatcctcagtgattccaagatcttgcagaaacagagaagtcctcagataagggaaaggtgaaatccagtcaagcagagaaggggcttggtgagtgactttccttttacatcgcactcagataacagaaaggaaatttcatccaaacaggaagatcaactatggctagcccgtttgcactatatcccaaaggaacccatatgtagtttatgtgatcaaagacattcaggggaaatattagaatcttttaataaagaatgaccaataaatagtggtcggcattgtttcactttccatatgttttactgcccaataaaccaaagagaaaaatatattttcagagcagaaaggggataatagaataggtaaagacttagtaaagtaggtaaagtaggtaaagacttagaagaaaattgtaagaaatccaggtggtaaataaaatctatattttaaattgttttcttatgcatattttaggatccatgataaaaactatgcagtaatggttaacctgtagtattaatgatgaaaaaaaaggcataatttttaagaacgtgcagagaatagtaatgtttgatagcaaaaacataagcaaaaacaaaacaaaacaacaataacaaaaacccctttgcagataataacaggaaaatagttaagtaaattactatctctcatttggtagaattgcatgctggtattcaaatatgttttgcagagctaccatttgacccagcaattccattactggatatatatccgaaagaaaacaactagttctgccaaaatgacacatgcactcgcatgttcataacagcactattcacaaaagtaaagacataaaatcaacctaggtgcccatcagtggtggattggataaagaaaacgtggtacgtatataccatagaatactatggagccacaaaggagaacaaaatcatgtctcttgcagcaacatggatggagctggaggtgattatcctaagcgtattaactcagttacagaaaaccaaatactgcatgttctcacatataagtgggagctaaatatcgagtactcacaaacataaagatgacacaatcgacactggggactactagagtggggagggaaagggggacaggagttgaaaaactaactgttgggtactgtgctcagtacctggtgattggatcatttgtttctcaaacctcagcgtcatgcaatatactcaggcagcaaacctgtacatgtatcccctgaatctaaaataaaagttgaaaacaaaaccaaagtgaaattttaaaaaaaaattgttttggaaagtaatattttagtagccaaagagaatatcatcaaataatctaaataaacaaaaaaaattaaagagagataaagtgactacatataaatgaaaaacatgcatcatagaaaatgtaacaacgttaaaggaaaagtgtcagactagagagactatctttgaactattctttgaactatttattaaaactacttgtaggaatttatcctatatacatactttcatatggtcttaaaaacacatatgcacactcacacttttgagaagattgaacactggatatttgacatgtagaaattggtgttaatttgttaagatgtgatggtgctatttggctttgatttttaaagtccttttttagggatataatcagacatatttgtagataaaataatacgatgactgggatttgcttcaaaataacccagtgttttaagggcttggggagaagctggtaagttcatagatcagatgatttgatgattgttgaagctttgtgataggcacagaatggtttagtactatgtatgctttttctacgtttgtgtatgttggaagtgtcctataatagaattgtttaaagaaatatacagaaccgtgtatatagtatgcttctgtttacataaattaaaggaaatgtatgttgtgtatgtattttttcatttatgcttatgtttatataaaaacatagctgtaaggatagacaagaaagtaggaacagcagttgcctatcaggaagatagttatttgacttggaggtgttttaggaaggaaacttattgttcatggtatatatacatctactatttaaattttctaccagtatctgtattccattatatgtgtgtgtatatatgtgtgtgtatatgtatgtatatgtgatacactgacttgaatatacagacacacatacatatataataaaaaatgatttattcaagatattaatttactgattttctctagtacatgtattcatctatctatgcctttagtataaatatttgcatatatgcatgtttgtatttatacacatttatatatttatatgtttgcatatatggtgaaatttgtgtataaaacttttaaatattctcagttaagatcagaaaaaattttgtaatctgcttttatcattttctccttaatatatcagtcaaaacctgattttctgaaaagcataaatttcaaaagttttcactgaaaaaatggagaaattttgccttttaaaaaatgatatgcggccgtgtgcggtggctcacacctgtaatcccagcactttgggaggccgaggcgggtggatcacgaggtcaggagatcgagaccatcctggctaacacgatgaaatcctgtctctactaaaactacaaaaaaattagccaggcatggtggcgggcgcctgtagtcccagctactcgggaggctgaggcaggagaatggcatgatcctgggagacggatcttgcagtgagccaagatcacaccactgcactccagcctgggcgacagagcgagactccgtctcaaaaaaaaaaaaaaaaaaaaaatgacatgcaataactgaagttgatttcttactggagtaatgtgtggaatgtttctcttctgttttgtggaatccctcctagtgctctcaccttctctgggggttttcttctcatttctcttaatgaacaagtcaaggaataaggtgtgtgttgttgctcactatacttctgcctaccaccacctcttccactgggtgtagtggatggggaggctttgaaagagataaatgaatgtctatgtgtatgttggatactctaaagctcaaattcctgaatgtggcatttttccaaccaaaaacgcatatgagcagactaatacattttaaaatatcaattttcaaaaatattttttatttcatgactaaaactcttctgaaaatctgtcccataattgtgttattattttttcactcatcccacttattttgtgggtctaatgagatgatatttgtgatgcattagttaagttggtaataatgggtagctcttcatggaaataatgaatatctaggacaaaggtaaaatatcattaaaaggtaaaatatcattaggaccagtaagttttacccagtgtcctgttgaaatttacatggtgagtgatgtcagcaaaaatggtggaaaaagtagtttcaagggcctgttgcttttggaaaccaagaaatcaagtaaaagctgtcagaatcaactttgtcagcacgctggaaaacagtcaaatgtttacagcaaccaagtgaatgcttaatcgaaaaagaaaaaaaaaaggcaactttaaaaatgagcggacaggcacagtggctcatgcctgtaatctcggcactttgggaggccaaggtgggaaaattgcttaaggtcagcagtttgagatcaacctgggcaacatggcaagacaccatctttacttaaaataaaataattgttaaaaaatgatataaaaacttcaaggtacttttacataccctttctatactcccctacccggcttggtagaatttttgaagcccatgttcccagtgtgagaccgtgtccctgattttgtagggagaaagcaagactttatctattcaaacaaatcttggggcttgcctgagggactgatgcaagttgtttgtctttattttgcctaaacttgaactcattcagggtgaaaaagcagtgggtatttcttgaaaatattatagggtcaatgaacaacctccagccacctggggcaaaaggttgtagttgaggcaaataatgaagaactgaaatcctgggaggaaaaactggaaagatagtttatctgggaaactaaatcattcaaaagtgtctgtatatactggagagattaaaaaccacatgcacacccagtgcaggacacctgttagaaatgacatgagaagaccttgagctatcaactcatgctgattgctaggccaatgcaagcaggaagtgaaggttaagacagaattttaaatagcatggctaagcaatcaaggagtgccctaacacagagctaatttcaccagatgatttcaataaaagattcaagtaggtagaagaaagaatcagcaaactggaagtgggtcaattaaaatgatctcatttgaaaatcagagagaaataagaatgaagaaaagtgaacagagcctaaaaaacctgtaatatgtatgtatatgtaatacactgacttgtatatacacctaaagcatattatcatgtgcatgattggaattacagaaaaataggagagagaaaaagaggcaaaagaatagccaaagaaataatggccaaagctctccatatttggtaagatgtaaaaatccacacatataagaagctcaatgaatcccgagaaggatcgacacaaagagactcacggtgagacacattataaccaaactgttaaacactagaaacaaagaaactctgaaaagcaacaagggagcagtgacttgtgtccaagagatgctcaacaagattaaaagcagatttctcattccatggaagccagagagagcaaaatgatatatttaaagtactcaaatgaaaagacagaaacaacaacaatcaaccaagaattctatatctgacaaaattatccctcaaaaatggagaaattaagacatttacagatggacaaaatctgaggaagttaatagtagacctgccctataggaaatgttaaacagaattattcaggctaaaatgacagtaagttgaagtcatatgtagaaataatgaactctggtgaaggtaaatgcataggtaaatgtaaaagccagtattattttatctttggttaataactcctcttttgatttcttatatgatttaaaaggcaaatgcacaaaaagtataaatatatggttaattgcctcacagtgcataaagatgtaatttgtaacaataacaacataaagcaggcaaaagctgcatttggacactctttttatctattgaagctaaattgatatcaattcaaaatagattactgtaaatttaggatgctaattataattcccacagtaaccactgagaaaatatctttaaaaaacacacaaaaagaaataaggaagaagtaataatggcacactaaaaaaaaaaaaagtcagttaaccccaaaagaaagcaataatgaaggaaataaggaacaaaaaaagtataacatatacagaaaacaaatagcaaaatgacagaattaagaacttccttatcagtaattattttaaatgctcatggataaaattttcccaaaggcagaaatggtcagacagataaaaacacgattccagagattactttagatctaaagataaatgtgggttcaaagcaaaaatatggataaagatattccatgcaagtagtaaccaaaagaaagccagggtggctctactaatatcaggcaaaatgatcttttagtcaaaagctattaaaagagagaaagaaggacattaaatattaataaaagagtctattctttaagaagccatagcatttataaacatataggcaacaaacaacagagccaaaagatatgaagcaaacactgatggacttcaagggagaaatagatagttctacagtaactattagagatttaaatatcccactttcagtaatggatagaacactgaaatggagaccaagaaggacatagagaacttgaatagcaccatacaccaactagacctgacagagattttgaacactccattccacaacagctgaatacacattcttctcaatttcttctgggcctgtttccagaatagaccatacggtaggccacaaaaacaattttcaattaatttgaaaagactgaaatcatgtaagtgatcttctctgaccacaatgacatgaagttagaaaccaataacaacaacaacaaaaaatactggaaagtccacaaatatgtgaaaaataaaattaaataacacactctttaataccaataaaccaaagaagaaatcactctggtaaattgcaaaattcctaaacatgaatgaaaataaaaacacacatacacaaacttacaggatgcagaaaaagcagtgctcagagggtgacttatagctgtaaatgccaacattaaaaataaagatctcaaatcaataatccaattttgcactttaagaaagtagaaaacaataagcaaactaagcccaaggcttgtattaaaaaaggaaataataattattagagcagagataaatgaaatagaggatagaaaaacatcagagtaaacctggaggaccttgactaattcccctgactaaacgaaaatggtgatatttctatagacctacaacaaaaatatcataagagaatattcgaactattacagaacagagataaaattgacaagtctctagaaacatacaatgtagcaaaactgactcaagaagaaacattagtattagtgttctccagtgaaacagagctaagaagatatctatatctctgtccatccatctaatctatctatctatctatctatctatctatctatctatctatctgtctatctatctctatcaagatatttattataaagaattggttcacttgataatggaggctgaaaagatccaagatctggagaaccaaaaaagttgagaatataagttccagtccaatggctttttgagtctggcaggcttcagactcaaaaacaaccagtgtttcagtttgagtctaaaggcagaaaaatagcaatgtttcagctaaaggtagtcaagcagaagggtttctttttatttagttttttttgtactgttgaggttttcagttaactggttgaagcccaagcacattagggaggaaggacagtctgcattactcagtctactaattcaaatgttaatctcatccagagacactgttacaaaaacacccagaatgatgtttggccaaatgtctgggaccagtcaagctgatacataaaattagccatcagagatatagttaataaaactaaaagttagatccttgaaaagatcaacaaaattgtcaaatctttagcaagacgaagaaaaaaacagaagttgcacttaattgaaatcagaagaaaacagaagttgcacttaactgaaatcagaaaaaaatagaagttgcacttaactaaaatcagaaatgaaagtggtgacatttctatagaccttctaccacgaaaagatcataagagaatatttgaactattgtatgctaacaaattacaaaacatggatgaaattgacaattctctagaagcatacaaggtagcaaaactgactcatgaagaaacaaaatttgaacagatttatataacaagaaattatatcagtaattaaacacttcccaacaaagaaaagcctaagaccagatggttttactggtgaatctactcaacatttaagcaattaacagcaatccttctcaaacttttccaaaaaatggaagagggaacatgttctaactcattctatgtggccagcttatcctgataccaaagccagacaaagacatcactagaaataagaaaattatggaccaaaatcccttatgattatagatgaagaaatcctcaagaaatactagcaaactcaatttaatagcatattaaaaggattatacattataactaaatgggatttatcacagaaatgccagagtcattcaataagataacagcaatcaatgtaatacaccatattaatagaacaaaggaaaaaataattatcttaaccagtgcagaaaaagaatttgacacaatccaaaacctttcatgagaaaaatactcaaaaactagaaatgggagaaactttctcaacatgttaaaggacatttatgaaaacctgatgattaataccatggtcaatggtgaaagactgaaacctttctctttaaaattaagaacaagacaaggatgtttgctttcaatattgctgttcaacattgtactaaaagttccagacagaggatgtaggcaagaaaaaataaggagcattaaaattggaaaggaagaagtaaaactatttctaatggcagataacatgattctctatattaaaaattccaaaaatccacaaaaagagaaaactgctagtgttagtaaacaaagtcagcaaagttgcagggcacaacatcaatacacacaaatcagttgcttctatataccagtaattaacaaactgaaaagaaaattaagaatatacttttctttagaataagagcaaaggaataatatatgcaggaataaatttaaataataaatgaattgtacacttaaaacaataaaacattgctgaaagtaattcaagaagctataaataaatggaaggcatctaatgcttatgaattagaagacttaaaattgttaagatggcaaaaatacccaatgctatgtatagattctatgaaatccctctcacaattccaattgtccttttttgcagaaatgagaaagtcacctactagaatagcattaatccaaaatctgaaaatagcaagtgttggtgaagatgtggagaaactggaacctttatgcaatgctaatgggaatgtaaaatggtacagcctccgtaggaaacagtttggcagttccttaaaaggctaaatatagaattacatcatcccctagaattttcacttctaggtaaataccccaaagagtgaacaacaggaactcaatcaatacatgtgcattgaagcactacgcacaatagccaaactgtggaaatgcatgaatggagaaattaattgtggtatacaatggaatattttttagccataaaaaggaatgaaatactgaacatgctatactgtgggtgaacctcaaaaaagttatgctaagtgaatgaagccagacacaataggtcccatattgtataatctcaattatatgaaatatctagaattggtaaatccatagttatagaaattagttttttcattgccagggggctgtaatcccagcactttgggagaccgaggtgggcggatcacctcaggtcaggagttcgagaccagcctggccaacatggtgaaaccccatctctactaaaaataaattgctgagcgtggtgactcatgcctgtaatcccagctaatcaggaagctgaggcaggagaatcgcttgaacccaagaggtggaggttgcggtgagccaagattttgccactgcactccagcctggcaacagggcaagactccatctcaaaaaaaacaaaacaaaacaaaaaacattgtcaggggtttagaggagggggaaatagctaatgaaattattacttattgagtaaggaattccctttggggtgacaaaaatgttttggaactagatagatgttcacatagttgcacacattttgagtatactaaacgccattgaatccttcactcaaaatggttaattcatgttcttgaatttatctgaattgatacaaaagtaaacacaatacatgtcttctttacttcagcttctgtttaccagactacttggtgagaggaaatagattcttagagtctgacagacctgggttcaaattcctcattcattcattttatccatttgataagttaagatataaatatcaccacaacaaattgttgtagggattaaataagataaacaggtgcattaatgaagggtaagtaatactagcttcaattgctagtgtttctttctaatgcagcagtccattgtgggtattcctgagtagggaaacattatctatggtcatcaggcacttactccttaggtccctgtagtattcttctatcaaccagcaagcagagaaagacatggtagatctcttatggaaagttgttatgagatggtactggataatggaatacatcacttcttttcaaactccactgatggtaactcagtgtcattgccctgcctagccacagcagaggctgagacatgtagactgtgtttcaggaagaagaaaaagatttgggtgaggaaaaaaacaactcttgaggtatcgtacttgtatgaagcttcttgttcagtttgtgataagcacttaataaatatgaactctcttctttgtgggtaagtgagaatccctggcagcttctgcaaagttgtttcaaaatgcatgccatcctgatgacaggccactcgttgtggccttatggcaaagtcagttgatagggctgccaggcagacagtgagcagaattctttctggactctgttcctgcttgttctttttttcttttgtgttttggaacttcccttgactttggtcccatttagtttcccaatgtctaacttgcatttacccttctttcacagcttgctcacctttagcttctatctgactaggtctttgtgttttcattttgccctctcaacaaactatttctagtccttagctcagtagcttcactgagcaggcccataaactcccttttgccatttccacttcccagtcatatcttgaagacttccaacttaaacacattaatttatgcttgggatgattgttaaaatttctctattcctacatcttgtaattagcttagctgatttttaaaacaaatcctctaagaattatttttatgaaggccatctggtaaaacaaattaatctccaaggaatgttaatcagactaattgctaattaggtgtcctccttgattctattagttatagattggaaagtgtttgtcatatacattaatttttgcaaagatagtgagaaaacattattttttgccctgcaagagaacaagtgaatccatttgcatgtataatgtatgtgtgtggtgatattaaaagatatccattttttgttgttgttgtttttttgagacagagtctcactctgttgcccaggctggagtgcagttgcatgatctcgactcactgcaacctctgcctcctgggttcaagtaattctcctacctcagcctcccaagtatctgggactacaggcacatgccaccatgcccagctaattattgtatttttagtagagacaggtattcaccatgttggccaggatggtctcaatctcttgaccttgtgatctgcccgcctcggcctcccaaagtgctgggattacaggcatgagccactgcacccggccactacacacagtctttaaacttaaggggttgaaatttattctaattgttagtgtctcagcttcattattcctcaaatggttttgtggttcatggagcttcagaaatatgtttttaaacatacaaaaaaaatgccagtggattcaactcaatgaaagatggcaaatgagtttaattttatataccaatggtctgataggaattaccttgagtatattgtagagaatgcctgggtgggacggggatatttaccatgcactcactatgctcctctgtaatggactgagtagtgattcacaaaaatggagccacaaataataaaaaatcatttgtgctgaccctgaaaatgtgagcctcaaaataagacaaaattaatcagaaccagacaaactttaagggaaaccctagttctttattgaaatgtctttgtgccaaggtagttaagtgaaagaatggatgaaaaccaaaattcgtactctcccccgctcaactatttagcctgaggtaattattcacttatggaaaggagtgagtatttttggtcaaagtaatttaggttttatgaatgatttcttcctgtggttttatacatatttgtagagagtatgaatgacattctccctgaatttgtcttctatttagtggtggattggtttcacagttgtatgagacttcagggatcttcctttttcctcttttgttgtgaattctctttttataatagaagcatgaaaaaagtctgcctattagaaatgtgaccttggaatccatgaatccatgaatccatatttggaatccatatttataagaaatgaaatgtggtatcaaggaaggaattttgtctggaaagtcagatctgaattctggtcctgcctctctgtcagtgagccctgtggttgtggctaagttgttccatggtctctaatgacctcaactatgaaataagagcttggggttcagtttttaggtagaataatgctgtatgttgatgttgacattctgccattctgcagtgatatattgcttaatttgcctttgccagttattgagcacgagggggcagtaattggcagattgccccctttatttcttcttgacaaacagccaaattttttggcagctgggaattgttattcttcaccatcctgccatcactgacagatgcatttgacaggaccattggcttgcaatgccattccactcttacaagtaaagtctataatgcttaaagaaaaataaaaacatatgatattcaacttttacaaaagagtacatataatattctttatctgtcaatgtaaaaatggtcagaaacttttcagatatatttgattttcctttccatgaaggcttcatttttgtaaggatttttaaaaattaatagagaaaaaaaccccataaggactctcaaaccagtggtctaaaatggaattaattttgtccccatcaattgctatttctttgcaaatatttcttatcttggtgaatgatgaaccatttagcctctgacccaagccataaacctgttagttgtcccccttagcttttcttttcccacacccctccatcatcttgcattctgtctaattgattcagtaaatctggttgattctacttcttgtgtatttttattatttttcctttcttctccactggaaacttttatgactctagtttatactctcatctaggtcactgcctatgtccctaagttgtatccccagtgtctaatgccatcacactccctcctttaccctcaccccaggctacacttgaacaggtagagcagggaatgccatgtagacctcatgtagccaagttggaggccctttccagttcatccccttgactttattttaaataatacatgaataggattgcagaacttttttttttgttttctgtgatgctcatgcttgtgcttcttctgttcaatgtgacaaggaacaagatctctacaatgaattgtaccaatgctccaggaaatacttgccccatttttttttaattttagtttggtttaattcctctaaagtaacatcaagcaatgtgctataaaacagaaatatgtcttgagagatagttattctctctttctctctctcaatttaaaaagggttcaattttttactgcttcaggcaagtacaattttcacatactctgacatctcatgaaacctatagccaaagatttaggtataacctgaattcttccccttcagctcagtctttgattgtatacatgctcatccctatcctcaagaagaagtttacatcttatctcctctctgaaacccgtatacaacaccccaattcagtaattttgctggggactcctaatgctcttcttgtttatatatatcagcagctaacgcctgttttgtatgagctttctctatatgtatcatgatttgccaaaaacattgtcaactctttgatggcatagaccctgcaattaagccctcagattcccttgtttaactgatggcccagatagcaaatgcttgaaattgaagtaacgttctccttagcctctaacctgtgtcatcacattagctgaccttaatcagggcattaaaaacacctaaatagagactggtggccttcgaaggaggtcttttttgtccttagaatttttaaataaatcccactgtcaaagtcatcaaccacaagggaagtagaaaaggtggtgttggtctttagcacaattaaagaacctattagctaaatccctggcaggccaaatatgaaggcaatataggtaagtcttattacactctgaaaatcaggattaaatatttacaagtttgcataacttgacctttcttgcaaagagtattaaaactgtttttaaagaattccttctgctcctatgtaaaagggcattcataaggcctccttccacaggtggacaaagtgttcatctttggacttactgataaaaattttggctcttctgaggtagtagcagagacagggtagtcagggtagacagggtagaatgctaactgtatcctcaccacctgacaatagaagtttaaagatgtaaaagtatgataacatacaatctttcaccccattggtccttgttgtcaatagctctggatagctaggaatgtatttacttccttcttttgccagggttcattatttgtaccttgcaaatctgaacatttggccaaagtctatgaccttttgaggtacaaggaaatggatttttagttaagaatatttacaaaattaaaattacaaaaccttgtcccagctaaagcttgaaacacatctgtgtttgttcacagcttgtaacatttgaggctccccatcatgttaaatccttcctttttattttaaagtttgccttctcatatgccattgttctcctttatatttgagatgatggtctaggttttcagacagctctgggaaggcaggtgttaaattttaagctagtgcttggtaacctccatggtgaaatatgccactgtttaacagatgactactgtgctgtggacagcagtgccccaggagagaggaggtgtttgttccagaatctaatcaagctatggcctgtctgcatcctaacttatgcagtgtaatcacttgtatcattcgtggcatgtcttccattaatcagagctagtgcaggtaccaagggaacaggggttccattagcatgacatatggtggccttcccaaagttttggatgttttggaagatggttgcagggtttgtaccagtcatacaagagctgcttaatgacttagatattagtaaactttttcccaggcatttaatatcttccccgtttcctcttagtaatcgtagttaggttcttgatgtcccctgtgacatttttatatccatcaccttcaggtccaaactgtttgatttgctgcttcatcttggactcctcatatgtgcttctagagaacaagtatataaaaaagaaagtatgttttcttaattgcaaaagtgatgaatgaggtaggcaatcaggactgtttttcatattttcagagatgctgaaaatacatttagatttgttttcagaacaaaatgagaaaattgttttggaaaaaatgttataagtttggttactttggaaatgtcttcataaatactcatcttgataatataatttatctttgctagtctcatataacaatattgttgcctttaaaatggaaatttgtaagaagtttaaaattccagctttacatacagccccctttaaacctccccaggcattcatagatatgttaaaatatatctaaaataatactaaagcattacatttttttaccttattggataagctaatataaaagatgttttatccatttcacataattttaaattttaaaaatatgaagaccttatgttatttaaaatttattaacaatttatacactcccttctcctgacaagtccccatatattcttaaagataaattccctataaccattttttaaagtaaatggtatatgcttctatctgtcttggctatcacgcatctatcttggaagaaaattgttgggttccaggactgaatattgtactcacatttggataagacaaggatggggctctaagaaaaaaagcaagagagagttgtgtgcatcacaaagatgatgcctctcccgtgtccccatctccaagaccaagcatatacagaaatagccacaggtggctagagaaggaagaccagaagacatccaggagcatatggcaaggcaggaactattccacattgcagggtgagggaagagttaaactggtggagagcaaatcagaaatgcggtgaattcccaaaatattgggacaacaacaacatgactttggctattgtaggggatgaaaataccttttccacactcatcttaggttcatggctgaagcccctacaacaaaatacagattaataagagaaatgtgtatgaatttatttaatatacattttacgtaatacagaagccttcataaggaaatgaagacctgaagaaatcataaatgtttgtatttttttgctaggtttgacaaagagtggacactcacgggcatgtatgattggaggaaaaaatgttttaatctaataataacaaactgggagaaacttagaaaggcctatttgttcagattactttctgtgtccttgtgtcttctgagataagaatattccctttttctgggtacagggattgcacctctcacatgatggtcacgtgacttcacaaaggcgaggagaaggtgagagtgatccccttatttgtccattctcatgctgctaataaagacatatctgccactggataatttctaaaggaaagagatttaactgatttacagtttggcatgactggaatcctcaggaaacttaaaatcatggcagaaggggaagcaaacacgtccttcttcatatggtggcagcaaggagaagtgccaagcaaaagggggaaaagccccttataaaaccctcagatctcacgagaactcactcactatcatgagaacagcatgggggtaactgcccccatgattaaattacctcccacaacacatgggggttatgggaactacaattcaagatgaaatttgggtggggacatagccaaactatatcactgccccctacttctgctgttttctcatacaccagcatgccatattttggggtagtgtgtcctgaaccccatcactatcatgtgatggatgattgggttatatattctatccagcccttactctcaacctgagatagctaaagttcattaaaatagatttttgcttctactatgtatcagggactggtctaggtacttgacacatatcagttaatgaaacagaattatcactatccttgtggagtttacagaaaataagcagtaaacttaacaaataactaaattatatagtatgttaaaattgataagtagaatatatatttttataaaatgaagatgagaaggatcagaagggtcaaataattggggccaaggtccaaggtggggatgtcactgcacagtatttaatggggtggttggttaggacaggcctcattaggaaggtaatagttagataaatttttgagagcagttagggaatttgacaagcagatacctgtggcaagagcattccaggaagtcagaacagtaataacaaagactcaggaaggaggccagtctggctggacactgtggccagagggagagaggaggggatgagtgccgaggtgcaataccacatctgatcatgtaagtccatgcaatgaccttgacttttactctgagtgaaacaaagcagttttagcattttcagcagaggagaaaaacactctgatttatgttttcaaatgaatccttctggcagttaaatgagaatagacatagagagatttttgacatcattgctacttgtctggagttctcattaagacacagacctagaattgtccccataaatatttaaatcagagtcaccaaacatgacctggtgtcaaaccacaacctggacagaaattaattgcattgcacagctaaacctggggtctccctgctggccatatcagtggacttgccctgatcattttcttaatcttacattaacacaccacattatatgcaattgaattccttagatgccacttattattttatggcagttttactgaatgtatcgaaacccttaaagatgttctttttctttgacataacaattacactcttagaaatttccttaaagaaaattatctaaaattcagaaaagaatgccaaaagatatttaccaaagtataatagtatataatagtgtgcgtatatatgtatatataaaatagtgataaattagaaatgatctaaatatacagcgatgaagaaatggttaaaatactatggtgtatttataaggtaaaacactatacaccattgaaaacaatgttaattattggaaaattcttatgaaataatgcaaataaaagtaggaaacaaaacatacagaaaaaatctaaaaggaaatgcagcagatgttagcagagtctattcgattgtgtaaaatattcttctttatgttcctctgtatttacccttcttccatccaccattttcaaattattttatgaagttttctccagaagataccataatgaaaaagcttagagacaatcccaaggtcaagttcagagtgtatgatagaggccctttggacttgttcagggtgagagtggtgtatctgtaggtgatttagggtgacgtttggaatctggagatctcagtctacatgaatacattgctcatctggcacttgggtaggttatactttcccaggtagttcagctttaaagaaatgatcatatcctttaaaaacaataccagtcaggtgcagtggctcatgtctgtaatcccagcacttaggaaggcagaggtgagaggactgtttgaacccaggagctcaggaccagcctgggcaacatagcaagaccccattcttcacacagaaaaaataaagtacataaaaataaaagtaatatcaaaaaatgaaaatacaatattttaaaacaaaatcttgaagtgaattcacaaatttttcagatgtgtgtttaaatacacatctttctccttgagagtctagcttctatgctagtggttctcaaagggggcttaaacttgttagtaatgcagataattttaggattctatccccgacctactgaaacagaaacgctgatggcaatctattggtggggctcaggcgtgctaccccaaaatgctgcacctttggcatttgagaaaacagcagacacagaggagggtcactcttactttttcctctcccttgtaaaatcataagacccttatttgagaggtgccttcgctatacccagaagaaacatccttatctctgaagacaccgggacatagaagaatctgagcaaacaggccttgctaagtttccccgagtttatcacctcctttgtccagtcatacttctccgggactgtccactcttcaaacctaagcataaaagtacacaagctaatctgtttctttgggtcttcattttctcatgaagtctcctatgtcatgtaaaacttatattaaataaatctgcatttatttaatatcttctttgtatggagcctccaccatgaaccgagcaatgggccaggaaaagacatcttttcctcccctacaacgtgttttaacaagccctccatgtgattgtcaggcagggctctaaatttggcaagcactgcttggtgttgagtattcagaagtgacagactttggtagactccaggctcagcaggcagccctgccttcagagcatccgtccatgaaaacggatggaaaatgcagaagggcctctccctatcagaaggagaactgagccccaatcaaggtgtagattagtggttgggcatgtagaggagggctgatggaagattataagcagaccatttccagagcaacaaaaaatgtaggactgcttcctatttcaagttctatttctagtaacccaaactgatgttagatgatcacagcaagaaaaaaaaatgtgccaaagctaattcaggaaactgccacctgtttggggtggggtagtcaatatcacaggtagaatggaagacttcctttgcacttctgactaatggattaaagtgacaaaattcaaactgggctgttaagtcattctctataatattgtggaatcgctaggttttataagctcagaaggcatctcaagtttagaatccaagagtaaaattctgttctcagcaagcttcttactgccctgaagtaatttctcagatgggcccacgtgtcttctgcccctggctatctcttacttgtggcttgcataaaagcctctacgtgcactgctgtcgttatttttttctttgaaaacggaggcaaaaatacttcagctttgatgccttatgaaaagagaaaatcgtgacatcttcttaatatgaaaaactagacaaggttgttaatatttaattgtctaagccagatgcagtaacacatgcgaatgtgttcataagtttggaacaggggatgcatttgatttactcttctacaactttccaagtgtattttcattattttacagaagctcatataaataactgataaaatcgacttgttaaaaaattaattggatttgtaatataaagaattctttttacccatagtaatatttgttcgttatagattttatctttaatttttaaacttctgttattttgaacctggtgaggtctacttggttgaactattaatgaaccacatgccaactaaagttgatgtgattctttcataaatcagtatatgcatttataatgcacatcaattttttttctagaagatactatgtgtgaaaatgtattaatttaaaagaattagttaacttcaaagagatgccttggaaattttatcttaaaaattaaaaaagaaaagaaaataaataactgagcttcagacaatttatgctcagtcctcagaacataagctctaaaccatataaaactttatttggtcagttgctcaaaatagtatcaaatgggaccatcttcccaaccagactttcttctcttctcttgcaaaacttctcttctcatgtcattttcaagaacttgctttatgaataccttttcttgtactttctgagagtatcagattgcaaatacatatccatacatgtatgcatatatgcaaacatacacacacatgcacacacacataaaacttctctagggtaattttcagatggcaaaacaaagcaactcttcctctgctcttcactctatacataattttttaaaatgtgttattcctgcaatagtagttaaaaagaaaatagtatatatcgacctgaaagtgtatctccccagctcacagaggggtcttatttcactatgataaaaacaaaattaaggttatagttaataggtgaaagcaaagatcttaatcaggatgagttcaaaatgctaaagaaatgggtattgtgtaggaaatgggaaaagtttgaactgatagtgtgggctctccagtgctgttgacatgggcatatcatttttgtccaggttaaaagaatatttaaatattcttttaatgcaaaatgcaaaaaatgcatttgctgctaaagtaatgtattatttaacatagctgaataaatccagttcaatcatttgagaagtgcacataataaaataatgcttcagcctaatcaatctaaggcttttatttactctagatctatacttcatacgcttaggaggaaggttttttgctctaaaaattaggcgcaagtaaaatttttcctaaagtatgaaatagggatctaaatttgggcctcacaggccagcattacaattataatatatgtgatgaattaatgtgattaatttataattgatttagataaaaacaagctttaaatatgggattcctaatacaaatgtacagtattcacattttactaaggaaagaggctgttcttacagcccctttgaaagaggccgttcctacagcccctttgaaagaggcctttcatgagacgatatatgacgtgaatattgttattatttattttggtcttcttacgtcagcatttcagctatcctttatagttgctttgatatatgtttcttctatcagtttgtgtaaagaagccatccctccatgacctttgtatgaatatgagtgtccttttctgttggggatagaagctgagaccacagatttctttgcacagcaactcagatcactagtccatgaagttagaatggaggagaaattactggcaggaaactcagaagtctgcctttagcaaggaggaagaggaagctcagcttctccctcttggcaccatttctgttagtctgagacctgtaatgtgtggttagaggtggtaaaacccaatgggtagatgctctttaggcttgagtaatatagaactcttgaataattggaagaaatgaaagtagagttctttcaagtaggaacacaaagctatttacctagagcaatggttcccagagtgcagtcctcagatcggcatcttctacatcaacctgatcttcttagaagtgcaaaattttcagccccactccaagcccagtgcatgagaaactccaggtatgggacccagcaatttgttttggtaaactctccaggtgattctgatgcatacttatatttgaaaatcatattctttagagggtcagtagcctcttttctgctgcctctttcagctaaagagcattcagcctcttaagctcagtttcatttcctttctcctcgaaagcgaattgtttccttgacaggtaggtagtttagatttttgaaatgcagaattgagagaaaggggaagagaattggatcagaactgagagagaaattttctcaagagcttggagaagatcagcgctggaagaagagtttcaggtaggggaaaatagacatgtagccatcgagtctgaagtcatctggggtttgaatcttggttctgccacttagatgatgcagggctttggtccacttatggggcttctctaggactcagtttcctcatatgtacaatggagataaaacaacagtaatttcctcaaaggcgtgttaggaggttcaattagttaatgtattatatggagtatgacacgatgttcaatatccattaggtatcattgctggatgaagtatattctattaattgtgttcagaaaaaagggagcaacgaatcacagtgatttgaactttactttttgattgctggactggttactttgcttaaaaaaatgctttctgagaacagaccacatgggtcacagcttcaagaaaatttcaaaaggaatatatttttccaagtagagcaatgttaaaagacattcagaatccaagacaaataaaatgctctgttattacaaagctattgtaggtcctcagttatcattctctctgctccaactctttgaaaagctcttcccaaaacagagggacacaagttctttgtcccctgttccctcatgagcaaactgaaggcttctttgcctcctagtatatgggtcttttatttctaaaactgacttcttaaagatgtcaactagctttcttgtgtgcaggtcttaaaacatgattccttcagcactggattgaatatccagtgaagatttctgtaataactttctaagttctttttttcctctatcatagagttccattggccaataagaagagcattttgactcaccaacatagatttttatttttgacctcttcactctattaatggcaaatagtaaaagattacatagtgtggtggaaacagcaagatatttggagccagacaaggtagttctgactcaacctctaattagctttttgacttaggaaagtcatttatcttcttggatcaattttctcacttagttcagctttcaactaggacaatagaaccttacagggatgaagagacaatcaagtgggggaaaaatgattttttttaaaaaaaaactgcaaagtgccattcaaatgttagctattgagagttaatgataattaacattcactgagtgtggatgaagagctgggcaccatggaaagtctcatatatacatatctatatttatttacaaatagatataagattattgcaatgtatattatgttcaatttgttaaatttacacagctagtaaataaaacttagaaaatgtaattttcttagctcatgtttaaacatttaaacctcgattagaaacatgatcagctttggtctgaaaataagagaaaactctgacacaatctgatgaaaccaataaggatacttgctatcgctcataacgtgaagttcagagagacagtggacgccagagtgtctttaaccatattcttatagttaccatcttttatgacaatcatcacagtaggctgtgttagaaatttctaaagctgggaaaggcttcagcagtcagagtctagactgttttcttacagcagggaaaatcaagattggagtttcaaggagctaactcatgatagcaccaggggatggtcccttcatccaatccctgattggaaaacaaccctaggccatgacagtggcagggacttagtttgcttagtgacttgctctttataatttctagataaatctgcattttgcttcactcttctctcatcagagaggttgagttcttcaaacacttttgttgttatttctcaattcaaagagcaacataagaaagacatgctcttactaggtcattccaaggtttttttttccatctattatatgtaatcagatttgtatctctgttgtagaaagtcttatttttctttatgtctgttaaaataccagtaggttctctattctgctaatgtaatatttcttttttttgctgttcctttgagctggggcacattttattgttttgtgttaattctgtgattttaagtctgtatatcaaaattgtagtcctactaggcatgtaaatattataataaatacattagtaatgcagacagcctacaaaatagtttgctagtttgctctaaagatatttctggctgtgataatgattaatttcagataccctgcatcataattttcttgaaatatgtaaattacttccctctcaaaatttcttatgtagaaacacacacacgcacagacacacatacacacacatatttagcaggtcgaaatgaggttcttgaatctgcacaaaagttgttgatgccaagcccaaacagtacaattgtgagtgcagctggtcaggtcttcaataccgttcccttctcctcaccattcttcatgcccaaggggtctatttgcatttcctagaacatgccttgcgctttctagccttcagaccttttctcccagtttgtccttcacttaggatgtcttcttttagtatctccaactaaatgaaccccaccctttcaccaatagggttgaaaatacattttctcaatatctcagacaatcccaggccagacaaaaccccaagggccagttatcttttgcatttcttgagcactggttgagcatcgtgttagtaaaattaaatgttaatctcaaacacagagtttgagaggaaggcattcctgttttgcaagtcattgtaatttcccccgcaggtagcactgtgcttttagatgaagctcagtaggtggaggcttaataaactgttttttggattgatggtatgattagaagtaagaagacaattttggcttaactaagagaaaattacaaactagaattaattgtgtgttttaaccaaaaaaaaaaaagaaaaaaaaaggtgtggaattgatcttttgtttactgtaaacatgttttccttttaaaacctttcacagagactgagtaattttgtgctatctctttgacccatcttttgcctgcaccctctcatctctttctgcatcaccctcatgaggggccaagctttctttttaggttgctctcttccttttcaatgtgtttatgtatttttcttcttagaagttttgggaagaattcagttacatttcaaaagtcttgctcttcagaattaaacctttagccctgtgccttttgattggctctaaaagtgcgtgtgtggcctgcggggacagttgtcagcgtggcatctttcttccagtgtgcccctctcctgcccttaagcattccatttttccttttaaccgtaacactgttgctttaagttgattttcaacaggtcttttgactttgatgatttcccaagatattgcatgtgtgaggtgaggagggtgtatgcggacttgttctttcctgggttagtgactagcctgagagagtttaaggagctaaacacaactatttccttgagtatgagaattatgattgaatatagctctatttttctccacccttgtctttgacatagtcttctcactttctgcatctttctgaaacatctataatagttttgaccctgaactttattctcttaaccagtcctatcaatattgtaccgttttgaagttaggaggtcataaagccattaactaatttggaagattcatcaatggctttgaagagctttacaaaatatgctgagtattctcaaaaatcaaatcagatcaagttagaattttaagaatttattgggcatataaagaacagtttgtgttttgttttgtttgttcggttggttttgattttttttcctggagaaaggttagtggctcccagagagtctagggcaaaaggctagtagggcctgatctaggaaagacttcttgacatttacttgagaggggcatgcaaaggtaaatcaaaccatttttttacacagttttagggctacttagtttttcttttaagattttctttaaacgtctgcataaaggttttatttatgttttaattgactaataaaaattacatatatttgttgtttacaatatgatgtcttgaaatatctttacattgtagaatgggttaatcaagctaaggaatgcatacattaccacacatacttatttattatggtgagaacacttaaaatttactctcaactttcaagaatacaacatattgttagtaactatagtcaccatgttgtaatgtacaataggtcaaaaaaaaagagaacagttcatgaattgggagactttgacatggaaacatgacatgagtctcaatattacaacaattacagtacagcttgtagaacatatagaaggaaggattttgatcttttttcatgattggttatatcatttttgaaggccattagggctgtttaagctcatttctctgtagctgtattggtttagttacactgaatcatgttagtaaaggactaaaagcttacgtttgtgttttgtttacatttcacgttagcctttcagggaaatcaggatgatataagttttggttacttgactataggcagttggccttggggtaggtaaatggtggccttcatttttatttatttatttattaacagtaccctctctttttcaggtgagctaaactatttatccaagcaatgcttatttctccctatctgcctctctcttctcttctcctcgctaaacacagacacaaaccccaattagactgtaatattacggtatagttttgattctacccatcgtgacttatgagacattgcttaaatacacgctcttattttttattcatccaaatctcctcatccagcttttcacccatgtttttcttcatatgctgatgaattcctttcccagagaatctagccaattcttttgaggctggctgctagctccctccccaaggcctccacttcaaagtgccctgctgccatagcggaaccaccaacaatctttttcaaaacaacctggatttttttttttctccttaggtctgggtatcaatcagacacagaggagctgatgagaactggtaacctaaaacaggatgctaagaagcatcactgacatttatctgggccttaatgtgtggcaggaatttttctaaggacttttccttatgtgatttcatttaatcatctgaataactccataaagtattattattattatcctcatttttcagatgaagaaacaggcctaggggggtaagttacttgcctaacgtcttttagtacaagatggggcttggattatgaacacagaggatcagcctccagaatttcagttcttaagcactctgccaaatggtgcattatacaagtaggtacacacccctattttcaaaccttgactggaaacacaagcattatggttcattttaaaatacaatgttaacttttcagtttataagcatgatgttcacaatttagatgatacactttggaatggtacactctgtatatttgggacatttcatttggcagccactgaagcttgttaatatcaacaactggcttcattggctccttcaaataaacccgtttaatctattatagctggcctctagcaaatatgccataagtagaaataaattttgagttaaagaatattcaccgtgattagaagctcaaaagaagtattttaaatgtgtgtgtctgtatttgggtatgtataaatagataggtagatagacagatgggtacatgatagatacctttgaaaacctttttcagttatgaaagcatttagtatatagtgttaatagaattttatctatcataggttaggtgtattctgatgttcagtttatgtttttaaaataatttggcagaaataaaagtattgacaggtggattgccactttggcaattttcactctaagacatcaatcgacaaagcaccaaacagcaaaacatattactcattgactggtaagtcataagccccagaggctgttgatcatcctggatgctggatgcttgcctactgtaggacagatggaagaactggctgctaaatcgtttctagcacttgacgcccagcatgattggggatcctgagcactgctggaaaaatatttctctagtaacttatcttgtgcttatcagtgaatttgcaagcccaagagagatctgttttgttgagatggcttctgaacaagtcaaactcatgtttccaagccaatttctaatactacacttgttattggatattacttgaaccagtttctgtttatggaacacttagaaaatttaattggaaatattcattttgtgattcaaagattatttattgtacttttgctggaaaggctgaaggtaaaagtatggctacatatcatttggcctgattttatgattcaaaaccaaaaaaagaatatgtcctgtaatatcttttccattgcaatgtagttttaataatgctgcagtgagtggattattgaccaacatttcctagtcctggagccacagagagaaataagtcatgtaggaaagccagcatggcctcactggctcccattatcttgattagtaaggtaggattgagggttaggttttctttcttttatttttcaccaggccccaatatgtgctttttcgtcctttgtcaacttttctttttcttttttctttctttctttctttcttttttttttttttttttttttttttgagatggagtctggctctgtcacccaggctggagtgcagtggcatgatctcggctcactgcaacctctgcctcccaggttcaagcaattctctgcctcagcctcctgagtagctggcattacaggtgcccaccaccacgcctggctaatttttgtatttttagtagagatggggtttcaccatcttggccaggctggtcttgaactcctgacctcatgatccatccgcctcggactcccaaagtcctgagattacaggcgtggaccactgcgcccagctgtcaacttttctttttaactctcctttgaatagacctaacccacattgttgtgttgaattttgatgatcaacagtactctgctcgggcttcctggatccagagccctgcaagagataaagtagcaacaggtaattacttggtgaacaggagatattgaaattgaatcaaatgtcctagagctctttccgccagactaacctatccccagcttactatggaacacacatagactttggcttttagcacccttccgatgcagtgcctttcttccctgattgcactgtataaaagctacaaatcatgcttctctgtctacactccaccccgcaaacacacacttttttttttttgccctccatgcttactattctccttctgttcacatggtctttcttcaaaatacagttatttatttatatatggtaaattttttgtaaagatagggtctcattatgttgcccaggctggtctcaaactcctgggctcaagcaatcctcctgccttggcctcccaaaaagcataaaattattttgaatagagagttgggaatgaaaggaattcttggattttaagtttatagtatttgggcttcttctataaatagctgatcccatatattatggaaagagaggttacttgttttattctgtaatgatgcatagacgaacaccacaccggacccatttcacaaagcacgtcctgcaaaaaccctcacatccacactcattcatattttctttggtacataaaacggttagaaagtattgacaagtagttttcacattttgattatgtgatttgctctttgtaacttttttttattattgctcacaaaataattaaacacattcctattcatgcagacaccattatcaattcatgttagattaaataattttaaaattaattaacttattaacaaaataatattatagtatcttatgaattgcctagatatggcattgttttgataagccaaagactaccccatgataacatgtatttaggagcaaccaagagaagaatataggaagtctccagagaattctatatacttgggcttaactatggtcaaagtattgccctgaggccacttttaaagcacatttctgattcaaataatggttttgacatatgttaaggaaaatgttggcaacaaatctagagatgaattgaagacttattcactttacaaaaatatttcttcaacatgcaaaagcatacacctctggaagtctatatttcagctttccctagtattgactagtagattcttactgagaaaaaaaatgaaagaagtaaaagtagatacatttaaaattaaggcattaagactatgcatggtggctcatgcctgtaatcccagctattaaggaagccaaggagagagaatggcttgaggccaggagttcaagaccagcctagacaacatggcaacaacctgtctctacaaaaattttttaaaaaattagctaggtgcggtggtgtgcacttgtaatcttacctatttgggaagctgaggcaggagaataatttaagcctaggagtttgaggctgcagtgagctttgatcacaccactgtacttcagcctgggcaacaaagcgagaccctgcccctgaaaaaaacccagtaataggaaaaaaaatacaattaaggcatcaaaagtgattgatagtttaacatgcctttaacctaaaagtaaaaaatctattacattataatgtaaatcaatagaaacatgtcatataatttacaaaatgttggtgaacatacacccttttgagacacatgttttctgcagatcaacgcaagttgcacaggtataactactgacaaatggcctccagaagttagagcaggcattgttaatttagggctatatgggttccaagagtcccagccaatgtcagactaggatcggtcaactcctggagttacgacttggcttgtattttgacattttttgtgttcattagttggaggatttgggtggcagtaggaatggaatctctagggtcagcatccctgtagtaggaatttgagtctgaaggaatccttgaatggatatcagtggatctataaaaactttaaaatcacggacaaaaatgtatgggatggggacaagccaataatatggtttaaatatttctaatcttttattttctggtcagggaaggtcttttattagcttctgttagattacgaccaaggatactcgattgaattgcaaataccagaggactaaattactgtaatatagtaaaaatgtgacttaaaacattaaatggattaaggagaaagcaagaaaagagtgaaagtggggaggggagttttcggaggggtggaacttcattggtggtacgggaatatatgtgaccttattatggaaatattctctatcacacacccaccttgaatctgtgtgaagagcagagggcgctttgctttactattatcttttttgctgtgcgatttccaccgtatcacttaatatcttccagttgtttcttcatttgtgttccttgtgttttgctactgacctcccttggagggatgttgtaaggcataaatcattaatgattataaagtgctttggaaatagaaagtattgcttcagtgatagcccagatgcacctaggaattgcagcatgaacagtacaaagcaaaaggcatgttgtcagaattccttttggggctccggatcagccaggccttccgctcacatcagggtgaattagggccatgaatctgaaagtacatctgatactgcttggcttgtacgtgctcttgttacaacattattttgacattttttgtgttcatttgttggaggactttaaacccttttctaaccaaaggaaaccaaagtgcctactgcaagcatttttcaaagatggtgtcactctgattgaggataaaaaattgatctactaaataaaaatgttggaatggcatgtttatcttacttgtttggccagatataagtaaggcagtgattcagaagaaggcttcattagaatgcaccatttatctaatactttgacagtcagtgatatcttctctctccctctgctgtctctctttatgaaaccaaacactgacctgtctttagcctacaatatcagatacaagaaaacagagaccaatggaagtaaataatccatcaagttagtgttaaagataagactagaaactgggtgtttcatctcccagttcagtacttctatatatctgagtattctttgatcatttctaagaagataccaagcagctttaatcaaacattcatccttcctaaaaggacctgagatttttattcaaagattccagaataccagttattcataaagctgcctgtccatgcatttagagtgtgatagagatcaactgtaacatccgtcatgttactacactccaagattgatttctgtggtctacttggtttgatggaaagtcccttcttcccttacagtctacatatctcctttaaatatgacttttatagatcgaggtgaatacatgattaactacattttcctcctattcatttatctatgtatagaaaaatgtgagaaaggagcaggaatctaaataaactcctaaattttcagtcgttgaggtatgcacagttcaaaagagatacttgtagactaaattatccagatgatagtaaaaattccctattttacattccagatgcagatccagcctcagtgatgaatacctaaatataattcccagtccttttatttcttatctttctccccaaggaacaggctcttcctcctactttggaggctcttctctctaatcgttttactagttcatgctcttttctccttggtactgtccaatctatatactctgttagattagaccatcccaactgagaaagcacagtgggatggagaagggagaaggcatggttcatttttgtatggacagttctgagtgattggtagggccagaaaaagctcttctgtgctacaggcttagggacaaacaaacactatgattgttaaaagatgttaaatagagcaatcaggggtttgaccgctcaaatgtagctgcaaccaggaccaatttgatgtgagctctgaggcccagtttttttcgtatagaaacaattatttttttttatgttctcccagagaacatcagccttgaaaacctgtttgtgctaaccagactcacagaggactgatttctgaatgtgagtgccactttattcaactgtaatgccactaatctagttttgcagccaccatggccctgccttttcacactttcttggtgttaatggatccaagatgtagaattagtgactagaagataagtagccatagaaaaagaattggaacagttagtgagttattcaatctgacctgtaatagagcctagaaaattattcctattcctctctgattgcccccttatgtcttagttggtcaggctgctgtaacaaactaccatgaactgagtggcttatgaacaacagaaatgtattcatcacagttccagaggctggaagcctgagattagggtgctggcgtggttgaactctggtgagagctcttttctgagttgcagactgctctcttgtatcatcacaaagtggagaacagagggatggagagctttctctggggtctcttttataagaacattaattaatgagagctctatccttatggccttgtctaatcttgattaccgccgaaagggcccgccttctaatgccatcacgttaggggaagggtttcaacatatgaattttgggatgacatagttatttaggctgtaacaccttataattaactgaaccatgtgtgttcattcatttaatatgggtttactatacttctcttatgtgccaattactgtcctaggttcttgtatttatcagtgaacaaaatagacaatgatctctgattttaattgtctgtatccagcagcccatgctgtaagagtattagaatattagttccattagggataggaccagcataatggatattgggcacactcctgttagtttcatgaatgaatcaaggctggctcctactggccaaatctgtgccctttgacatttcatttccaggctgtatatcagtgctattcaatagattattcagtgataatggaaatagtctctgtgctgtccaatatggtagccactggaaatatgtggctttgagaactttaaatgtggctaacgcgactgaggaattacattttaaactttacttaactttaattaattgaaatgtaaattgaattagctacacagagctagtggccattgtactggaaggtgcagtcctggctgatccacagcgccccagtgtctctgtgagattagagactgctgcttttgaaaagttgctgctcagaagacagtgcaatggaccattctggttgtttaggcatccagaaaccagactgttcctatgtcaatgagtaggagcacttgcttataataaataggaagttgcatagccaagtagggagacctagattcctggagatgatgtcaataggtggccacttatgcagatgtttactacttaggagatcttcaagggctcctaatgggatttcagctgtttgggaggtctgaaaagatgccatacataatcagaggtcacgaggcctggcctaaggtaaaaattttttttttttttaaacaggccacagtgcagtggcataatcatagcttgctcactgcatcctcaaacttctgggctcaagcaatcctccagcctcagccacccaaagtgctgaaattataggcatgaaccaaaaggtagatatctttaaacactaggttgggttttgggagcagaattcctgttcctggaaagactgttaagaaggaggcaagaccctcatctttgagaaattgtgacggggtggattttgagccctgggaacccatgcaggcaacttcccagagactagaactgagggatcaggaaagaggaagatttccagataaaggaacttattctcaaaagtatacagtgaacagcagcgaagttcacatattgttgagtccagtgagctgaactaggctctttccattcttcgttcatagagctggctgggctgggacctgggaatcagattgttccatctgttgccagggaaggaatgtgtgtgccgggggaaggaggaggtcacaatgtgttctctttgtgtttttagcaatttggtgtttctccttaaggatatttagcagaaggacatcatttcttgaaaaacactgcaatataaaacatgttataaatcctatcaaggtagcttataccttcagaggttaataggttaattctctccgtttacgatgactgtcctaagctttagttccttgacaccaaccacggtgaagtccagcagagatggaaacctgtagtgtgctgagtcaggagattccaatgggagtatatttagtctgaaatctctggggctgaaaatttaacattcaaagcaagtaggcaaagctggcttgggtagctgagtgcatggtcaggtgctagagagaaaagcagagattcagtttaggagaaccctgagaagttcattccagttctttccttgctgccttcacaactttttattggaccagttctatgccaggtgactctgtactgagtcattgtaaagtctttcaaggctacaggtaatttggaacttgcagctctctacatacttcaaattatttctcaaaaatctttagacttaaatgagttctttttctcaatctaccatttatatagccttattgtccaagatctttaatgacccttggcttgagtaccttcacatagcaaaggattctgctggagtatatgagttccaaggtatttttttctgatgaaaaatatctatcttggtttttacttattagaaatggaaatgtaagcactttgtactcactatataggccactggataatcaccaggttggtgcaggtgtgagggtgagtgtcagaaccccagagaactggttatgttttgaggatccatattcaggaacatataaatttatattgggaaaatgtaaatcaaaccacttgtactgaatgcttgactacactttcccatggtacacatcatcatttccttttaagacatgatcactccacttaaaattgtaagccattccttcatgtagtggcattccctgcctctcttctctgttttctccaagttttaatcacttataatataatatgatataatgtaatacagtataatataaaattcacttctttttaaaaaattgtcttatcactctttattaaaatgcagtctccatgcagaaagggatttttgttttttccactagtacatcttctaacttcaactgcttctgacacatagtgggcacacaataattaagtgttgaatgaaagaatgaataagtgagtgaatgaattttttggctgataggaatatacaacatatagattccaagacatgaaccttgtagatggcaccctgtatgagaatttctcaggattttccttgcaagtatgtcaaagactacaacgtactcaccaaccccatttcgccttccttctgggcatccaaccacacaatctttccatctacctctacatttgatgacactatgtgatagtgttctggccaattacatgtggatgcaagtgatggttgccacatcctggcctgaccatgagaacctgactccatggtccaccatgcttctcctctcctattaggcttgaatgaagctgagacccagggcatacttacatctctgtgatgaaggtggccaagtgcacaagaaggaaggttctgagtccctgggaagaaccatccaaccaggagcgctgccccctgccttgacacacacaattgagttttagcattagcattgttgtaataatgcaagaggtaaacttgtactgtattaagcctctgaaatttgaggtttgatcttttctagcagcaattaatgtttccttaacctccagcatgaaattttcatgttgattaaaagaagaaatcaagttttggaaaaaacactgctaaagaatatgagtgtgtatattagtctgttctcatgctgctaataaagacgtactcaaaactgggtaatttataaaggaaagaggtttaattgactcacagttccacatggctggggaggcctcacaatcatggcggaaggcaaaggaggagcaaaatcacatcttacatggtgggaagcaagagagagcttgtgcagggaaactcccttttataaaaccataagatctcgtgagacttattcattatcacgagaacagcacaggaaagacctgcccccgtgtttcagttaccttccaccaggtaggtaattgaattcccactacatgtgggaattatgggagctacaattcaagataagatttgggcggggtcacagccaaacaatatcattgtgttaccgaaataatctcagtgccctggtcacagcccattgtgtcagtttaaggaaaaaaagaattaactttaaaatacagagaaaaaaacattctgctttttctaatcagttaactgacatgctttcatttttatttttttaatgggttaatttccttcacaggacagaagcattaggctctggagaattttagcatgcacccagataatttcttttttaacttggccttcatattgctttcagaaaccacccagtgcgttgtgttataggaatgttttaaactcatggaatgttcgtgtcaactctttcaaatcaagtgtgccctcaagagagaaccaaaaatcataatcttttttcagtgtatttgctagaaatgtatcctttttcattcatctgctggagttttttatatttctctttgatataagtagtgtaacctgtgggccatgtgttattacctaggtaagctggcacactgtttttgtggggacactaatcttttacagttttttctctcccattagtttgaaatttgtagttctagcaatatctttcttggaacacacattaaggaaaattatgggccaggcgtggtggctcacgcctgtaatcccaggactttgggaggccaaggtgggtggatcacgaggtcaggagtttgagaacaccctgaccaacatggtgaaaccccatctacactaaaaataaaaaaaattagctgggcatgggggcacactcctgtaatcccagctactcaggaggctaaggcaggagaatcgcttgaacctgggaggcggaggttgcagtgagctgagatcgcaccattgcactccatcctggatgacagagaaaaactcagtctcaaaaaaaaaaaaaacacaccacgaaaaattatggtgaaataatggatcttaattatggagaatggaagggtcacagtagagaaactttcgaagaatctgttttcttcccctggaggtttcttttggggggacctcatcttggctggagcgagatgttataaggcagtgtccattcccctgcagccactcccaccctcttccatcctgaagcagtgttctcattgctgatagatgaaagaaaactgggacctccttgtccataaacttgaagtgagtctaaacgtgtaagattttcagcctgggtttcaaaaatgcatgtgaagaaaagtctagtgaacctgactgtggttaacttggagatttaattacctgagagaagagagagagtgaatacctttggctgccagaggcttggtacgccttgcttttggcatttgttttttcgtcattatagctttggttgctagtcttcaataaggctgcagtgatcataatgataatgttgttcacaggcaccctgtaagacctcatttacataggctaatagggctggagaagctcaagcaaaaattaataatgattaactgtgtttttatttgactttcaattgtgattttcttttttaattgccgatgcacttccataaatagagtcaacttttagttctcacctgagtgtaggtaaatgggaggaagtggtgagtggaaggggaaagccaaattgatattaaatattcccataacctttaatcacaaatgcaaattcgtgtttactcagatagggaattgaaagttcttgatgtcatatgggatcacgtattaggatttgagcattatgcagagtaatttgaatttgtattcatcaaaatactgtgaactaaatatatttaattgtatattattccagaaaccttcattttaaatctgtaggtacctaaggacaacatgttaaaatattcttgcattatgataaaaaatggtattctaggaatttctaaatagttttcattgaagcaacttagacttattactgattcttgatatcacagaaaaattaatgtgtataatagttgagattattattctttacatttctcccttgaactaattaactggtaacttaatttttcttctcctatcctctccatacattgaattccagaaatttataataatagcaaaacaaaaacaaaaacaaaaaaacctcatctgtaacatgagtaccatctagaataatgaaagaaattttacctgtatgatttaagtatttgccttcttgtaaatattattatggaaagtgttaacagaaatgatttctgatgtctaagcaaggactggttttctactttttcaccttgtagggtgggggtgggggcagtggtacaggggaagatgttaataagttagggttaagcaactcttttacagttacactatgacacaagagggcacaacaacacccctaaatctctaaggctggttgttgccataggctggagagcagagaggaaaaataactagttttagagacagataaactggagtttgaattccattttggcatttgcaagctatatgattgtgtgaaaattagttaccctttataacctttattgtattcatttgtataatagaaaaaaatattttaccagattgatgtgaatattaaatgaatgagaatttccagttgtctacctctgtgtgttgttacatatcaattccatgagagtaacacaacctgactccacaggaaagaacagtggaaacctcctgtttgagatctcccaggctcctccctatgcatcacttcaatgggttgagtttgatcagtgtcctttccctctaaaaagtcatagctgtgaggatagtagctttcagtgagctccgtgagtcctactagcaaattatcaacctgaaggtgtttttggggacccctcttcccaaacatgcagttggtattagaagtgaggaccttcttggagaatgtgcccacaaacatggctatctggctaacttttagcacaaatgaaaaccaaggttcttcactgtaccctctactaggcatgccaaacatttttttaggccaattccacagacttttcttggagaaacttgccaaaggtttagaagggactaataatctcaaataacatgtggcttcagaaccctgatacatctggtacaaacaggtggaagacattttagtgcagtgaaaatggtctaatgtgatttggaatataggcacagagaaaaagagactctgttagttggtgttgggtgcttaaattaggagatcatctggccttgaagctgaagctcaaactgaggcagccataatggtccatgtgcagcagagtgtagaaacagagaacatgaagaagaaaagcaacttgaagggagaaacagaaccagaagccaaggcttggcaggatgagagcagtgcagaattgatcactttacaggacttgcaagacccattatttctccctgtgtttccttatcataattttcctctgtctcttccaaacaccctgtacctaagcataagtgtgagggttttctcatttcttgtaatcaagagagtgttaatgaagacattctgaatgaggcttatgtgatttaaaaattgctacaaaagagaatgtgttaatatttatattcaaattgctaaaacacgtatcaaaatatctatatatatattccaaagatatcagaaataatttagaatgggggattcttttttcttaagtgaaaaatttaacttcagaagtatttaaaagaatgtaagaaatgcatagtaatacagcaagaatatgccattttacatatttttaaataatacattgcattgaaatactggtaatatcctttgttaaagaggttgtggtaaaaacataactctcaggatacaaaatcaatgtgcaaaaatcacaagcattcttatacaccaataagagacaaacagagagccaaatcatgagtgaactcccagtcacagttgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatatcatgaaaatggccatactgcccaaggtaatttatagattcaatgccatccccatcaagctaccaatgactttcttcacagaattggaaaaaactactttaaagttcatatggaaccaaaaaagagcccgcattgccaagtcaatcctgagccagaagaacaaagctggaggcatcacactacctgacttcaaactatactacaaggctacagtaaccaaaacagcatggtactggtaccaaaacagagatatagatcaatggaacagaacagagccctcagaaataatgccacatatctacaactatctgatctttgacaaacctgacaaaaacaagaaatggcgaaaggattccctatttaataaatggtgctggcaaaactggctagccatatgtagaaagctgaaactggatcccttccttacaccttatacaaaaattaattccagatggattaaagacttaaatgttagacctaaaaccataaaaaccctggaagaaaacctaggcaataccattcaggacataggcatgggcaaggacttcttgtctaaaacaccaaaagcaatggcaacaaaagccaaaattgacaaatgggatctaattaaactaaagagcttctgcacagcaaaagaaactagcatcacagtgaacaggcaacctacaaaatgggagaaaatttttgcaatctactcatctgacaaagggctaatatccagaatctacaatgaactcaaacaaatttacaagaaaaaaacaaccccatcaaaaagtgggcaaaggatatgaacagacacttctcaaaagaagacatttatgcagccaaaagacacatgacaaaatgctcatcatcactggccatcagagaaatgcaaatcaaaaccacaatgagatatcatctcacaccagttataatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaaacatgctgctataaagacacatgcacacgtatgtttattgtggcactattcacaatagcaaagacttggaaccaacccaaatgtccatcaatgatagactggattaagaaaatgtggcacatatacaccatggaatactatgcagccataaaaaatgatgagttcatgtcctttgtagggacgtggatgaagctggaaaccatcattctcagcaaactatcgcaaggacaaaaaaccaaacaccacacgttctcactcttaggtgggaattgaacaatgagaacacatggacacaggaaggggaacatcacacaccggggcctgttgtggggtgggggtagcggggagggatagcattaggagatatacctaatgttaaatgatgagttaatgggtgcagtacaccaacatggcacatgtatacatatgtaacaaacctgcacattgtgcacatgtaccctaaaacttaaagtataataaacaaaatacactcattcagtattggagattgtaatatgacactattcttttggaaaacaatttgacaacatgttttaagctgtaaataaaattatatctatcggcccagtaatcccactcctaggaacttaaatgtaaattttaaaaaagaaaaagttttaggcataaagacatacaatttaaatacaaaaatatgaagctactttattctcagaagggactagaggaataagttactttcactgaaattgatggattattatgcagccattacatgagaattattaagattatgtagcaacaagaaaaattgcttatattcatgacacaaaatgaaaaataatggagaatataaagttgtatctgtaccatgatagaactacatagtaatatgtactagtactaatttatcaattgtgcactagttttgtactttaggtgcatgatttactcaagtttcacaaccacactaacaggtgacactaatattattccattttacaaatgagaaatttagacacagacagtttaagtgacctgaagtttcatagttgggactgatgttctgtttcaacccaactgatctaatgccaactggagtactataatacaattctgatgcattaacccactggagttgacatcagactccacaagttaaaggctcagtcatccgcaagactctctttaattcagatgccatttgtactttgccatctgtacttgagcctgggaaggccacttgcacttataaccaactggctataaatatcgaggttcccacaaccccctcatgtatgttaatttggtagatcaactcagataattgctacacctataattacagtttattataaaaaatacagatgagaaacagccaaatgaagagacatacaggataaggttgggtggagggaccaagagcttccatgccctctccttgtaaaatctgggtgcatcttcccagcacatcaatgcatacaccacctggaaagctccaatgaaccttagtgtccataatttttattgaggtttcattacatagacaagattgattaaataattggccacatgattaaactcaatctctagtccttgccccttcttggagattaggctggtccaaagtttcaactctttaatcatgtggttggccttcctggtgaccagtcccctgaaataatctagcagctcagcatgagtgactttatcattaataataacaaagacaatactatcacttacgaaattccaagggcttcaaaagtttcaagccaagaactggggacaaataccatttatattctctattataccacaagtccctttcaggaattaggaaaatttattttttattcttgtgcaagcattaggcccctataaaataattatgatctaataaacaaacaaacaaacaaaaacactgggttctaactctgttctaacctttccaagctctagttctagtaatttacaagcactggtgttctcaccttcctgggctcagacttttcttctgtaatgactccttaaatgatattaggtgttgcttcaacttcctatcttccatcactcttggttttttttttctttgagcatggcttacattataattggatttagcccagatatcaggagtcactgggttcaaaccttatcttcatcatttgtaacctttgtgatcttgagccagttacttaacctcttggtgcctcagttttctcatttgtaaaaatgtgagaataatagtgcttccttcacagtattgctgagagaataagatgtaattatgcaggtaaagactttatcacttattctggcataagtatagtaaggactcaataaatgttctcaaaagtaatttataatgtatcaaaattttataggattttaagtcaaatctctccagtataaaagttgaatatatcaagggtctatagaacttcattcttgataaaaataccaggcatattaacaatgacctataatttaaacaatagccaggtgtgatggctcatgtccgtaatcccaacactttgggaggctgaggtgggcagatcacttgaggtcaggagttttgagaccagcctgaccaatatggctaaactctgtctctactgaaagtacaaaaattagctgggcatgatggtgtacacctgtaatcccagctcctcaggaggctgaggcatgagaatcacttgaacctgggaggcagagattgtagtgagctgcgactgcaccactgcactccaacctgggccaaaaagcgagactatctcaaaaaaaatttttactgtaaatacatatatacaaaattttcagtaggaaaataatgataatttgtcctgtagccaaatactgttaattcaggttacctaagtttctgtgaagaagaacatgttatggatgtttttgctgtcatgaaagtattacaaactgaattcagaatataacaaacttacttttgtatataggtcagaaaaggataacttggaaaatcccttatatgaacctttatatgaatagaaagaagatctgagctagtgactatccaattagtctagatgcacatgtgtacctacttaatgaaaccatctcatcaaagagtaaaaaaaaaagtagatttgtcttagaacaattctagttttatcgttatccagccatgagactttgacttctgtaacaaacaagttagaaataacagctaacataaaatatgtgacttgtgactaagtgagaaagattatactatatgatgctatccttaaaattcaattatttctttttttctatttgcttgactgtatgctataaatacaattaaaagtttgtcttaaaattcaattttttaaaaataaccaagagaacaagaatatggtagctttaatagaaatttcatttaaagcattccttttgctttttgaaattttgacctaaaacaaccagtgttcctattgtggcaggtacacaatttttaaatttttcttcacttgtgtctatgagatattaacagtatttataatatagaaataatcatcataaatataatatgaccaatatccagataattaataataattcctacacacattacatgtttatccagtacatataaggtacactatctttgtacttttatttcttcttatccacgtttcttagaatgtaatacatacaacacttggataaacatagcagtaatcctaataagcctaaacacaatatttttctgatgttgagataagttgatctatcaaggtaaaaatgatgaccacattcttactgttcattcattctttttttttttttttttttttttttcaagacagagtcttgctgtgtcgcccaggctggagtgcagtggcgcgatctcagcttactgcaagctccgcctcccgggttcatgccattctcctgcctcagcctcccgattagctgggactacaggaacccaccaccacgcccggctaattttttttgtatttttagtagagacggggtttcaccgtgttagccaggatggtctctatctcctgaccgcgtgatccgcccgctttggcctcccaaagtgctgggattacaggggtgagccaccgcgcccggccctcagtcattttttcttgtgttcattcagctaattcaaaatgagtgctccaccttcatgattttggacaaagcagaatattagttctgtgagaagttactgagcatagagattaccagttggtaggagagataagtagtatatttacacggctctaatcaaagatagaatgcattaaaagatgtaagtacaaagtgttgtaggaatttgaacatgaaggagacttagggggcttaagtgattagtaaagatatctcaattattgaatgactgacaagggagtttttaagtgacattctagaataatcctaactgttcctggacaagtgttttatcaattttttttttaagtttttaacgttttataacattaatacttgatcaacaaataaatatattgtcaatctctccaaatttaatggccaataaggaaagaaaatgcttaacagttagttatcattttgttcatataattatatatattcttctgcaagagatgctaattacttaaaagttatcttagcttgggcttctaaaacaaaatactacagactgggtgacttaaacaacattcatttctcacagttctgagggctaagaagtccaagatcaagatgtcagcagatttagttcttggtactggcctgcagacggttgacttctccctgtgccctccagatggcgaagaagaagagctcttgttcctttttttttttacaagggcattaattccaacatgaatgtgccaccctcattatttaatctaaccctaattacctcccgaaggccccacctccagtactctcccactggggattagggcttcaagatatgaattttggggtgacacaaacatttagtccatagcaaaggttaaggatcatttattcctcttcaacgtgctattctcttagtatggatatgaaataattttatgttaggggcctacggaagtgaaagctttattagcaacagccaccgacctgatttttcacttagaaaaactatacagttggtcttagaatttaattaaattacatttataacttaatgtaatttaattcaatcttagagtctacacaaagaagaaactgctcatcttccatagtcgtttctttattatttacttgctgactcattcattccactgtacatgcattgatgacttgatcttatgaatcagaaccttcaactgaagaaactgcttactcagaatggtagataatttgggagattttttaatttttattttcttggccatctaggagaatcaattatattaaataatactctggcagccataaaattatctgtagctcccaaagtagtcagcttaaggattgtttaaaagaaatgcaatctaaatattttcttattgtgtatatatttatgtgttaatatatacacaataatttcttaatttattaatttataagaaattaataaattttattaatttctttcctgctctcaagacttggaagattttaggtcaagttatagttatccaaagactatataaatcatatatatgctttggtatatatctatcatctctttctctatatatgcacatgtaaaacttacatcccttgtcactaattaaaagagaatttaatttttttaactttctattttgaaataactataaattcacaggaagttgcaaaaatatgagaggttctatgtattcttcagccggtttccttgactgattcattttgcgtaactaggtttctttaccaaaactaggaaattgacattggtaaaatgtgtttacatagttccgtgtcctttgatcacatgggtagattcctgtaaccactactaaacagacacagaaccattacattaccaccagtacctacctcatgctacccattcatagtcaaactcactcccacccacaccatctctaacacctgacaatcacaaatctatctaccctctctataatttggccatttttagaatgttatatataaatggaatcataaagcatgtgattttttattttggcttttctccactcggtataatgacagagagatccatccaagatgttccacatatcagtagtttgtttcttttattgcagagtggtagtcaatagtatgggcatatcatagtatccttaaccagtcacctattgaaggacagttttgttgtttccactttttgactattacaaataaaagttactgtgaacatttatgtgcaggtttttgtgaagatgtaaattttcatttatctggcataaatgctttatgaaccagcaatcatgtgattgctgtaacatatgcaatgtatggcttttgtaacaagttagaaataagagctaacataaaataagtcactaaatgagaaagaatactatattatactatacttaaaatgtcaattatgtctattttttctatttgcttgactatatgttataaatacaattaaaagtttatcttaacttttaattgtcttaacttttggttgctgcttcatatgataagttcatggtgcattttctaagaaactgccacacagttttccagcatgcatgtacaattttacactcccttcagcaatgcataaaaggtctagtttctctacatccttgccagcgttcttccccctacctgttctaataggtatgtagtactctctcctcaatagtcttaatttgtgtttccctaataactagtgatgttgcacagtttttttttcgtgtgtttaatttaccatccaaatatactcttcagtgagatatctctttatgtcctttgcccattttctagttggaccatttgtatttttactgttgagtttcaagagttctttttggatactagatatcggacctttgtcatatatatggtttgcaaatattttctctcagtctgtgtgttttctcctcatcttttaatagggtctttcacagagcaaaaattttacattttgataaagtttaatttatagatttttttcttttacagatcatgcttttgctgtcatgtctaagaacttttcacaagctctataccttgatacttttcttctacattttctactaaaaatttcatagttttatattttatacttaaatctacaatctatttgagttcacttttgtataggatgtgaagttgaggttgagatgatttatttatttactttatctatggatagccaactgctatagcaacatttgttgaaaaggttatccttactctattgaattgcttttgtacttctgtcaagaaatcggttggccatacatgtatggatctacttttgggttcactattacgatgtattgatcttgtgtcagcccctctgtcaataccacagagttttgattgatgttgctatataataagatttaaaatcaagtagagtgattcttcccactttattcttctctttcatcattgtctattctagttcctttgtcatagaaattttggaataacgttttctgtagctacaaataatcttgccagaatttttattggaattgtgttaaacttctatgtcatttagaaggaaattgatatccttattatgtcgattcttttaatctatgagcacagtatgcttcttctgtttttagatattctttgattttttttcattggtgttttatagttttcagcacagaagtcctgtatatattttattaggcttatacttaatgatgtcatttttgaggtgatcataaatgagattatatttcaacttttggggtccacatgttcatttatagcatgcagaataaaattgatttttttgttactcttgtatcttgtgactgctgaactcactcatcctaggaaaattttggagattccttggaattttctatacaccatcatctcctctcaaataaggacagtcttatttcttccttttttttttttttcttttttgagacggagtctcgctctgttgcccaggctggagtgcagtggtgtgatctcagctcactgcaacctccgcctcccgggttcaagcgattcttatgcctcagccttccgagtagctgggattacaggcgcacaccaccacacccagtgagtttttatatttttagtagagacggggtttcacctagaactcctgacctcaggtgatccacccaccccggcctcccaaagtactggaattacaggcatgaaccaccgtgcccagcctatttcttccttattgatctgtatgctttttattgcacatgccatgagtggtgagagcggacatccttaccttatttcagtcttaggaaaaactgttcagtctttcaccattaagcatgatgttagctgtaggttttttttataggtatactgtattaagttgaagttctcctctatattcagttttttgagtttttaaaaaatattatgaatagatgtcgaattttgtcaaattcttttcctgcatcgatacaatttttttttctttagcctattaacatggtgattacactgattggtaaatcagttctattaaaaagaacattttaaatagttattcaattcattattagaaattagtcattcttacataataaccatttaatgtagtgatcaaataaattgttgaatgtataggaaaaaatttaaaaagatatttaaagctatggaatctgatatagtgttgatatgattattcattattaaaaattagtcattcttgcataataaacaaccatttaatctggtgatcaaataaattgttgaatatataggaaaaaaatttaaaaatatatttaaagctaaggaatctgatatagtgttgatatgagagaagaaaggaaaggaaatgagagaagagaagaggggaaaggggaggggaggggaggagcaggaaaggaaggaaggaaagaaagaaggaagaaaggaaagaaggaagggagaaagggaggaagggaggaagccccttaggaattcatggtagtacacagttaagttgatttagtttctattcagctacctgtctccctgttattccttcgtttgtttgttttctgctaccacctcccacttcctttttctttgtaaagctgggtgttccctcccttgagaattcccacaggattcagatgcaggagacaagtgaccatctgcttacttagtggtgacacatgaaatcgtgtggtgtgcaggtagaaccatcctgttaaaaaatctaggagtctccaattcagcagtctgttaaatagacaagagtagagtaaaagcaagatgaacaatgagggtgaaatagtataatcacgtaaacctatgcatggtggaaaacagacatttaaaacccataagagaaagtttcgaaaggcaccatggcaatatattgcttttatagaaagatgctatgagttggtggcagaagtgaccaactgggagggctttctcactccatcagtttttaccaaatggaagaaataagacagtgcccactgagattgatcaggaaagccagctgcactgtgcatcatttgacctgcactatataaactcttctgcaggcaaacgttgcctccctccagcactgacctgcctgacatgctcagattgtattgctgcaagaggtagggaaagaaatttggacccacagactcatttggagcaactaaagctcaaatttagtgtaatataaataaatactatagaaatggaaggcaagatgaattatcattattatccagtatttttatagcactttatattttgcaaacggcttcacgatcccatataatgaatctgtggggggctagcggatgcatatgttacaagctacaaggaatagcagttagcacatccattcattatgttttgcttacgtttttattgtctgatttgtttacatgagctatccactcttcctttctttatactgatttttggaaactttgggtaattaataaataattataatagatacatttagatgtatttggatttaaatttccagatgtgagcctgactttatgtgaatatacggctgcatagaatgcaagcatgagaactgagttaaactaagaatatttgtattcttcataaaacaaccaacatggacttcatgattgtgcttcttattctttaaagattttccgcctttcttactcttgctgcattcctccatcccccttcctacttagttaagcactggatgccctgcagcagtgtattttaaaggccttgtgtgtattggccatctgtccagtttactacaaagtagctcctcttcgaagattcctgccctattgttcctgtgaactcacctgtgtttgtcagtacctgtgctttggctttttgtatagacccaggtatgcccctctgtccttccctctgtaaatattgtctagtttattaagcacctagtgttggagaaatggtttcccatggttctgttactctggttcttattgactatctttccataaaccagatcaaagtcttaatcctcacaggagtggaattcaaaactttctagggatttatttaataccaaattgatggctgatttgtgagtaatgtgaatggtctctcaaatctaccttttgatcagagctttacaagcctgtatataggcacgttatctcctccttttccaatgagataatagatagcttagagccagcacatagtaggcccttaatcactctgtgctcaccaatgaagggagcccctactgggatccttctatgaagtggaggttgtgaaagcattaccctcaaggttaaaacctagtgtagacaatgtgacatataattgtgtgacctcaaaaatacatttgatccaattctagtagctgcagaacaggaaaaaagagaagtctaaagtgagtcatgagagaaaagttcaaaatcccaaagtttaatttgttcacagctgttttactgtcaaaggcagaaagaacttcaacagtgcatttgttggaaagaatcacattttactctgattaagaatatgctgagacttgctttttaggtcaactttataattgtaccacacattagtttttaaataactggaaaaatgttctgtacttttaaattattctttggggcggggcgggggtcagaaatttaaggcagatgttttaaattaaagttagtgttttatagtgaatatagttatatttctgaatattgaaagatctatgtaaagatggtgtaataaggaaagaaaaaatcttgttcttcgttcagtaagccacaaacttggagcctctctatccaaacttcaaaatcctaagcctttttaataaaaatattggaagaggccaggcatggtggctcacacctgtaatcccagccctttgggaggccaaggcgggtggatcacgaggtctggagattgagatcatcctggctaacaggatgaaaccctgtactaaaaatacagaaaattagccgggcatggtggcatgtgcctgtaatcccaggtacttaggaggctgaggcaggagaatcgcttgaacccaagaggcagaggttgcagtgagccgagatcgcaccactgcactccagcctgggcgacagagcgaggctctgtctcaaaaaaaaaaaaaattggaagaaaaatattgtttgtaatcagaaagatcactaatcttatgctaatttttaattatatcaaaagagtttttaaatttgatttgataaattacatttctttaaaaaagagaaaattgattacataattaaaaatttaacctgattgcagttaaaggaagacaaaatggtctaaaattatatctactaggaaaagcagttgaatatatttctcttacctttagcttattctaagatgaaggaaaataaggagaagtaattgaaatgtcagattccagagtgattgttcatttcaagtggacaaaaacctttacttgctttaaacttaagagggaactactcaagtaatagagatataggaatgtaagatgatgactgacatgtagccaaaggtggaggcagaagagaacagagagggattattattattttttaaatttcagccatctctggaacagagtattcatcttcccactcttgaacattttccagcttgggccaactgtgtgtatccagtgaggtcttgtttaagacattcagaagaaaattaagttatggaagtttccaatctcctttttttcagtaatttttccccccactagtatccttccaaaagcctctaccatgctctgggctttctgctattaatatcatctaccagaaaaataaggtgacactttttgtggagaattaacattttgatagagacatttaaaaaatgttcacatattgttaaaataacattgacacatctttttaaagaaaagaaatcaaaatcatccatattctcagtatcaaaattcaactgttgtcctttctttctggcccttattgttatagtgttatctgagcaaagaagtaattgtgagatctaattttttgtttttaatagatagggtcttactctgttgcccaggctggggagtatggtggtgcaatcatagctcactgcagtctataactcttagtctcaatcaatcctcctgcctcagcctcccaagtagctgggactcaggcacctgccaccatgcctggctattttttttttttatttcttagtttctgtagagaaggtgtcttgctatgttgcccaggctggcatcaaactcctgggttcaaacaatcctccagcctccacctcccagtgtgctgacatgagccaccatgcccagcctgaggtttatttttgaatatagcattattatgtaaatgcctcccatgttgtcccatccttcataactttcctgttttgtcttgacacactaatccatccatttaatgtctataatctattaacagtttccttgtttggagacatttaacaacttgtttaaatttttttaaaattactgatttttttttttttttgagagggagtctcactctgttgcccaggctggagtgcagtggcatgatctcggctcactgtaacctccgcctctttggttcaagtgattctcctgccacagcctcctgggtagctgggactacaagcacgtgccaccatgcccggctaatttttgtatttttagtagagacagggtttcaccatcttggccaggctggtctcaaactcctgaccttgtgatccgcctgccttagcctcccaaagtgctgggattacaggcgtgagccaccgtgcccggccccaaaaattactgattttatcagaaatagtttctactcattttttttcttctgaattatttaattgtaataaattctcttgggagaatcaaagcatgatgaatattattcatttttaccattttattttcttcagtggtatcaatttgcagaactactaggtgttcactgacataagtatctttaaatgaacaaattttcaaacaccttcacagcaagcccaaagagctgatgtactcttcaaagatttctaccaagaaaaaacaaattcaggatcttctaagtatagaagggttttacatttttttttctaattctatcttctcctatgaaagccctgattataaaattataaaagcaaagatttttttgtttgctttgttttttttaaacaatatatattgtggacctgaggaatctgacattcccttatgtccacgaagaaattatgtcatttatttgttactctgattcttctgcattaaaaataccacatgtatacgttagaagcaatttcagtattttttgtcataattgcaatgagaagataaatacctttttaaactatattttatatatttttttcaattttagaggtctcacagtttttctaaaatgtcctattagaagtgaagggatcactttggtcctcatttgtttccacagcattttttcaacctaaggttttctttcagccagaggaccataaaacacatttctcaaaatatattgtagggaacactactagtatcttgagatgaaattgtcatatggaaaagaaaaagatccaatggaactataaaatgcattcataaactcattggttctgaaaatgtggttgctggaccatcagaatccatatcccttgggaacttcttaggaatgcagactctcaggcccacccccgcctactgagtaagaacactaaggaggcagagccatcaattggtgttctttaacaaccctccaggtagttatgcttttctaagtaatttgtaatgccattatcttaaaaaagtttctgagaagttccttaggggagagaaaaaacactacaacacgacaaaaacctctaaaccttgtttgcccaaaaagttgaccaaagaatatctattttctcttctaccaatcacaaacttttttttttttttttttgagacagggtctcgctctgttacccaggctggagtgcagtggcatgatcttggctcagtgcaacctctgcctcccaggttcacaagattatcctgccttagcctccggagtagctgggattacaggagcgcaccaccatgccctgactagtttttgtatttttagtagagacagggtttccccatgttggccaggctggtccctaactcctgacctcaagtgatccaccctccttgtcctcccaaaatgctgggattacaggcgtgagccaccacgcccggcccaatcacaaactttttttttaatagagatacagtctttgtgtctaggctcaagcggcagttgctagtttcaacctgagttgttaatacatttaacgtgggttcattagtgtttgatatatttcttgtggctagaccatgggaagaactgctgtccttttggtagcgggatacgtcattgcctgatgagttgattaatctttgttattctgcaatacctgtttgtcatgcatatcttagtatatgtgaatagagtatatgtctggtatgaattgtgccattataatggttcctgataggagagattctattttcatttgctaggtatttgagataacatatttactcactagagaggagtaaaaattaagtattaatatttaatgaacggatactaagtgagaaaaaaattagagcctttggactaaatatttattatcttacaagagcaaatagctatgttataaaatgagaatatgcaaataataaaatggaaaattgaaagtaattatctttacatgtgctgtaaagttgctagttgaatttattgcctattctttttaccagttcaaaggttagtgggaaaataccgttttgacagcagacttctgacagcttaataataatgatcaagctttgtgcattttatttaaacatctatagtcaacatgctctattagtagctctccttgtatcttttgcaaaaataagattttagggaaaaatgttatgttttatctcaacaaaaaagtctagtgtatgttttatatttgcatctcttaccctgtatgtttaaattacaaagaaattccttagttcaaatgagcatgaagttgtttggcaaactgagattacatagctacaaaacccttggtagatggtatctataaatagaagtgtctaacgtggaaagtgctctgaacaatataaacgggacttttgcaaaaagaagtggagaggaggaaagcctacagcgttgatttaaaagactgtaattagaattaggttccgataattagatcccagtagactgagttctttttcctcaaacaaacaaatcataaatgagtataggatgtcatttctacaggaatgaaaatagaaatggaattttaaataaagattgtgaagcaaaatgtggcattttaattcttgcacctggaatcatttcataatgaaatgcaaattaattctaaaaatctctgacctctgttttgctgattgcagcctaaaatcactcatctggttttgagaaaaagagaaaatgcatgccaagatgaaactatttagtatataccttggaattttataatgaacttagatgactgactgtggctaaataagtttacatttccatttttaagaaagatcggaaaccaagaatggaatacttggtataaattggggatgaagccactgtgattatctgaagtcattcattggcttaaaattttgttcatccttcactagtgagttcttatgggatgtgtgcttattgtatactctttagttctaaatttgcaagagaagtaaaactggaatctactttttagttttgaaaaatgtaagtctgagcttcattaactagcacttataaaaaagaagacacactccaattgacattttcacattgatgtttaatttaaataagaaccaatatttctatggtggtgagctgattgagaggtaaaagacctttaaatctccttctgaagcttactgcccaataatattttattttctatatcattttattgaccaatgttgtcatcagtttatctaacagaaaaataaaaattgcaatgtcattaaaaatatataccaccaaaaaaatacggttgatgcagttgaagaagtaaatggcaaattcacagatattcataaaacagctattgtataagactgagactagaatgaaaattttgtatctaatgaaaataagatgtcttcttctttatttatactcacatcccctttctaaaaggaatctgaagctctttacaataagaccacctagatttttttaactatgaatagagatgaaaaatcagaacacaggcaaaaagaaggaaaaaagcataaggtagggtggtaaccaagagactcaatgtaatttattataatttttatagttagtctctgagcttcctgggggcaaaagaaaatgaaacctgtatgtccatattgtcttaagttttaactgtaaatacagtgaggtttttgttagacttaatagtgtgcatatagacacacattcagtacatgttttctgatgccttccatccacaggttacctggttcaattgtcaatgcctaagtcatctttaaaattgctcagtgcttttataatattcataagtcactgaaaatagaacaaaacaaacaaaacactggcactttttcttcattttatttcactgttgaacttgataatgttggaaacctgagcagaataagatagtttgatgattggctgggctcttcatcacggcttgcctttcagtataagatattaaaatagtggttttcaaatcttatagccctagtatcatcttagaggtttcagagacaatttccaaagtaagtgggaagccagtttacccagaacaatttactcataactgctttatccagaataagttaacttttctctactttacaatgttagattgtattttgatttgctttgaaacaaagttctgctgaaagcagtttaataatcacttaaactggtggtgagtaaagaccaccaacagtgctatagtaaaaggaactgatagatgaccctcgggggtgaggtttgtgaaacctctaacaagggaatcctaactatggatggatagtttttataatgttagcaaccctctaaaattgtaagaaaatgctacatattttacaggcaattaatctagggggatagccaagagttttcttcggttcttgtattatcattaaattttagaaatggataaatattttttaaaaagcacctagaatggatttattgaatagttaataaaagaaataaaacattataggaaacattgaaatcccttttttaaaaccctccagacatatttctgttgttctcttctcaaacacaactactctttttaatttggtatgtataattcctgttttttacgctttcactacatatgtagatcctgccattaaaatacatgttgtgttaattgagtgtttatgaaaattttcataaatattttaccacaaatgtcattaaccatcttgtttcatcacattttattttattttttgtgtgaacacgtatagtttctagttcatttaattgcctgatgcagttctatattatgaatatgtcacatttaatcaattcatttcatctctatggaaaaatactaaagtactttccactcactcactaggtcaagtagcataacagggaacatctttgcacacatttttaagagttggactagactggaatgtaactaaaagtgtacttgaggctcacagagtatgcacatctccaaattgtgtttgtaaaatccaagttatcatccagaatagctgtacctgtttacattctcctcagcattgtatgaaggttcagggtttttggcatccaacagtggtactgtatattcagactttaatttttacagttgaatgggtataaaagagcatctcactgctgctttcaagtgcatttcccttatttctagtaagatatcttctcacttaatgtccattgggtttctttctgtgaattgcctttgtgttcattgctcatttttttccctagtaggttaacatctttttctagatgccatgtaggagttccttacatatttggtataataattatgtgttgccaaaatacatttattcccagtctggagctgctcttttaactttgtccatggagacagattttaaaattatgttttaaattttattgtggaaaaaatgtgcagatcttcttctttatggtttctgccattcatgtcttcacaaatccctcccaggctggatgcgataatgcatgtctgtaatcccagtcctttgggaggtgaaggtgggagaattacttgaggccaggagtcagagaacagcctgggcaacaaagcatgaccccatctctacaaaaaattaaaaaattagccatatgtggtgatgcatgcctatagtcccaattgcttgggaggttggggcagaaggattgcttgagacccagagattgaggctgcagtgagctgtgatcatgtgatcacaccactgcactccagcctgggccacaggagaaaaccctaaaaaaaaatccttttctataacaattttataaaattatcctgtcaatcctataccttcttttaaaaaggttaaaatgtttctatacctacttaggctatcaacctcacctggccagaattctgtgataggccatgtttctataaatgtacaacgctatttctgtgacctctttttgttgcattgatttaactctactccagatttaaattttcagtgactgtagttttataaccttgatgtctggaagggcaaaaccccatatatcttatttattatcttcaaaactgatttaaatattcttgagattttctcttctaggtgaattatagaattattttccttttttgttttttcttttcctttttagagacagggtgctgttctctcacccaggctgaaaggcagtggcaccatcatagctcactgcatcctggaactcctgggctccagcaatctgccagcctcagcttcccaagtagcttggactacaggcatgtcactgcacttagttagtatttttatttttagtagcaatggggtctcactttgttgcccaggatggtctcagactcctggcttcaagtgatcctcctaccttggcctctcaaagtgctgagattacagacatgagccactgcacccagctttttttgggcacttttcaagaagaaactttctggatttttattgaaatgtcattgaatttatagattaattttatgataattgttactttttgaacttgagtcctccaatccacaaacattgtatatttatgtgtattttgacattttttgtaaatatttgcagtacttttccttgtaccttttgacattttcatcttttacatgcatgtgttgtaacttcattttgccacgtctgaattttttcatttgtcttattttgatgttcattcttttgttgatttgtttattgtttgtttgttttccctctaatatgagaattcatgtcttttgtcaactctggaaaatgctcagtcattgttgcctttatctcattctctattctcattatttttgaaactcatggaagactcttgatatgcataaaatcttgcaaaagcttcagagggaaatatatgtataatttctatatatatatgcacacattatatatagatatacgcacatacacacatataagtgattttatcatatatataatcacatatgattataatacaatcccttatatataatcacatatatacacatatatgtatatatacatatgtaattacacttacatacatatataatcacttatatgattacgtatatcactgatatgtatatataatcacttatatgtgtgtatgtgtatatatagtcttatggtcgccaaattctcttttctatttttcaactacaccaagcccactttcgaccacaataatgctatttatatctttacatgtttaccttccacataagattcatttgaagaagagaacacagctttccttggtgccagctttccctgagtctatgtatttttttgttatacagttgtgttttaagattgtacagacagttgatataactgatctttggaaactctattctgaaagaatagagtgccactattcctgagcaagaaagagatgttttcaatttcatttcctgaaccttcccactctcccgttacacttaacttaaacaaatgtacgtacatcattgcatttataactatcagagatacaagtcagagaactggccaggatgttcattaatcatgtttgctggtagtaataaagggaaaatccttaaaagctatgttgtttgccttgtgggtgttagtcacataaaattcatggctttgccctaaactagtgcgcagtaaagaccagacaattgcttatcatgaggatggattgctttggcattagtgcttcctgacttaaaagaggggcttatttgttcagaaaatgggccggcattggatgagctttcattatttcctgcctctacttgtgtactcttgcattttgcaaaatattgccagtcttctgttattcaagtaaatgtttcaactgtctatataaatcatttctcttgatgcaaccaaattatttaactcagaaagtccatccatcaggtgcttcacaatttatcattattttaaagtaattggtctactcagtagcataacacttactgacataataaagtcatgtggattatagataaactcgtgagatacctggaacttggaactatcattcctatatagggccaaataatccactattgatttggaacaacaaggtgaagaaaattaagcctccccaattccagctagtattttaattgaaagagctccaagaaagactcaggtgctgtaattgtgcggtaatttggtatggcagcttctaattatgaagcacgaataagaacaaccttgggaaaaatctcggtatgccaagattcacccattgcagaagcagaatctgagccaaatggtaatttgtgaggttattaaaatgactattaaaggcttggatcagataccgctcaacttctgaactttgagttaactagaagttgatcagagttagctttctggagcttttcatttgtttctgtattttgttaaaagaaaaaaaatctgacttgcatgcttattgcatgttaagtactgtgctgggcattttatacattttagctcatttaattaaattatcataatgctatgatagttttagcatctaaactagcctaaaaagggctagttttaggccctttttacaaataataaaattgtgtttcagggaggtgagcaaatttctcaaggttatccagctaatcactattcaaaaccaggtctgtcttttcccaacgcctgtttacttccctctacaacaacagtaatgatgaatgaatgcatcgacatatgttcatctcaaggctatctcagtgctccttaagcattatctagtttgactgggaacttttttgaggccatgtggtccatgtttaccaaatgattcaggcatatctagccatccttgagaacttgtcagagcaggttaagaggttaagagacaggcaatattgttaatacttgttattaatacttgcttcagtattctccactttgtatttgtggcaattttggattggtaggtaatgaatagaagatagagttacggaatattagataattttataactctttggatgcttaagagcctagaaaagtatataaatatcagcagtgcaaggagaaggaagcaggttggatacagagagaacttggaccctttgattgctcagcaggtggttggatatcctgagatggggaagaaggacagacctcaatatctctgcattgactaactgggtcaatacagagctgcctaaagttgtatttaccgctggaaaataaaagtgaagaaatagtaatcaaaacagatttttatatgccttattgctaaaagtgagtattatagataatgccactaatttcagtaaaggcagtcttattccatattattaccttactcctaccactgggactgtgagaaaacactaaaccactagcattgtctaatttgctactacaaaaattacttctaacagaaagtgagagattaggggattataaaatgttaatgctggataagacttttgaaaccactcctgttttacggatgaagaaactaaactagagaaatgaattagctagttcaaagtcagacaactagttacccataagactaagacaaaaattcaaatgatctgacttccaactcagtgatatacccacaatatcatgccaacttctagttttattttaatgttctattcttattttttatttatttattttaagacagagtctcactctgtcgcccaggctggagtgcagtggcgcaatcttggctcactgcaagctccgcctcctgggttcacatcattctcctgcctcagcctcctgagtagctgggactacaggcacctgccaccatgcctggctaattttttgtatttttagtagagatggggtttcaccgtgttagccaggatggtctcgatctcctgacctcgtgatccgcccgcttcggcctcccaaagtgcagggattacaggcataagccaccacgtcaggcctctattcttatttttaatgttaatttctttaagtgtattacatttgaacaatgtaaaactcatttctattagaaaacagttagatttctagagtctcttcctactcactggtctccacaggggaaaaaaaggaagactgtgataaaaagaaaaagagaaaagagaaggaataaaaaggacaagaaaaaagattattttgcttcatttttagctatttatcctcagataaaattgagaactgaaatctgaaaaccgttaaactcatgacttacttttattatggaggaattagtttttccttttattatggaggaattagtatttctcatttatctttcagctctcaagtactccctgtgtgaattcgaacatttattccacttaaaaaattcacaagaaatgcccaaagtctaacatgtttccagattgggaatattttcactaatacagtactttgtcctcctgggtaagaaagaagctctctgattactggtctgaaacttagagaataagacaatgcttttcatgtaattgattcatatacatgggaacgaatgcctttgcaaagcagttatttctatgcctgacctacagagagtctgtagtgagccacgcatgtggtatcattagtcactgatgatgacaacgagaacaggaagattggagtggcaggataatcattctcagcaaactaacacaggaacagaaaaccaaacactgcacgttctcacttataagtgggagttgaacaatgagaacacatggacacagggagggaaacatcacacactggggcctgtcggtgggtgggggcctgagggaggtatagcattaggagaaacatctaattagatgatgggttaatgggtgcagcaaaccaccatggcacgtgtatacctatgtaacaaacctgcacgttctgcatatgtatcccagaacttaagctataagaaaaaaataaaagaagagagagagagagagagaaaggaacccaaagtcctagaaaaaagcatggggccagggggattcgttttcaaccttggtatgagaaaggctttctaactataactcaaaatccagaagcaataaaattgaaaaaaaaaaaaaaaaaggaaagaaagaaggaaagatgggtggtagagagacccagtagagggcagcatcagtaatccaggcatgaggagatgatactgtgctggaatggtgggggaagagaaaggtaggggcacatgctggagaaactttaaaggaaaaattgagatgtatgagtgattgaatgtattggagttaagatactgacgattataataatgtatcttgcatttatatgttatgttatgcatttatttgtgctccaataaagtctatcatatcattgatcaaaattactatatagtcttcctttgttttgagaggataatttatttcaggaagaagaaataaactgcacaaggaaagttcttctaagtcaatagcttatttaccaccaagattaatgacacacaatcactttaacagttaaaaagtatatgtgatttttatatatgtgaaactttagtgcaaatcaaactcaaacagaatagtaaaaacataagaattttttttcaaccttaactgatgcataagattatctggactataaactggaagactaccagtactcagaggagagaattcagtgcaacgcatgccagatttcataaaactgcaaagatgactgcatggtgactctcgtttcatggtgcttagctgccactgaggcatgtgaattctaaattggtcttcataaatgtgaaggaatgcctggaagtcaaaggaaagcattaaaggaaaccccttatacatgtttaattctcataatctgattggttatatcaagaggtatgactatatataaatgtattacaaatagttattgaaacacattgttacaatagttattattggttatatcaagaggtatgactatatatgaatgtgttacaaataagctatagttgctataatgtttataaattacacaacacctaaagtttaggaagtggatagcatcttctcatgagatggatagcatctttatatatctctgacttttccactgggcttcaaatgcatattaaaggacattctataaaattaccagtattccatcatttttggtctacaaaaatgtcagtttcacatagtttgacctaatatttgccactctcaacttgtcatttccacttggcatagtcttggcattacgtaggcatatgaaaatccagggtttgttttttttttccaccgaaacctgttccaaccacaggtggtccacagctgtccacatttcagcaaatgatgtgatacgatcattcactggatggctcacgtttcaaacctgggcataactctcacttcttttctccccaaactcacattcaattcatttgcaattgcttttctcttcacctggaaaatgtatgtctaatttgtctactcctctctgtctccaccattagcatcctagtttgtcattattttttattgaatttatgtaagagagtcctagctagtcacttagctttccactcttgccttcctctaactcaatctctaaacaagcacatgaagaatatttaagaatgtacattagattatgtcactcccatgctttaaacactccaagggcatcccatgacacatagaataaagtccaaactacatataatagttacaaggctctgcgtattgtgaacctaactttctgatttcttctcctactccaggattcaccatactcaaagtaaattggaaaacagatcttgggtctcttgggtcctcttgggtcctgttgttcccttttcctgaaagctcctctttatctttacataattggctccttcctgtaaatcaggtctcagcttgaatgacatatctttagagagatcttctctgacaacatattctaaatagccacccccatctgtcattctttatcataccatcatttaaaaaaaccctcagcacagcacttatcacaatctgagtgatagatgtcttattcatctatttttgtagcaggatgttagaatgaaagttttagttgggaaatattattttacaaagtgaacaagaggaaagaagctttcaaagtaggactagggagtcatgtggttgactgtaaaaattcctcatccacaaagaggaaataaaagaatcagaaaaatgaagattaggaaataacttagggaaagttttttttttttcaggtaaccattggagttccattatttaacaaattgaatgatataaacttataattaatgttatattaaaacaaagataataaatatgcaaaacgaatcacttcttaattatgttgttatgttttgttattatctatgctcttcaggtaacctaagtcaactggtaggaatactacatacacagtgatgtattacttgctgcatatcttcccaactctgtttttgataacattatattgtgcacgaaattagccatgatggaactgtttacaccaagaaattagcaaacaatatagattaaggttttattgtttgttaataatttcaacttcaaaaattgagaaaatattaataatgcagactaaacttagtgttgtgtcagtagctataacattgtgaatagcacaaaaatcaaagaaatattctagtattctaaagctagctaatataataaaaactcagtcacatcactgagaacaagtaaattcttgatacactttttcactctttcactttcatattactcattactgtaaatgaaaatacagaccaatacccacgttggaattatacatgtttatcagttccaactatagattgactacaggtacaaaaggttgacaagcataaatgtacttctataagaattaattaactatgtggaatttgcagtaaagagtattatatattttattattgactatgagttgtatgctatacctctttttattagcaaaatttataataaacttcatacatgtgtgtatccattatttttagagagctctttgttaaacatttaccagcacagcgctgtgatagacccactatctagccaagaggaggcaggttacttcttttttcaccttaaatcaagaaagggacactttactaaggccaccgagagagcacagactatatcccccacaactgggggaggggatactgtgaattggtgtcttacttcactttaaaaatctaggccaggcacagtggctcatgcttgtaatcccagcactttgggaggccgaggtgggtggatcacttgagtcccatctctacaaaaaaaaatacaaaaattagctgagtgtgatggcaagcgtctgtaataccatctacttgggaggctgaggtgggaggattgactgagccagggatgttgaggctgcagtgagccatgattgcgccactgaactccagcctgggtgacagaaggagaccctgtctcaaaaagactaaaaacaaaaaatctaaaaggtgacagatagccttgtctggctgttctaagaagaaaggctttagtgacttaccagcgtgggaagtggtgttggggcaaagtttgtgttagtgtttcctgtggaccagagatgagcctcacatgagacagattaggcacagggtgaatttagatcctctaaaaggaggctgcccagatgagtaaaatggatgtgtataaaggagctacaaatgactcctggatttctagagaagaaaagaaggtggcatcagtattactaaagggaattccaggtgacaaatccctagctgggaagggggaatctctgaagaagctttaatatgctaaaaagagaagggggcagctttgaaccgctgaaagaggagagtgtactgccagcttgtgacagtactactagtcacaataggactttgctgctccatttcctcgtgtctgttagcggattcacaagttgacgagcaggaggagaagtataaattgagaaaaaaagattaaaaacagcacttctcgccactccctcattccctagcagctgctttccacctacaacaggcctggcaatgaaaggctcctcaacttttcataacgttcactttttgaccattaaataaaactggatatcccaggagcagaggaagacccagctcccatccaataaactgaaggagatactaagagacaaaaatatgattgccttatgattaaactctacaaatcatgcttctttaatgaaagaattatatttattttccccttaaaattgaaaaatttaagaaagcagggcttcagtacataggagacacccagtaaatattaattgtatgaataaacgtagacaggaatgaatgattgctcattggttcttcctttggcacttgatgaagcagactcagagaagctgtatatataaattgcttttaatataaatattcttttggtaggaaaaggagaaagaatgagaaaattcaattctgaatgattaggagaaagacagaaatgggtggatctgaagaaagaaccactttcatgtgggaaaccaattcatatgatttctcatcagtggcatggaggaataattgttagacacttacacatccctgaaatgtgtcgtcagtaattaggacaggccctagattctagaggagggagacagaaatttggccaagaaatgaaggggttgaaaagttttctgagactgagggaaaagaagaaaggagaaacataaattcaggtatatactgcaaatatgtaagagcaaagaagacttcaggtgaactctagatttttattttcatgtgctcctctccttcaaattcagaagaaaaggacaaagctaaaactatatgaaatccttcgtctaaaatgacgaatctgaaaattccagaaggtaggagcttagtttcaatgagatgaagaaaaagcttctcattcatgaaatacattttaataagttgaaatttgaacaccaggtgtatgaaaagaactagaatttaaccatatgtgttcagaaatatttagcccacatattttccagaataatccccaaacatgtttaaggatataattggtaagtaagaaatttgaaatccctatcagagtttgccagagttgtctaagatgcattgagtactttcagtaaaccagatgctgcattttcaatccttacagcactgagaagatactgttctagttgaagttgcatgactcaagtgggtcaaagcttgcccaagttccctgagttaagaagtagaatttcaaacacaggttgaactaaccttagagtagggttttcataacaacattcgcttcccagtaggagttttaattttaacatgatgttccttttggatttaatgttattaagggacatagtggatgaggctgactataatttgctggctttcatataagcatcaaacaattgcatttccttctccctatcatttttagtcctttatgtgcagccttgcagcattgatctccaggaaagcttgtgttttctggtgcacttcccagaaacaaaatatgatatgtgttcccttttgaaaacaattgataagtttcatgttgacagaaacatttcattttccaagtcatttatctatttgtcataagaggaattataatagtatattggcttccataatccaaatccattccctttagtgtatttttttaattaatacttctctacttaaattctgatctaaaaaagtggccattaattaactcagggagcaattcagctatttttttttctaggaaatgggaaatctggtaaatggtttgtacttctactttgtcaaaaacatgtatttttccaaactgtatgagaactttaataacactccataaatttcatgcttttagtcacacttggaatggaggctttgggaactctataaccttcttaatgacatgttggcttggcctcagcactgtagcttcaacttggttcttaatggacattaacccatagtgcataggcttcaggtaacacagttggtgatttgtattttttttctggaaaggtccaagacagatccaatattatttccttttaagaatttatccctttttgagacagagtctcactctgtcacccaagcttgagtgcagtggtgcaatcttggctcactgcaacctcccccactccccaggttcaagggatcctcccacctcagcctcctgagtagttgggaccacaggtatgcaccaccatccctggctaattagttttgtatttttagtagagtcggggtctcaccatgttgcccaggctgaattaaaaatatttctcatgaactacatgaaacctcgtaagtgtgaaggcttcttgaggacaaaggttgtatcgtgcaaacctttacatatcctaaggcactaattctttgcccattcttgtaaccaataaacatttattcagctcctactatatgccgggtgttatattaacggctgggtcagggcacatacttatgaaaatagtgtatttatatatactatctttcaaataataaccagtacatttttacaattaaaatataaaataaaattattttggcttgtatgtgtgtctttcctagaaaagatttgctaacagtaaaataaactttatagaactatcattcactcttagttgcatcttggcaaatagtcaagggcccttccaaaactttgcctgtatacactttggattttaattagacacaataagacccccctccttaatctggctctgcttcttgacaagtcatcatgaaggtgtgataatatcacacaggaaattatcaaactgctaaaccaagtacagaggagacaaataaaatgttgatgcaacagctgcagagactgtcctgaaggttctgtaatcaatggtgtcttgagagtcgtatctgaggtagagtctttccaaatgcacacagtgggtggggcagtggtatctgaagtggagaaggagggcagagaacatggtatctacacatggcagattcaagttcatgcaagcaccctgaagacagagaatttgtcttgaataattttaaatttagcaagatggaactttaacctcataaagaatggaactcggtgagttttggaacaaaatgactgtttttggactcaaatcatagaaagcattctcctgcaaatgtaatatatccatttgtctttagcaggaaataaatgaatttatttcaagatggtgtcccagagaaggcctgaggcacaatcatatttaaactgtatgaatactgagtgacatgattgcatccagtgtggtctggattatttgagcaaaccatggggacatacttacctgtttatttccctacatctgtttatttccctacgtgttcttgacgttagtgtcgaaggattaccctgagacctgtctcagtgtcctcttgagaatggatatacacattgacataaattattaacttctccctagataggtccattaattttctgtgaattgttatggctttattagtttcccatcagttattcttggtctctttccattaaagagaaatccactcttacttaaatttgtgtcttgcactaaagttaaattcagccaacttcgttctgaatctatttaatcctaaaattatttatttaagtaaactttcatgtatcctcaggagcctcttttcctgaaaagaccaaagagaaactttccttaattaggcataaaataacagttctaagacttgttttataaatgacgatctgttctataaggttactgggtcacgagagctaaaatctttggtggtttttgaaaactgatacttgagggtctgaaaagctgctcggtttcagtctcacattgacaacgattaagatgttgagattccagaagtgaagaccttacacaaggagatgacagctgtcagtgtataatcagaaaagcagccatgaagtgataattcctctgtttttcttctgtgatgtcctagtagaggtgattttaagtaaaatagattacatgtcatggctattagcaaaggcaatagacttcaccacctttgccctgagctatgttatatctgcaagatcttcaacaatagttcaacttacaccaggaatatattagctcgttttcgtctatattcatacgttctactccatgtggctttctgacttttaaagttgggagggagtttaaaaataattttatataaccccttcactttaaagataaagaaagtgagacccagagaaagtaagttatcttccaaggtcaaagcacttctagcagtaaaactttaagagaccatttgggaaatttcattatgatttcaatggaagtcactaaaagtactattgagatagtcaggaccctggagtcagtgagcgatgctgaattgctgggtccagggctgatgaaaatgccactgaaactgtaatagcttagccaataattacattataatatcagaccccttgcaatttttgtgtcttgatcattgaaattgtaagaatgttagtaacagaatatgttccttccaggggtgggcctaacaccctattcatttttttccccttgtacaataaaagtggtgccacaggcatattgaccaaatcattagaaaatcaattactattgagttagagctgaacaaaatagtttgaaaagtatttaatttatcccttgtaatatctgttcttttaaagttcctgtaatctgtgatccctggctgactcctctgtgatccctgacagaaaacctcattttcaaatccttttttccccctttccccctgctatccttccaaatgagaaaatcattaaaggaaaagaaaaaagtattcagcacagtgagataagagcaaaccagctcaactattatgagagaaacgcctgtttccctaactaatcaaaattcacagtaagtgtgaggaaaacaaagccaaactggcagaaataatacagttagacttaggaaagacctagaatgcaggcatatctcataaaaaggttatttagaaataaatctgatggctgtgaggtgagaagttaatgttagcatagagcagaacctaaagtcacttgattttctgctatttctgaaaaggtcacctaggtttaatcatatattctactttcttccccttgccttccatttctcccttccttccctctctgcttctattcctctccctttcttccctctcttcctacctctctgcagtctgcacttttcccttccattctccatcctttctccttttattcctctcttctttcttccttctcttcctctttcactgtctctctttctccccttctccattccttttccccccttccccctctttatttctccctctcctttctctctcaattacatctttcttctcttttttctccccacttccttccataaaggaagctcttttgttccaccctctacaccaggtcctggagttacaaaaacacagcagccagacaccccacactcagaccttacaggcaggggcaactgacaagttttcagtactaaaatcatgtgttaagtactaaaactcagggatttttttttttttttttttgagacaggtctcactctgtcatccaagctggagtgagtggggtgatcatagctcaccgcagccttgaactccagcctcaaactcctgagatcctctagcctcagcatcctgagtaactgggactacaggtgcatgccaccatgtccagctaacttgtatttatttattttttttgtagagacagggtctccctatgtttcctaggttggtcttgaactcctgggctcaagccgtcttcctgtcatggcctcccaaagcacagggatgttttaaactgttagtggaggggaggtttcgctaaactcccccaacctagggtgatctgaaaggacttcttggaagaaataagacctcagttgtatcttaaggaagagtaagagtaagccaatgaagatgggagttgggatggaaaaggggaaggggaggctgaaaagggagagtggaggttcctgccatggtaaacagtgtgtgcaaatggggcatggaagaagggagggagggagagagggaaagaaagtaatacagagagaaaaacaccaagattcaaagacaccaagatgttttggtctggaacgtggatttcaggtccttatgctgatctgtctcccttaaatacaatgagtgccttagaaaggaaaccatattatttattactcccttaatagaaagtgcttctttacagtagtggatatgtttgacatattacatacaagatgcccggccaaatttgaatttcagataaacatcacattatttttaagtatgtctcatgtaatatttcatgtatatttgcactgaaaacatgatctattatttatctgaaattccaagataattgggtgtcctgtacagttatttgctagatcagcaaccctaattaccaagcaccagatagttaataaaagtttagtgaatgaatcactaagtcagtctaagatgtatataagaaagtgtcaggagattcaggtagacagctagtcaagttaaagtcaaatgtttaggagtcattgctggttattaaaactataggccagcatcacccaagaatgttgtgtaaagtgagagagaattaaggatgagtccctgaggaacaaaaagattcaaagagaaagcagaggaaaactggtatccaaggaagaaatccattcattaggaatagaccttggagaaagtgaggacatgaagaccaagaggagtgcacttcagaaaggaggaagtggccaacagggtcaaagaatttaggagtcaggagggtgaaaaacgtccattgatcttagccacgaaagtatcactggtggtttcatcaagtaggggaggtgtggatactagccagatttgggtgagttaaaaagttaaggatgggccaagtggagggagtagagacatggtacctgcaacctgttgcctctttcaagaacctagggttgccagatttagcaaataagagggtacccagttaaatttgaatttcagataaacagtgaataaaagtatagctgttactgaagaagagagagaggggcaatgcccatgggggcatcatttaaagatgagaagatccaggatgatcctatgtgtgaagaaggagaaggaagagtgaagaaggaagaaagaggaagaaaggaagcagaagaaagagtgaagttgaaggtctagaagaaattacagaaagaaaaatttaactctagggtcacagtctctcctctgaaaccgttgaagcctgatgccagaattttccctggaaaagtaatatggtttatattttctattagcactcccctgggggttctgtagaaaccccataatcaaatatgttaatatttttaatagaaaagtgtgaatatttttactaattaagataaaggctgtaaaatagcctcgtttcagtttagattttgctttgctgccaatgaattatattaaaagacaaacaattttggttttcagagctttttaaattttgtaattgatgataaggtattaagaatgtgctcagttctcttcttggccccaaggcaagatgaagcaataccgttaattatctcttaaatatatatcagtcaataatataactgttccttcccagtctactgtagggagttcagtgttgccttaaatgttcctggtactaatttgttttgcaaaatcagggtaaataatggaaaaacaatatttaaaacacaaagtaaagagaccagggaaccttgaggttctgtgtgggaaatggaagagagactgatgggaagataaaataatgattctcatggtaaaggggaaaagagagagagacaagcactggttgggttcaagagaagtttctgaggatcaggtcaaaagtgttccagccccagcccacaaactccttcagggtcttaagtcagatatacaagtcgtctctggaagagaatgatgaaggagctcaccgacagtccctgtcactcgtcctaggagggatgactattacggcagagtcccctcctcctgatccttctgccattaaggtcccaggtcaatgtcagcttatcaatgggatgttctccaaaccccctatgaaatacagtgccctctctccacccatccaagttcatcccccattacattcaccagtttcatttttttttcttgggcagttattaccatctaaataatgttgcatatatattgtttccttgattcatttttctctcaccactagaatctaaatctcttgagaactgacactttgtagccttcagaatctagaacagtgcttggcacatagtaggtgctcagtaaccatttaattaaacatagatgcagaatggaagtagaccacaccaacgctccatgaattaaatggatatctattacctgctcttgattcctatccattacagaaagctaaagaacttagcttccattttggggggaaaataaaagttccaacttttactaagcattaaaaaaaatctgtaggaatacaactcatttatgaatttcaaaatgtttgcattttaaatgcaaccagaaaagaactatttgaataagcaggcatttagaaatgtaactgcttctaatttgattggtcacataaattcagtttttttgcaaagcagatttatttaagtcagagaacttacaaaattgaagctcagcagtgagagttctccatcacacttcctaatccatgatatttcattgatgcattgttcatttggaagatggagatgacaccagtgtctgtgtgtggatccaaatatcccagggggttcaacagcacctcacttcatcaaaacagagaaacaacgagagagctggatgaggcacctaagatgacagctagaggtaactagatgagttgatggcaggtaaacgctatgataacaagtagaaaggagccaataaatactgggctggagcagctcaaagactcctgcctgcttctgaggtttggatgatccttctaacctttaaaagtgggactgaggaatctccctagacagtttggcacaaacatctgctcgatcagtgcaattgcttttgtgtgctgccttttaaaaagcaaaatatttaatggcagtaaaaaatgtgtaagaaatcatcctggagatacaaagttgtattctgggatttgatgattttgttatgtcacagccaagttagtatttttagttagccttgttaagcccttgaacaggtgcttggagctgtgtagaacatagaccaggtctccagtggtgaatctgactttgccaaaggcgagcaggtctcccggccacagccgtaagtctcaaggagtccatgtcttatggaagtttataaggactcatttctgccagccatggggttggatggcagttacaagaagggcatttattgggatttctgggaagtcaccaagatcttccattaacccccaaatgtccatttcttctttattttctctgattcctttgcttctttttcacctgtacaagttcttcttggaaactatgtagaattgtctgggtctcgttcattaaaagtgaaaaggccttcatcacttccagagttttgatttaggccaccgttgaagggcttcacttttatttgtaaaacttacctatcagtaagaaaaaagaattgagttttcatattaatttcttatgacaaacaaagcaaaacaaagcctagaggttatcaaactattatttaatgtaagtcagctcccacacattgcttttacatcattacctcagtacgctaggtcaagggtgctttgttgttgttgtttgtttgtttgcttgttcatttttttaagtggggaaaactatggaaatgggaagcaaagagatactcctaatggtttatttaattaattttactatttggtaaattcagataatgcacacagggccaactataagcttgaaagctggtattaaaggtaccattgcaagaagattctgacagttagaggaactacaggaaagtgtcttttcataatatgaaaaaagagatccttattcttgccagtatggtttgggttcactaatacctaattatccaccatcattgacttttattatgattggttttctaataggtgatattaatattcagtgtttgaatatgttccctattagcatgaggaaaagccaataatgtgacactaatatcatatttaatgtgatttattattttaatttttatgatggcttttgatcattccatatttttatattcacgtttcaaggttgttagacttttttttcccaattacttctgtttttgcataatcagtgtcattttacctaatagcatctctcttagatgagtaataatgctccatcatgcctctttaccaacaggaagattcagagatattaaagtgatttacctaattttttggaagttcctaacttctgttttgaggattggtgctttccttcttccttccctctatttctcccttctttttgttctctctctttcccttgctctcttccactcttcctcctgtactgttattttcctccctgtttttcttctttcctctctccctccctctctgtcttccttttctttcctccctttttattttttccttctagagtaaatagtattagaaaaattagtttctgcttttttaaaagaggaaattgtacagtgtaaagtgatcatttatattcaaggaaaatgctacctaggacatgccttatctcaccccagttctcggtgctgctaagagggtttgagaagcatgggataagggtggcggcaatgtggctgcaacagtgccaggtgagcaacccatgtccgcacgcctccactctcatttcttgtctggactcaagaccccagtctaagagtggcctataattctcctttctgattctctggcaacaggtgaatcccatgatccctgatgttgacatcaagcaaaagaagccatggtctctagccagtagattaacaacacagcatcttgggtgctacagcactaagataagcttaatcatcttccattatttcatgaggttgattggaatgagtgtgtgattggaagggaacagatggggacaaagagtaaactctacatctctaaaatctaactcaacatctttttctcaaacctgaccctttctccagatgtttttgtttctgcttcatttcagcattcttccttccagtcacgtgtgctcaaagtgccaaagttatctttgactcttctgtctttccatcccagtttcataaatttttcctttattctgtttgtgcaatccatctcttccactcaattttgcacctctatttgcttctgccctcccttcaccccacaccaactgttgaggcttttttctttctttggccctatctctggatttttcttattcaatttcatttcaatgtccgctgttagtttaatgtactatcttggccaaataagctttcactccaaatccttcagtgtttttctattagatacataataaagtaaaaatttcttagctcagagtataaggtctttgataatcattccttactcacaagtcctttggaaccatccaccttctaacaaggtaagcctgccttcttgattgctctctctctctgagcattggctattacgattatctctgcaagtcatattttcacacctgccctcttgtgtatgcatgtcccccccatgcacatatgcatgtacccttgcctctgaccttcccttcatattactctctgaattacaagttcctgataaatatcttaatagtgatgctgatgaagagaaagaatagaacagatttaaaggggaaacttctgggatggctttctggccagaggcttatcgttggaagtgtcatacttacccttttgccattcacgggagatttactaaataaatgcaagatggacaatgtcaaatcatatcaactctcctaacagtgcagcaaacgtaatataggattgtgatatagcattggtaccaaaaatgtgaaattatttatgaaaaaacattttctgtctttgagctaggagcatctattagaacaagaaaggaaaacaaatgcctacaattttgggtcttttcatatcaacttggaggcaaggacagtggcttagtcctcttgtaagatagcatctttcttccattgtttgttgcccaagctctggtagacctctcagctttttatggcctgccagcctctaccttttccccaggagttgtgatacttacagtattaaccaacaaaagggcacaatgttttacatcttaaattattcctcttgcacagtctgattaaagcttgacaatatgaaaagcagatgacagggccaaataaaccagccatcacttgaggtcacccaccattttccagtgtaagtggttctgaaggagtatcttttcttactttgaggttgctttagagacatatagctcaggtcttaatagtcagtccaaactctcattcacagagcattacacaagtgtattccaccctggtactttgttgggtttctgttgaatcccaaaacactgcttaaactcacctcaattacagggtcagcagtgcatctgcaggcaacatggcttctttgttatccctggtttgttttccctggctcagtgacagaaacttgacagtccagtgtaggttaaactgaatgagcattttgtagcataggtgctagtcccaagtctctccaaggacatagggctcaagtagagtagactttattaatgtccatcaaaggtgaacctagtcttcaaaatgctgcctgtccctccaggtgcatcaaagctactaattaccattcttccttccttccctactttggatgggcaatgaagaaaggagagagggtaaatgaaagatattctctttactctgtaatttgatatcacagtaaaatcctggaaaagatgttgttaatattcaccaatgaccattatccctgccacagtctacccactaccacatccaccaatctcagagtgctttgaacataggtttcaaacataagcagaacactggaagtatgtgccaaagaaaatgcatttgaatgtggtccattatttaggaacagtgagtttccaaccttatttgtctttctgttgtctatttttgtcatttcttttgtcctaaaacaaaaattatttttcttttttgaaacatttttaaaaattctataattatattaattcattcatttacttatttatcatttaattaacacaagggttggcaggctttatctgtaaagggccagatagaaaaaaattaaatattttaggctttgaagaccgtgcagtctctgtcacaactacttatatctactgctgagcatgaaagcagccacagatagtacataaatgaatgagcctggctgtgttccaataaaactttatttacaaaaagcaggaagtgagctgttgtttcccgacccccaaattaacatatttgactagctcctatgctttcattaccatgctagcttcaggggacacagatgaatagaactttgttcctgccttaagatgccaataggttaatgtttctggaaacaaggcaggccttcgacaaagtcacttttggtgtccttctatctctctgctgctccttttcctgccactttctcagacctagtactgtccactctgatatgccatccagatgttatgtaatgccatggtattacataaatgctctcccattcctcttctattgcaacttgctgactctcagcacattgtcttcaactaactggaagacataataaaataacgtacatcaaggagggaatcactggcagtagcttaatttgttcatccttcaggagttcttacatattaaaagaggatattttaaattcacagacatctacctctacttgtaaaattcccggcagaggactagaggaaatctttctgagcagggaagtccatgacaccatctaaatctcacagaagtgaacataaatttcctcctgtgactaatgaagataactcacatgtattgagtcactagcatagcagtcattgccctaaatcttccaggtaagatttactttgagctccctagtagctctatgagtcaggtgccattattagtatccccattttacagatgagaaaaccatagctaagaggggctacataacttgataaaagtcacacaactctcatgtgagatcgtatttgaacctaagtagtgagcagccttaatactgtaattatgaagaagcaagtcttctctaaatcagacatagttgagctctattatagaatcttagaagaggaaggacaattaaatattgcttagtataatcttattttaagaacaaggacaccagggctcagagagcgttttggatttgacaaagtagcttcagactgctggaagtaaaatgctgttcttaatgagttttttattttattttatttgtttttgtttgtttgttttggtcttagtaccacatggcctcttgacagtatagcaataaagggaacatgaattgattagaaaatgattccttcccgctgggacattagtctgtggaagactataacatgtgcgactttgctcttttatgctcccactcatctttaatcatgggcctactgggaacacctcattgcccctcattcactgggtggttgagtcttcgtgaagcaaacccacatgagttgttctatggaaggggagagcagaacggtgcattccatcattaaaatttcacatctaaacaccagtgcctgactatgctttctctgaatttcccatagggttattgaaagctctaacaaaacgtagttaaggcaaaagatagctgtctgttttataaagaatgtaaggaatttcccagtcagatggctcaaggaaaggctttacccgagcagtcctactttccatagcaaattccagttggttagagcaaacactgtgacaatatctattgttcaattaaaagtagccacaattatacaaaacataccaccatatggcatgtccttacatctcatgtatactgtagatactattttagcttcttgctttttctttttcttttttctttttaatttttttttattttgagataagagtctcactctgttgccaaggctggagtgcagtggcatgatcacagctcactgcagcctcaaccttcagggctcaggtgattctctcacctcagctcccaagtagctgggactacaggcatgtgccaccacacctggctaatgtttgttttgttttgttttgagagacaggttttcaccaagttgctcaggctggtcttgatctcctggactcaagtgatctgcctgcttggcctctcaaagttgggattacaggtgtgagccactgtgcctggcctagcctcttgcattttctatgggtgcattttcataatagctttttaaaatcaaggtagatcttagaagtgaaagaagatataagaattttatatattcttgagatataggaatctgatagtttcagttgtcataaagccagtggaaattcacagcttcaatgcgtacatcatgttgggaatttttctcctccactgtttctcatgagggtgggtttatagagttaaatagcaggggtatcttcaccaactccactgttggcattattttctttgaaaaaagtgtgcagagagatattatataaacaatatgacaaatcccttctccgtgggccaatttagtaaacttagagcagagaaaaactatagcttcttgctgctagaagtattacgcagaacacagatagctcttttcagtttcccataccgagagtcaggtaactgagtggtactcaattctcaaagcaacaagaaggctgaatattctggaaatccacaatgtagtagtaaaaatcaggtgactttggaactacatgaggaagaacaataaacaaattgctaattattccctgcctgccatcatttttatttactgagatttctattcctatctactttttgatttattgagattttaagggaatagaattttgggggaggttgttcagcaaatatactgtcaactcatatcattctcttgattttttatagaagaaattgaggtgcaaaaaggttaagtgctcagtattacattgttattaagtagtttagctggaatttgaatccatgtcttctcattccaaccaagagactttgttgactaaattaggctactctctatggtaagtatatgggcacaggtaggtgtaagagtacagttgtagtggtgttagtggtagtggtggtgaaggaagaagatactgctcatctctcctgataaatgcttacgagaatataaataacaggattattatgtcagttaagaataggcttacctgtaaacaacagttttctcacaattccagagttaagttattcagggttggtatggctcattagcattgtgaaaaaaagatctaaatatcttctctctttttgccgtcttcattgtgttggttgtggcttcatggggacaggatggctgctgcagttccagcaagcacaactgtgttcaagccatccatgtctttgctttcttgtttgtttgtttgttctgttttattttgttttgttttgtttttaagagatagggtctcactctttcacccaggttgtgcagtggtgtaatcgtacctcactgaagcctcaaattcctgggctcaagtgatccttctcgcctcagcctcccaaattactatgattacatgtgtgagccactgtgtccagcttcatattgttgcttctgataggaaaagctgatatttatctagagtccctaccaatctcttctgctttcatttcattaattatcgctgtgccatatgatcaccccagtatcatgggagtggctatctcccctggggctgggccctttgacttccccaagcagacagggttcagttaggctgaaaagggaggaaatggatattagacaggcaatacaaattgttgacacagttcctaatagaatacagtcaccctccttctacaccccaattcagaggtttggtttcattgtcaacagccaccatggttttatcctggtgattttgtcaagctgcagggaaataaaaggtagctgctctgcaaaaggtgacagaccctgatttactacctgatatgttgcttacactcctgtggtgtttttccagaaagaaaaatgaacctggccctagaagtctcactttgtggagcatatatctagcatgcaatactattctactatccctcctgtttcctcgagcatttcctgaacattcctctttggttattttattatttctctagaacatatataatttcagaagtcatctccttttatttgtgcctgttatccagtctttagcgtagctagatttgagccacccaaatgatggcactcttctttctggcacaataagcattttaagtgaaagaaagagtattagtagtctgagtggttgttttaaaactaaggttgactacataacaccatcccagatttaggccttgttgtgattggctttttcttgcactgagaaatggatatttaatgaccatctcactatgtcatagatgcacttccttaagttgaaaaggcctccaaggactcttcccaggagaaaaaagaaaatctgagttggagcttagcaacatccagttctgcatcaagcaggcctctctgctatgagaggggtcattgtttcaatcccctttgctgtggtggaccagcagctgtggaacccacccatgttcagggaccagcagcaatgaccaggaaccacgctggctgactcacacttaactgccctccaagaaaattcactataaaagaagtcaggaagttgaaaagaaagacggttttccttcacttagcttttctgcttaaggcttagaatcatcctgtatttgtctcctacattgaaacaacaaacctatttaagcaacctataaaatataaatagattttctgtagtgtagtcggtgagctttctcaggctgagttagtgtggcagctgccccagtttagcttctgcataggaaacaaggctctgctgaaaatgctgaaccccaggacaccctcttccttagtgtggctcagcacagatgcttgttgctttctgaaagcatccactgaccccatgacttagctgcctgaccctcctggaagtaccatgacacacttcacttttgttttgtctttttagaacttatgtcatcatttggggttgagcattttattgtgaaggctgcctagctcactgtggcatcctcagtgcctcctatccaatgcaaagtcaatagatatttttcaatttaaactggttttgtaagggaagccaggtatgcaggattaggataaaaacaggaataaggggacttctgggagcagttaatggttgaatggaaggggggttcaaggtgccatggctttgggtcttttctccattattttgagatgccatcatataggctacctttggttattcatcctattccattcccaataaatgaacacatttgcctttggcatatttgagcatgccctatcaaaccatgagagctttggtattaaaactctcctggtcggtgtccgggttttaccagaaagcactgactaagaaaatggagaagcatagttgcaggcctctcatttgtgccccatgagggagggaagagaaatgacagaagtctcacagctagagatctcacatctacttgtgtcccctttgttagatgtaaagccagccacatgagattacattcaccgtcggcaactcaggtaacggatctgaagggcagcttgttctttttttttttttgagacggagtcttgctctgtcgcccaggctggagtgcagtggcgccatctcagctcactgcaagctccgcctcccaggttcacgccattctcctgcctcagcctcccgagtagctgggactacaggcgcccaccaccacgcccggctaatttttttgtatttttagtggagacggggtttcactgtgttagccaggatggtctcgatctcctgaccttgtgatccgcccgcctcggcctcccaaagtgctgggattacaggcgtgagccaccacacccagccagcttgttcttaagaaaggaaagaatacaagccaaagcagagcaactatctttcacgggggctttcatagaaatgttttcatcggtacagtttggcaacatgacctccaaggacaagggcccttattccactaatatgagctatgatggcttagtggttaaaacctggagccaaaaagcctgggtgcaattacagaaccacactttgctgctagatggtgctgggaaaattaccaaacctctctgtgtttttcatctgaaaaattgggatgttaatggtatctatgtcatagggctgttaagaggattaaattattaaacaattgtaaaatacttagaatagcaatagggttatagtatacatgtttgttaataaattaccgagcctgaataaccaagggctttgaggccgactatagaaaacaatagagaaattgtagttataggatccaccaggtagatttcagagctggacaaaggtgaccaggcggtcagatggagaccttgggggaatgatcccagtgatggatagttgagatgcagatcaacaactgaggctgggcattctacaagtctgaaactagcaaggattgtgtgaagtttgtggatgttaagaaccttaaatttcctaaatatcatttattctttttgaaacaagatttgcctgtggaaatgctgtgacattttccaagctgtgcttcccctctgcaccactcatgacctcatactccttggcggcattttccaggtcttggtaacctcccttgaaaagagaaatatagttcagattcgcagcagtagtctaagccacacagctgctatgggtcaggggagatcaattacatttcctggggttctcttcaatgggcggtggtcttgtgcacacggcattatagatactcatccttggaacctggcttgttgaaggttctccagaggcaagaggaagttaaaagataaacttggctgtgtatatcctatttcataactgcctaaatagtaagcatgctgactggcaagaattagaactataataaatgcaattaaattgcctattacttgcataattgagaactataaatattttaaataataaaattgtgaaaaatttctctactaatgctctgggaatgtcttaaatctgtaaaggccaggggattcatagggatggctgaatatgaaatctttccattcatctctttgagatcaaatatttttcatgattatttcaaaaggctccaaaatggaaaagagtgaatatgtgagccgccatgagaaaggaagcccagaagagtgagtacagggtagtttttctgggaagatgtatttaggaaatggggcaagagcaaagaataaagaagtgcaaaaatagaactaatttgacactgcatatgtgtccttctccgttgctgtacatccttttttgcttccaaagggcataatttgatgtgattaaataaggccttctgctttaattaggtatctcagtccttgaaaattctgattaactttctgtgtatggaaggcaggagatatttaaatatgttgagagaaatacaagagcaatagcaaactaataatctgaagagaggtcctcttaacaggtgttttttttgttttgttttgttttttgtttttttttgttttgagatggagttttactcttgttgcttaggctagagtgcagtggtgcaatcttggctcattgcaacctccacctcctgggttcaagcgattctcctgccttagcctcccaagtagctgggattataggcacctgctaccacacccagctaattttttgtattttgagtagagacggggtttcactatgttggccaggctggtctcaaactcctgacctcaggtgatccacccgcctcagcctcccaaagtgctgggattatagctgtgagccaccgcgtctcaccttaagaagtttttaatactcgtacataaattcaaaaggagaagtggtatttgttctaatattttctataattcagttttaatatattggcatatccaagtgtgtttgtgtaggtctgtgtgtgtttgttagagagagagagagagaaagagaagaagaaggaggaggaggaggacgaggaggaggaggagagagattgtattattcaattacagcagacactgttagttttctgtgtaatacccacttttacttctttgttaacaatgaaatctcaattttatttgggatggaaatgtacccaggtgtgaaaaaacacatattttccagactcctttgcagctaggtgtcattgtgtgtcatggttctgggccatgcggtctaagtggaagttttctggagattttataaaaatttttgtctcttaatatgagcagttgccctgatttcttgtcctttcattcatcttcttgcttggaacttagcccatgagattgcagatggagactattacaatgaaaggcccatcctaaggatggcagacagaaataagagcaagtccagggcattaatgaatttgtagaactatgtcttcaaccgttatgggagaaaataaattcatatttgtttaagccactcatgttaactataatggtgcctacaagggaatgtataaagcaatagagcaagaggagtatcagcaattttcattcattaaagatctacttccaggactcaaataggcatgtcttatatttgatgcctattttggtggacatagccattttgaaatttacagagatccaacccatgctacaatacaatatttccatctttatagtgcttgagagtacatagatgggctgtagacaactaatatgtctgcatacactgtattcacttttggaataattctagtttttttgtttttactgagtagggacatcttgatagaaatttattaacaggattttgattttatgtaaaatgcatttaacttattttttatttgctgttttctcaatatcttatatatttagtattctatgttatattttaagggaatcttattggcacaattgtttttaatgctactgtgtataaaaaagaacacattttagaagcaaattgtaattagtaaaccaaccaatgttaaatgtttaagaaactgtaccagggaagaggacatagtacaattacagtagtactgacaattacggtaggaccacacatgtggatgccaatttatatttttacccactgcaacctctgggccaagaggtgaagttaaaaaccagtctctggctgtttcagagagttactactccacctgcttgtaaaattctgtctctttgaggtttttgccattgaactacctcccctgttatctacccacttctgcacactaactttcactgaccaaagactttcacttaaacccacagtcttcctttctctctattccaggccttgctgtcctcctgggttatttctgttttcatgtgtgcaacccattcagtagcattgactctcatttgtgggatatcatatcgttccatccataaagagttcagaatccacctccaaaagatagaaactccatgaagaaatagccaaaaagtagcaagagtctaaatatctatcagcaaaatgtagtatatttatacaatggaatattattcagtcataaaaatgaagtactgatacgtgctacaatatgagtgaaccttaaaaacgttatgctaggagaaagaagccagatacaaaataccacatagtgtatgattacatttatataaaatgtccaaaataggcaaatccatacacacagaatgtgtattagtggttgtcagaggataagggcagggggtaatgaggagcgactgctaatgggtatggggtttctttttgtagtcaaaagtgttatggaattaggcagaggtggtggtggttgcacaattttgtgaatatacaaaaaaaaaaaaccacactgaattttacactttaaaatgattaatattatcttatcttatgtgaatttcatctcaatgaaaaaggagattgagccagttatgttgctaagtttggaggaggtcaaagcaaataaggtcttctctttaccctcaaataactcatactgcgcagaggggacttccaatgggcccagcaccgtggtgtggcccagcctccaggagcaataggatttcctctcagatgaggatctgtgtaggatcaaggcagaaatctctactgaagtctgtttgtgtcacacacttgtgcatgcctgccttggagtctgagctctagctttgtcccagtcttgtcgccttctccaccatggggactttgcacttgtactcctttctgtgggaatcctgtttctttactcctcctgtctcgttaattcctcccaccttgcagattttagctcacgtgccattgccccagagaaatcttcctaccccgaccttcatagtcaggttcaatcaccaactgtccattctcttgctctcttgaaattctcctttgcaacagcttttaccagtttcccacagctgtaattctttcactcagttgtcttttcctgccagattttgaagttgttgagggtaggtactcttcaaaacagcaggcaaaggtagtactcagcccacttttgctcaccaacataacttcagcgcttcttagtgtctgacacgcagtaaggactcagtgaggacatgatgatcagctgagtgagtgtctgctactgtctacccagctacccaaagacatacgccgttagggacttccgagaggagaggtttttcccctctggccttgacaggtcctttcactgccacatcctttctcctctaagttgccatcatttgatcatcttatcctcacaggaacccagtgaggtagtttgatgccgttgtcatttacatttgaatcacctgcaatgcaaagtgaggataggatgactaaatgattaccgtgctcagggaaagtgtccagcattattttattgggctgttaggtcatgtccagtttgctcactcgaatacttcatcatattctgctgccaggcctataaatgtcaaatagtaacaacccttgacctcctggcccaaagctaagcatgttaccagatgagcctcactgaccttctttaatatgagaatctttaatatggattaatcatattataattatgtatttgttctttttattagagtccttggggaatgtcttttaccgaagaaatgttatcttacagggtaataagaccaaatgggcttttattttttaattaaaagaagatgaaaagttctgcttaaaatacttttaaaatgccttcatcttgaaggtaaatggcagacatgtatcattttgcacttatataaactttactaggctgggcaattgaactccaaaatgaggctgatagctaatagaacatttgtggaggagacaaacaaattgtccagaataaacaaagcttatgtttatttttaattgatagcagctgagcacagggaggtgtcattagctcaaggcacagatcaaactcattaagtaccctggccctcttataaatcatgcgacgtgtcgagtcttgaattaaaccaaacaagagaatggttcagaattcttcccttgtaccagcagaagcatggttggcacaaagacccttggagaaagattgagcaaggctgttccccttagtaacttctgagcctacgcagtgatcaacataggtgatttgcctgttcggagaccaagaattggagccaagtgactggttccgagtcctagctcctgcactcccctgccatgcgcagcacctgctatcggtaccttcccgttgcccttcagcctactcagggtgttactacccggctttttcacttgctggagacttcctgcaactcaggcctagaggtgttctcttgctgggaggttgtgctttgttcagttacaggcgagccagaaatgcagagttagccagctagggatgggagttggtgggtaaacacccttgctaaatcacccctcaatggaaaagttgtgttctacagagttcctcagagcacccccaacaggatggagcaccagcagccacagtggtaacctgttcactagtgtacactctcacttttcttcttcacagtgctttctgtaattgcctcccaaataagatactttttccaaaatcctagtctcaatgtctggttttggggatcccaacttgagaagctctataactgttccttttattcctaggacagtgttaaggaggctagaggtgggtagagaggcagcctagcacggtgcttaagaggacatgctctagaggtggactcgctggccacatcctgactgccactcactaggcacccagcctctctgtgcctcagtttcctcatccacaaaatggggtcagtgataataagagtacctatttgatgggcttgttttgagaattaaatgaatactaaatttatacttttgaaacactgcctatcacataataagtgctcaataaggtcaggtgtagttactagaatcacagaacatcagactggggaagaagtttacagattagctagtgcaacctcttcattttccatgtgaggcaactgaggatcaaagagacatggagtgatttcctcagggtcacacagctcatcagtgacagcaacaccccaaagtctctcagcgcagtgtcctccatgctgcgaaatcagcttcaggacagtcctacttccaaatactctgttaacaaacagaactcggtgtggtcatttcaatttgctgggctttttttcttaatttaggcaatgcaaggcaggaatgtgcaggcattatgtaagattttgaggagtccatgaatttaaaaccagaagttttttaaggggaataaaataaaaatcaacttcacaatgccataggcagaatgtcctcttgaagaatctaagatttagacacaaatactgtcttctgcagagtcctttacaaacttctgcttaacctcctggcatcaacggacgacaggttctggctgtgcagagtggaagtcccttagagtatttgacagcatttatctgataacagctcccagccttggtagtattcacttgtttatggaggtttgtacaagacagaataaaataaaaatgcatgtttctataccagccctttgctttttaaagtcttttttatctacggttccatgcaaagtcacatgttctcttcttccttttgatcttaaatgaggaaggggcaaagtgtgtgaagattccagaagaagtgaatcggagcaaagtcctcactaaatgaaagcttcgtcttccattcagccgctgagatcagtggaataaaaccacattagagatgatccccctggcccttagcctccagagagggcatctttcagtgacagtgaatgtgctgctatataaatacacaaagcattgtggaaaggaaagagctctgtggtatggagacttgtcaatatttgtccgaaagtcatgtttctattatcttcaagtatgtctggcaaaggaaatctggagggaatcttttaagaggtaaaacacgttgatttgtgaaaatgggatcattttatctcttctgcttcaaggtaagctctttggtttcacagtaactagttgccaccagatcaagttggggaatatttattcttttgcttcaattcctaaaagattgatattaatgcattaagcctctttttttctttatactttcttcttttctgcaactgataattaaagctataagaaaattaaattactattattattattagaaagctcccatgctagccagttctggttggatataggtcagctgtgtacaaatggacacactgtgaggctttgtgcaataatataaccactacttgagaccaaatgatgggtgatacatatcctaaacctctccctcatcatttttatggttaaattacaatgattgagcatcaagcttgcctaagatttgactactctacttctttgccttattttctgtatattaagttgcagggaaggtttttactttgcaatttatttttcctcttgaatagtgattatgtgaagttctaagcatcacaatgctgcagtgtataattcttcaaagcaggagaatcagagtgtagcaatggaatgcagaaaaaagcaatacgagaaaggattatttgtttgcatctgtaagaggataaagatggtttgaacatttgcttcatatggcactgatatgagcatacttacctcatttgaggtgaggtttccccagaagcagacagtgagaccagtgaatgcatgtagttgattttggaggtgatgctaggatgcactgataggaaaatgaggaagtgatcatgagaatggcaggatccgatacagttgcattattaaacaagttcctagaggagggctccatccccttgggattcttctgatggactgcatgagcacatctagaattgtccctcttgatatccatcacctttcttccatcacccatacacagccagagagtcacaggggcttgcaatgagaaggcactgatgtacatgggaacagtgagctttgaggggccacgggtgaaacatcaacagcgtgtgttaagctagaatgataactggctggttgaactaagtaaacaaatccaagtgcaaccttggaacctgggatattaaactggctgccaacattgggcctacctgttttctgtcttggtctggatttattcctcgtttccttttatttctttttctttaaaaaaaatcttttttccttctagtttctctataagattttttgagaatgcgtagatatacatgatggaggaataataaaaacactttaaagcaatagatgattcttaccaaacttacatggataaatgtaataggagacacaatttcagctgaataaaagccttactccaccactctccaaaccccagaactgttgtacagttagctttttagtacttacgactatctaatggatcttgacaaagagaaatataccatagcattgcattaatttttgagcagatagtatattttgtaattagatttaaaaaaacaatcatgtcttttgttgttaatgggttaccttccttcggtatatttgatgaatatcatctctcatggctgctcctgagtcagtctcttcagcaacctgttcctcctttgttactttgtttctgctcacaactttcagctccatcaacagtcatcaagtccatttggcaaatattgttagcctctggtagtggcgacaatacatagaggtgaaaatattctactgatataccactgtcatattaaactctatgttgcaatacaagcaattctcagactgaattctgtcacacacacacacacacacaaagcatcaatgaggaagtagccacaaaatagtcatccagtcttatcctgtaaacttagtgatgttcctccatctgcaagcacgcttgcaggaaaaccaacacgccttgcaggaaaagttcattttgagttgccaaacctctaggcaaaccaggctgtgaagtcacccattcaacatatgatcatgagaccagacagagctctggacctcggcttggctcccaagatcttattgccagaggctctagattctcatatatctcgtgcaagagcaatggtgccgtacaatctttttaggcaacaacatatcttgaacaccaatcgtttcaccaattgaggcatatttctaatatatcgtttgcttgttagctaaacttatgctattcaataataatagtggatgatgtagtcatctttggagggtgagtacctgattagaatattacatgttaattaattgccaccaggatatgtatttacacacacacacacacacacacacacacacaaagctgagagagagagaaagagatttttaagctaccaacacagaaattctttagaaatcatgatttacctttcctgtcaaaataatttgaaatttcctattgttaatctgaagtttcagtaaagagaattttattattcttcacatatagtatttctgcttttactgaaatggcttgctttaggaatttgccagaacagattttatctgccaatgggaaaaaaaaaattagatgttgaaagtcctgtttgttatcccgtcatcaaattcctcttttcaggtaaattttgaaaggttgcatcctgccagagagattttactgaattttctcatctgtctttgaaagctatactttatcctacagataaaactatgattgcatggatttgaacaagtcttatagaatcccttacatataatgtttagcctaataagattggtattggaattgtccccaaattatttagctagtacataatgctatatctataaattgtgataattttatgttttggctacagttgagttttagactctgtatgcagctggggaaaaagtatgacctactgggaagcatcagtgttttcttgcaagctcattcttcattttccaacccataatccccctctgctactcaaggaagctgaagcccaggattaatccatcggtgtccaaaggcctgcaggaggtcaggcgcagatggtttaatccttggtgctgcttggaatcatgggagtgggtgttggatggaagtgcctctgatctagctcttgctgtgggtgtcttgcacctcttgacacacctgtggctgcctggaggttgtcagcaccacccaccactctcctccctgccttctccgttgtttagaattcttgctatctagtgggtgacaaagaatgtctgaaaagttcagttgctaaatggatcaaaattagtttctcactagttctccaaaaggtgcaagtgctgttggaaaaagagctgtaaacaatattagttgttgctgccagttggagcctcataacaccttataattttatttctgttaatgagacacatgaggatctgtggagttcagtgggatataattttgcatatgcattattaaaaaaaagaaaaagaaaagctgacataagggagataaaagatcaagaagcgaagaatttccagctcatttaatagagacattgaatacccttatgcattgccttttgactatgccatctcttgtcaagcaattataaatacttgtaactaaaacattaaagcatagaggttaactaaacaaagcatcagcacattgcaggctaaagaaaacccttgtttaaagtgatttccattttgattaatttatccagataaaccatcaatttcccaaagttggagactccgtagatccagactttgttttctacgtgaaaactgacagttctctggaactgtagcagagaatatggtaccatttaaattatcgagactgtagggcaaaatttcaggcctcttaaagccagaaaaatggccccagtgagctctctcatgatcagttcattcttctgggaatctcaggaattactatgtctaatgactttgccagtgggtctggcctgtgtaattaagatctaaatatatctctatgttcattctataactaaatttcttatctggacaaatgacccatttatgaaagctcataaaatatcatagggagtcattacatacttaaaaatctctctaataaaatgtgcccaaagatggtcatatctgcattgctaataattttccaaaaatatgccttaccataagtaactagaaaatactgcatattatcattcaagagaagaaaagtagaataaagatccattagtattaaaaaagtatctttccttgctttaatttagcgaaaatacttgcatttttcttctgctctttcaattcctggatgtgctagcacagccaccatcacatcaacataatcttgcaagcttgtgcattcactgcagaaggcaaaatgtcatggcatttctttatgaaaatataaaacttttttttttgacggggcaagtttcgcttcacatcaaaggtaaatgagaatcaaggttgaaattgcaggcacttcagaattctgaatggaatactggagtgaccagactaaaggaaatacaccatatgtaaaggaaacattaactctggtattttattcccccttagtaatttccgaagttattgattagtagctctaatcttatgaaaatggttcattgtgtctcattaaggatgacttcatcttaccaaatcataacaaggaaggagtggaggtagagatagtagaggaggatgaaggaaggaagacttcccctcagttagaaactacacaagggagaaaagttatatgtgattggggagtgttatttaatgtttactgagagttccaagaatctttagtgggattttaaaaaaattgtaagttatctggtgatttatggttcaacctgaaggcaggagacaaaattcatatgtttgtgggattttttaaagttcataatggtctatgccttctaataatgacaaaattcttggaagcctctcagatcactgaatcatagtctttagaggtagttctcagaaatcactctatacagctctcaacctaagaagagccatttgcaattctgacaagaaacgataccttagcttttgtcttagctcacacagaaaagcacctgaccaattgacttcctcaccaggtagcatgcccatgctattatatatgtatatatgttaacgtacatgtggtttatatcatccaagtaaccgaagtcaaatggtcatttaatatagaattggaggcaccatagagcagctgagtcaagcctaaactgaggttatatatatcattagatttttttaagtacaaaagactaaaagtgcatttctttcacttttactgccacttggagttaagtttcctgtaatttgcagcataggacactttactgatataagggtcaccatcagtacagggatcagaattgtgaaagttcttagtttgaagaatcagtagtctaaaactcttgctactcagactgtaatcccaagactgtcagtattggtatcatctgggagcatgttaatcatacagaatctcagaccccaacccagactcactgaattagaattttcattttaaccagatcctctggtggcttgtctgcacatttatgtttgataattattctggctccaatttttggaatatattgactgtggtctaagctgtagacgtgtcatggacaggtagaaaccgataaaattgccccactaggaaacaattgagtctgtgataatgacactttatgtgaacagaaggacgcatgtgcttatcaggatgagaggagttaggtatttaaaaagggcagtattgttacaaggtacaagtatagagcacacgcttcatcatccagcctcttcctggttatccttaacctctgtgtagcttttgaagatctgccacttcaggtatccgtatacgtgaaaataataatgccctactccttgccttcccaaggttggaattaatgcaatgatatcatgaaagtagagcctgaagtagaattattttctatttacttgcttctaaatatgtccacagatcagtaacattagcatcacctgggaccctgttagaaacataatttcagcctgccccagagaaacggaatcagaatttgcattttagcaatatgcctaaatgattggatacacattggcttttgacaagtgctggtccatggcactttgtgaaccagggaactccctgtacctggagaagtttagatgatgcttgggtgagtcccatcaaaaatggtggagaggggagccatgtatggtgcatgcggaagttagaacaaataactacagggccagttgcaattctgagttagatatgtgttcttctagaaaaacactgaaacaaagtttaaagtgatctggagtggtcaaaggaataatttacagattttgcagctggatgtgagctagagatcccatgaagatatgttagttccaaaaggaacacattttgtagggtggggaaattttggtcagttctttggagcttgtgggaaatacatctctagtgaagaagtcttgtctaatcattggcttcttacttgtcctcaaaaatgttcctcaattacattaagtgatgtttgttactaacaaaactgtcattttccatgttgaaggatgtgtcccactttcagagaatcccaaaaattaaaaacagtggagggagaggaaaagtgatgggcagaaatccttccacacactttaaaggaatataacacttggctgtagtaagttttatctgagatagagttacaatctgctatggataatttttattttgttcatccttaatcaagatgcaatcataagattgtgatgaaaaattaaattcatcactttgtgaaattaaacttttgatgaagtcaaagtctagcagaactagtggcggctaaaagtattcatcaagtcaatacttgctccatccattcagctatccattcctccttccatcttttcttccatccatcatccatatatccatgcaataagtgaccttattacctttctaataagaatgacaatctagtgtatggactaagttaactccctaggagtagaaagaaattcactctctactcttagtgaatcctaggtttgtcacattttgcaaaaccaaatcttctcatctttatggtttgctcatctcccagtgtgggagccaaccctggcccgctagagcatttatttagtgaatggccagctgcttgctcccctccttgtggttgctggttggattaatgcagtgaacactgagaaatgtggagaaataacttacctcctggggcctgagctgtcatatctccttgcagactggctgctccccatcttgttctttttgctcatttccataatagactctggttgataaaactcttcactgtgattgatggtccacaaagcacagccattttcaggccacgagtagcaatttttaacttgggaaatatgactacaatcaatttctttctccttttcttttcttgctttcttttattttagtcatttctacagggtgtgtcctttagacatctctttcttggtcattattccctaattaattcccttgttaaatataaagtgtgcattagccttgactgatgtcttcctttgtgactaaggaaagaagaatttattacctttacgtattgaatcaagctgcataatcacaattcatttgtttaaagccctcattcttcataaaccatactagagtttaggccccctgcagctgccaagaggatctcacctgactttcataaatatgatatggagtcaggtgtttgcacatgtaattggtttaaaaagtggctgtattggctgggcaaggtggctcacgcctgtaatcccagcactttgggaggccgaggcagtcggatcacgaggtcaggagatcgagaccatcctggctaacatggtgataccccatctctactaaaaatacaaaaaattagcggggcggtgggggggcgccggtagtcccagctactcgggaggctgaggcaggagaatggcgtgaacccgggaggcagagcttgcagtgagccgagatcgcgccactgcactccagcccgggcgacagagcgagactccgtctcaaaaaaaaaaagaagtggctgtactcacatggaaacccatctcttcatttatgtaatgatttcaagttcacaccatgaaatcatggaggggatgaaatggaattgcccagtttgttgagagaacatgccgacacttcaagggataaaacagacgtgtcaagactctgcaggcgtgaaatctgcatatgcgttggtaaactagcaacctgctccttctccaattatgtggttctgtgacattagtaaacacagaaaaggaccttagctcatcccagggaagagagactgtgctggatatgagaaggatgcagtctgggctacaattatctggtgtagccatacaaaaaaagggaaaaaagctttgattagaaatggatagagtaatggttcgtaaagtgtggtcctgggccagatatgggggttcacgcttgtaatcccagcactttggaaggccgaggcaggaggattgcttgagctcaggagtttgagaccagcctggacaacacagcaagacctcatccctatgaataataataataataaatattagatgggtatgctggtgcgtgcctgtagttcccaactactggggaggctgagatgggagaatcacttgagtcccagcagtcaaagctgcagtgatgcatgatcgcaccactgtcctccagcccaggtgacagagcgaaaccctgtctcaaaaaaaaaaaaaaaaaagaaagaaagaaagaaaagaaaagaaaaaaaaaagtgtggtcctgggagccagcaacagcaatatcaactaggaggttgttcgaaatgcaaattcttgggctccaccgcagaccttctggatgagaaactggtagttaggccctccaggtgattctgatgcagctaaagtttgagaaatactataacggaggatatttttcttctgtttttttgggagaaagtcacactaatcttcagtttgaagacatgtttaaggctgttaagatctggtaggtggcacatagaacggttttcacactgtggatgctgaaaaagaattctcatctctaaccagttctttctcaaggaccgaggatgctcaagatgaattcttctctttcccttcttcccttgacctcactgactctgttctgcagtggaaagtgcttagaattctgagtcaaaggatcggggcttctgtctgagcttttcttcttaaccactgtgtgactctggggaggttactcacccagtctggggataagaataataataatgctttctgtcagtcttacttggttattatgaaagacaatgaagcccacggaagctgtagaatttacaaggtggtatctttcttcctacttgttaagctttaacaggggaagagactgatagctgaagctcctgagtattctgtccatttctatgatcttccagtaaatattgttgaatgtgtattctctctccctcctaacaactgttcagtttattagcagcctgtcagtgagtcccggaagaggatttgaggccaagttaggtgagaaatggttgattgctctatccatagcacctggcccataggttctttggaacctcaccactggagcctgttaagggttgggaactatttctctctgagaccgtctgtgttgctttgtgattggttggttggtgtgaatagattttcttaaaagcttctcctggaagttagaccttcaacttcctaattaagagacactggaaggtacaacttattaagaaaaccagggattgactcaaagccaaggatccataataacctccacttgggtttgtttaaaaaaccttcggaggcactggacacgtgaaagacagaatcccaaggaacactgccttcttcttaaggggcctctcactgaatcctttcccagttgtttgtccttggcagtccctcctgggttttaatccaggtctcaggggggcctttcttccttcttgtggctttataaagatttacctgcttttcctccttcttaccaagactagctggttataagcaagtgctctgtttcctctgaggttctgccaaaataaccctgcaggtttattttgctttaaaagctctactgccagccacaccaagggaaataacaatatcaaatgtcttaggttggtttcctcagaagcagactctgggataaggatttgggggaaagagatttatgacgaagtggtcccagaaaacacaacaggtgaaatgtgaagaagtgagagtgaaaggaagagtgggtattggggcaaatcccaggtgattacccaaggccacggggttgctctccagatggtgaaggtcacccttcaacattgtccccaccagggcaagggcaaggaatttgcaccctcccattcctcacccatcagtcattggtaaagggctgcccctggggagcatttgattcccgagctctatgtgcactataaaagttagttccagcatccaggggcagtcctctggcagttgctgtgaggggggcgtatcatggacaggggtgaatgggcttggagaaggatgaggcaccaactgtgtcccttagagctatgctgaggaatgctcccaggtgtatctgtcctccagagctcctgcaatcagccctgtgttcttgttcccgattcctgtgtgcaagaggcttcttcttgtcatttaaacctcttcttcagcccaggaggcccccctctcagggtcagttaggcctggcaatggccatgagctgtgggccttttagtctcgagtgggtaatttacttctcaggggatttgaaaagattgcctcttatgtcaattttcctcgggctctgcaccagcaaagtcacctaagggcgtccccctgcacttcccgcctcttagtgccaggtatgcagaatgtgcctgatacatgttccttaattatgaggaagatggagaggggatacttacaaaattagaggtgattaaggtcattgaagggtcaccatttggggaacattttcttccagtagaagctttcatattgcccaactgatttgccgttaatatgagcagggattttgttttgctttgtttttaatctttgtttcttccctttgcttctatataaagggagtttatagatgtaaacattctagaacaggatgcacattctcttgggtccagcaggtttatggagacctgttctccttttcacatatgtatgatttacagtaaaacattcctacaagtcacacaagcaagctcaggcaaaaatcaagttcttccatttgctggttccaacattttgtatcctaataaattcatggtgaaactaatccagctgtcttctcggaaaataaaaagtttgaaagagggctgctactattcatggccatgtaatagtttgttttatactgcatggagtcgaatagttataaacatgaaagcagctggcaataaatgactttacgacagctatttcaaaggtataatgaagaaaacaaaaagaaaccaagttattacttataattatagtgcctcagtgagttcgcacaccacactccaaacacttcactggccgtttctatgtgatctcatgcacagtctcctacaaagaaccttggcctttgggtcagttagccttgtgggtgggatgggcactgtaatagtgtttgcacttttgaatgcagtttttgaaggagacggcatccttttactatattcacccatgcgatggggaaaaaaattgaattattgactattctccactgttaaagagattttatattgaaaaaaactttaagaggagcaatttggtagtatttttaaaattttaaatgtgcttcttctttaacctaatggttaagtgggttaattttatttctaggaatagatcctaccagaatatattaggtagaaacatctagagtgttggttgtaacgctggatatgggagttcttgcctggaatcccagcactttggcaggccgaggcaggaggattacttgatgctaggagttggagactagcctagatagcatagtgagaccctcgtctttccgaaaacttaaaaaaattaaccaggcatagtggtgcgtgcctatggtcccagctacttgaaaggctgaggtgggaaaagtttaatagtttcagtttgaggccaaagtgagctgtgatagtaccactgcatttcagcctgggcaatagagtgccgtccttcctctaaaaaaaacacaagggtgcggtggctcatgcctataatcccagcattttgggaggctgagacaggcggattgcttgaatccagaagttagagaccaacctggccagcatagtgagaccttgtttctacaaaacatgcaaaaattaaccaggtgtggtggcatgcacctgtagtcccagctattcaggaggctgaggtgagaggatcacctcagctcagggaggctgaggctgcagtgagccataatcctgccactgcactccaacctaggtgacagagtgagactctgtctcaaaaccaaaacaaaacaaaaagaatatgggttgccaggttgcatgttacagcaaaatttacacacagcctacatattcatcaatgtggcagtagttaaataaacatagtataatcataccatagactagaatatgctattagaaacatatgaggtagatcaatatacactgacattgaatgatctcctaagacctactacatgaaaaaaggcaagttccagaacataaaaaccaatgtaagctccaatttgtatagaagaaaaatatggcgatgcttgtatagatcttataacttaatcatttattcatttatccacacaacagatatttattgagttccagacaccattctaggtgctggtgatacagcaataaacaaagcaaaggtcttcctgggagtttgcaactcaggaaagagggaattgatgttggggagactgtgaacaagcaaacaactgtgtgtcaggtggtgatgggagttgtaaagagatacaaagcaggctaagcaatagagagtaatttagctggaggctaggaagacctcttcgaggaggtgacatttgatcaaagatctaaaaggaacaagggagaaaaccagggagtatttgggaaatggagtatgccagacagaggtgacaacaaggtcagtggccctggagtagaatcatgctttgtgcacttgaagaacaaaaggagaccaatgtggctggaactcaggagcaaggaaaaagtggaagggaggggctaaggaagcgaggattggaggttatggttgtgattttgaattttattaaagcatgatgggaggtgattacagggttgagttgaggaagaggacatgacactatttagtctttaaaatgtaaatgaatgcagcggaaggattctcactctactcttggcagtgatggcctcaaggagggtgttctcagcgaattagaggagagaaagcgtgtggctgtaagagaactgttctcactgagatctgcctatacctgtcttgttttagccttgtattcatgtgttatttgtgtaattaaaaaatagaatcaattactctttatacgagataaagaaatcctttagtattcctttctgtgaccttggacaagttttctttcttagcttttctcttctccatgtttatagaaagtgggcaatctgtttttgatcacaggcttgttcatgggaatgaatcagataatgcacatagagctctgagcccagtgctcagcacatttcggtaattcaagaaatgacaacaattattgctgcagtgctgctgcctcccatgtccaaacactgtgaggcattcaggatactataaaattgcctgtctctctatcacctttatcttgagctatagagaaggataagaggctgtttcatagcatcacagaatttaatagccaaataagccatctagcccagctctgctccttttatagatggggatagagaggtgctgaggggatatactgttggctcccagacctgtagctagtgagtgacctgtgcttgtgctttccatgtcaaatctttatttcctgcattggtattttcctaactttggtcatttacattccatcttctggtttacctaatattctaattgactctttaagcaattttattttcaaaggaaactttgtatcattgtcataaatggaaaacaagcattacttgttatgatagattataataacttatagttttagcatagttatatcattgccattactacagtaatgctatataaccagcactcaaaaactcagtaatgtgcaatagtaagcatttcttgcttacatggctatgggttggttggggcacagctgatctgagactgagtttactacatctactccacttgtctgtcagcctccctggaccagtagctacatgaggcgtgttcttatggtatagtcttctcattgttctcctccaaagacaggaatttaaaagttgaaacctaaatgtcacgtccattattatcccattggccaaatcaagtcacatgctcaagtctatcatcagcgggatgaagaaaaatatatcccctctgtcttagtcagctcaggctgctataacaaataccatagtctgagtggcttaaacaacttatatttctcacagttctggaggctgggaagtccaaggtcaaggtgccagcaggtttggtgtctgtcaagagctcttttcttggtgtgtagactgctgtcttctttctgtggcctcatatagtggagaaagagataatcttcctggtgtctcttcttataagagcactgatcccattcatgagggaagggctccacccttatcccctaattacctcccaaaggctccacctcctaatgccatcatattgggaattaggtttcagcgtatggatttagggcatggacacaacattgcatttatactactcccctcgtggagtgtcttactcggttcgggatgcataacaaattactatagactgtgatttaaacaacaagcatttatttcttacagttctggaggctgggaatctaagatcagggtgccagcatagtcagattatggtgagagccctctttcagggctcaagttgcagacagccaacttatccttgtattctcacatggtggaaagaagagctaggtagctctctgacctctaatgtcctctagtggcactaatcccactcatgaggcctccaccctcatgacctaatcacctcccaaaggccccacctccaagcaccatcacagtgggaccagagcttcaccacgtgaatcttgtgggggacacaaacattcagtctattgcagaggaactgcaaaattatatggtaaagggtatgtgtagaaggagggatgaagacttgggaaaaatgtaaatatcacatttaaatgggtaatgtccatctgtttaccacctcaaaatatctttcatactcctagagttaggcataccatggtttgaaaatgctgaagtatatactgcaccctagttaacggcatgatggcacaacccactatgctgataaccaacatgtagagaaaagagtggggccaagcacagtggctcatgcctggaatcctggcactttgggaggccaaggcaggaggatcagttgaagccaggagtttgacactagcctgggaaacatagtgagacctcgtctctacaaaaaataaaaacaaattagccagatgtggtgatgaatgcctgtagtcccagctacttaggaggctgaggagggagaatggcttgagcacaggactttgaggctgcagtatgataggactgcaccactgtactccagcctgggcaacagagtgagaccctgtctctgagaaaagaaaaagaagggaaagaatggtattctgaatttcattgtttctaagatgcacatgttctcatattctaacttacttgaactaggataactcttatatttgaggtgttttacaatcacacatagttgtgatgaagcttctctgcctatacacatacacacttggttgtcatttctggcggattggctgggcaactgccatcccttgactttcagctaaccaaccaattaggggccgcctgaggaggaggtatgtgtcttgactgttgtctgaaaccctttgttggaagctctggcatgaaaaaagaaagagctacgcgcaaaactttcagagagggtggcagtggtttggaagaaaagtgcagagccaacagtgggtcagtcattaaggactggagcaacaccatcattcttgagggtatgaggataaaactgtggaaaactcctatctatgactctgagttgaaaagtgattcataagtactggatcctgaatgtgaggaagttttaggaaacaaacaatttatctcctttttatccatgctgtagaggaagatgtgcttaaaaattatctacataaatcaacaatagcaatttcaatgagtatgcaatgaaaatcctaaatgataagaaagcatgtgttatattttaactggtggagctttctcttcttagtggtccacaaagtaacacaaaataatggtgtttcttacaattgacagcttgcttgagtcagtgaaatgtgatatataatgaaaaacacttaaatggaaggtatatcaggtagcatggttttgcttgcaaataatgggaaatctaactaaaactgactaaacagtaaggaatgtgttggctaagcaattgaaaaattctagaggttaagagcactttacagttaatttacaccaacaggtcaatggtggtcaataaactcttcatctttctattcttgtggctatggaggggaaggtatgctgcttatttaggtcagtcagccccttccgatggagctgaaggtggagtcatttctacccagactgcaagactgctgtgtaaaagtggatgggatgacgatggatgagcaagagagaaagaaattcccactttgcaagaatgcctaaactgagaatcaagggtcagagagaagcaagtggtagggatgatggcttagggtttattgtgtatgttttgagacactgttagggtcaagacagagaaggctgaggagcatttccttccttacccttaaattacttagacagaaagggaagaaatgaagacggactttcaagggaatgggagacagagtctacagccttaaggatttcagtgcttttcactgcggaaggccgcagggtcctctgcctaggaaaaccagagacctttgttcacttgtttatctgctgaccttccctccactattgtcctatgaccctgccaaatccccctctgcgagaaacacccaagaatgatcaataaaaaaaaaaaaaaaaaaggatttcagtgtttttgcaaatctgcttgatatcaacatgttgggctataaaagtatttcccacttggtggcccaacctataatttcacataagaaaaaattctccactcttaagtcaaatttatttttatttttattttttaagacacggtctcactcctgtggcccaggctggagtgtagtggtggaatcatggctcactgcagcctcaacatcctgggctcaggtgattctgccacttcagcctcctgagtagctgggactacaggcatgtgccaccatgcccggctaattttttgtatttttagtagaggcagggtttcaccatgttgcccaggctggtctctaactcctgctctaaagtgatttgtctgcctcggcctcaaatgatttttttttgttttttgtttttgtctccctagaatttctgatggctgggtgctcaggcctgattagcatggagacatattgctcctgaagtttgctgaaaggagaatctggaggctcacaaatttggttgctaatgtcattctccaaattctagaggtgattgctgagttatgtgcaacacctggcatgggttttggtacaatttatcattcctccatgggatagtatttgcatggaaggtggttatattaaatgcagctttgaaataaagaaatctcatgctactcacttctgatggccccatcagaagtttattatggcagagaacacaaactatgtgctgcaaaagttgttagtttgcttgttcacttgctctttctcaatctctctctccctgtctctctctgtctgtctgtctctctctctctgagtaataaaaaatgattaatggagtaggcttagtttagatgaattctgtgcaaagttattttacataaaatgaatttttttccacaatactctatttccatctctgctttatcattgcctttttgtttgaattaatgcaataatattaccaaagtcatcctccattacactaccatttgctcccacattcaaggcaacgatgtcatttccagatgaaactatttgtccttgttaaaacagacaaggcagttggtacattcagactcaattactaagttgcatgattgattccaagacagaactgagagctaaggcaaatgaaacttgtcattaactgtgcagtatgtttttcttctgctagatctgataggagaaagattcacatagctggatctaagagggaagcgaaagggagttagcccagatcagttcccagaaaacagactctaagacagagtttagaatgctagatgtttattaaggagtgcccttaatcaatacctggggaagagagagagaggaagcaggagtaggctgaaggagaaggtgagctggatgtagacccaatgatggaccctacagacacagtgaggaactctgaagctggaaggacccttcagtgttgtactgatgagccaaggtggccaggccttataccacttcattgatcagttactggtgtgaactgtcctgagcaggagcatgattctgggtgaggtggctttttatagctgaggcagtccttgaaaatgttgatagttgaaggctgtctgctgggttctaggtcctagactcaaggtcagtgattctcaacaaggggtgattttttccccctgggaacatttgacaatgtctagaaatatttctgattagcacaactggagagatgctactgatatctagctggtagcatccaggggtgctgctaaacttaccacaatgcacatagcctccaagaacaaagaattatctggtccaaaatatcaatagtgctgaggttgggaagccttgctctggagcaacagaacctggtggacatcacagcatccatgccaggagtcatcactaatcaagatattactacttctcagacacaatgctcatgttctttatttctcttactccttctacaaaccctttgaggcaggcctcagagtttccatttactaaagaaaaaagcagtgctcagagtagttcagtaaactgacccacgttatgaattggaaggacaccaagatgtgaattaaagtgggccatcttgttgaaaacattttgctatcttctggctttccctttgaaagagttcagaacatacaacccaaaaatgtgcccctctggcacattgactattttgagtcaaaggcacgtaaaaaaagggcaggtgcaagaagaacactcttgcagtcctttttaaaagcaggagataaaatttccagttgaaatatatcctccctgtactagaagaaaagtgtcattcttatcatcaaggatgggaagttgaggtcactggaaatctgtccaaacacaccttgttaaactaactcttgtctttcttatcacttcacccaattaactaccctagcccaagcccctttaccttgtcacatcttcataatctactactctttgtccaatttagtatatgtgtttaactttaactgcatctttcagtcatcattttcttatgaagcctccaatgccacatacaacttgaattaaatacatttgtattgtattttttttcttgttgatctgtcttgtgtcaatttaattatcagccacaactgaaaaactctaggaaggtagaggtaaaatcttgccttccctacaccttgagggctcaatgcagaggttgtcaaacattttttttttctctccagacatgagatacatgatgctcacatgttcagtttgctcccatggaattcctggggctcaagctgtaaactcacttttatcctacttaaaaggtacagtggaacatgactggcatggcacaaatatggggatgaatctgaatcctctctgatttgtatttttaagtagactgttcctgaactctgagtcctttctaatcgtaacaaatatatagtaagcttgcagttgattttcatacggagagtaacgcctattgatagtgttggtgaatgcctgtaaagagactacatcactttcagagtctgtgttacactgttgcttcatgatctgtatcactgaatgattaagtcatttaagaacattcttcagatgttattggcacctcaagaaccgtcagaatcaaagcattgactcataaatttaatttaaaaagagcagctactatgttccagaaactgttctactttctcattataaacagtagaattcactattaatagtaaaggcttccacaggagcagaaaaaagcatatatcattttacagacatacagttgagcttaacaaagtcaatttgtactctctctgaaacaaaatcacataaattttgacgtttttaatagagcatcatgcaaagggaataaacaaacataggctatgcaatagtgttaatagaaataaaaggcagtacacatttagccaaaagatataaacaaaaaggacttagatcttttattattattgacctcaatagtaatgttagttattatggtccatagcagctgcagtttttagattctagcatagtgccagtaacttaaaaaaaaattctgtcattaattccaacagcacatttcttttttcactttttattttatagatttagggggtacaagtgcactgttgttacatgaatatactgtgtaatggtgaagactaggcttttagtgtaaccgtcactctaacagtgtacatatactgtacccttcaggtagtttctcaccccttgcctccttccacctttctgagtcttcaatgaattattctactctctatgtccatgtgtactcattttttagctaccactaaaatgagaacatgcagtatttgtctttctgtgactgagttatttcacttaaaataatggtctctagttccatctatattgctgcaaaacacatgatttcattcttttttgtggctgagtagtattccacctaccatcttttctttatccagttctccactgatggacacttaggttgactccatattgttactattgtgaatttgtattgtattttttttcttgttatagatagcactgtgataaatgcaggaatagaggtttttaaaaaaataataatttcttttcctttgaggagatactgagcagtgagattgttggatggaatggtagttctatctttagttctttgagaaatctccgtactgttttctgtagaggttgtactaatttacattcccaccaatagtccacaacacatttctgtatggtgggcattatcttccttttacaattgaaaaatacagaccagaaagagtaaaacagcttggttgaatttacacagaaatcccttggcagagaaagttgccatacccagaccactttctatagctagaaagcctaatttagagtaaaatgtacatttatatttgtcaattcatttttttcaatcaaattctctgaacactgctaagcaaaatatggcataagcagtactgtgctggtaaatgtttaaagactggctgtcaaaaaaggggtacatattatataagcttcttttaaattgtactgacataaagaacatgtagcacacaatttacatataataataaataatatatgtaatactctttattatacattctaaatagttttttgattttcacagaatgcttttgttgaattttacctaaaatgtgtatcaatagccagtctgtggttttaactgtcccacaatatgggtcatgaatgttaattgatgttttcagattttaagcaactgatgtgacatcaggtaccatggagctggaaagagagacttgtgtagtattttaccatacacatacgacagacacacataatctcaagagcataggtaatagtcaaatgtgcaaagtaattagaaagggatgagttctgactattggttatctgtgttttgatataatttatttcattgtaggtttatataatttaatttcttaataataactttaacaattgcctcacaagattcctgaaaacttagcagttggttctcgtgagctgatgtaactgctgatagggaacagttaccagttaatcaaatatccccatttccagtgtcccctactccaactcatagctctgaatatgtaagtagagggcatcccattatcaaacaaaatagatgttgagaaagatgatgttgcgtagagttgtttctttaatattcattgttatttttgtggtttattcacaggcatttccctgcatctcaacaggcatttatggtaagtgatacagcttttgatgatgtttgtatttctttattttgctgttaaatgcagagattcagtgaaaaaataagaggttctctgatgaatatattttgctgtgatttagagactaaaaatgctcgtcaaatcccattaaagaatgtcatgaggctattcagattcttttgggttcttgaatttggttatatcgggtatcacatgaaattatttgatacattgtggcttgatgtcttttgttaaacaaaaaatttggttccagtaggattgacttctaatattgctttgtttaatgaaatcaaatttcttctcagtagaaagcataatgtacatagagtttagcagtatcattattttgttgctatttacaaaataatagaaaaattaaaatgcatacatatgcatatatctgtgttttcaaattttaaaaaagtccaaagaagtgacttttactaaatatgaagaattttaataaactgcaaatttttttttctgcatagtgatggattgtgttaagtagtgaatgcctcacttacagatggaagcaaaatgtttcttaatcacttgctttcactagcctaaagctctctaaatattcttccacctacctacaagaacttttttatactttttttcagaccattaataagtctgttttataatgttaaagattttctgatctaagtgaaatagattacattctttctgaacttaaacttctcacatggaagctgtcagctgaagcacaaaatatgtaaaaatctaacatatatgtatatattttaaattcattattacaatgaaggactacctagattgatgtcaaaggtaggagctttactttttttcttcatctggtatttcttttgaaggtcttgagcaaaataaaatgagaaatgtaggcctgaaccaaattaagtgggaaaggattttgtcacactatttaaaaatttaaggtttcctccttcaatttaagccttcttcctctccagattcccctacagcctgtctttgtggaaacaggatgagcactgggctggagggggctaaactagaccatctgcacaattatccccatcatggccattctttctgcctcacaaatgcccaataacaaaccttaaatatttgcttaaaggaagtattatgtacaaagttatgcctggcaaataccctaactctttatttcgccttatgtagagtcaaaccaaacttcattgcagaaatggtttttattatgaaaatgttctttcattgcaatcttgattttccttgccaaaaaaacaaacaaaaacctaatgcctacaccaatactgtatacatcattttctatgtttattaccttgtcagagagttgaagtatgttttacttctgagaatcttatggtaatgtgttaagagcttcaaaaagggaattgatgtaatatatatggtatactataagtaggggggtggtgggaaaggaaaacagaaaagcaaaggaaaatagggaaggaccataaaattagaggctccaatatgatcatgtcaatagatgcagaaaaagcaattgataaaatccagcatcctttatgataaaaaccctcaacaaaatgggcatagaagggacttacattaaagtaataaaagccatatatgacaaaccaacaaccaacatcatactgaatggggaaaagttaaaagcattccccatgagaactggaacaagacaaggatgcccattttcaccacttgttttcaacatagcactggaaattttagccagagcaatcagacgagagaaagaaataaaaggcatccaagtcaaaaaagcagaagttagactgttgctgttctctataatatgatcatttacctagaaaaccctaaaactcacacaaaaagctcctcaatctgataaacgaattcaggaatgtctcaggataccaaatccatgtacagaaatcagtagcactgctataaaccaacaacaaccaagttgagaatcaaatcaggaactcaatccctttcacaagagctgcaaaaaaaaaaaaaaaaaaaagataaaatatttaggattatacttaaccaaggaggtgaaacatctctacaagacaaactatgaaacactgctgaaagtactcagagatgacacaaacaaatggaaatatatcccatgctcatggatgggtagaatcagtattgtgaaaatgaccatacttcctacagattcccatcaaaataccatcatcattcttcacagaactaggaaaaaaaagctgaaaattcatatggaaccaaaaaaacagcctgcatagccaaagtaatattaagcaaaaaaaaaaatctggaggcatgacattactcaacttcaaattatactacaggtctataactaacaaaacagcatggtactcctataaagcaggcacatagaccaacagaacagaataaagaatccagatataaagccaaatacttacagcaaactgatcttcaacaaagcatacaaaaacataaattggggaaaggatatcctattcaataaatggtgctgggaaacctggcaagccacaagtagaatgaaactagatcctcatttctcacctcacacaaaaatcaactcaagatggagcaaagacttaaatctaagacctgaaaccataaaaattctggaagaaaactcttctagacactggcttaggcaaagaattcatgactaagacctcaaaagcagatgcaacaaaaacaaaaataaataattgggacctaaattaactaaaaagcttctgcacagcaaaataaataatcagcaagcagacaatccacagagtgggagaaaatatttgcaaactatgcatctgaccaagaactaatacccagaatctataaggaactcaaacatatcagcaagaaaaaaaaaatcccataaaaaatgggcaaaggacatagacaattctcaaaagaagatatgcaagcagccaacaaacatgtgaaaaaatgctcaacctcactaattatcagggaaatgcaagttaaaaccacgatgagataccaccttactcctgcaagaatggccataattaaaaagtcaaaaaacaatagatgttgtggtggatgtggtggaaagggaacacatttacactgctggcgggaatgtaaattagtacaaccattatggaaaatggtatggagattccttaaagagctcaaaatagaactaccattccatccagcaatccactactgagtatttatccagaggaaaagaagtcgttatatgagaaagacacttgcacatgcaagtttatagcagcacaattcacaattgcaaagatatggaaccaacctaaatgcccatcaaccaatgagtagataaagaaaatgtggtatgtatataccccatggaatactactcagccatgaaaaggaatgaaataatgtcttttgcagcaatgtggatggagctggaggccattattctaagtgaagtaactttagaaatgggaagtcaagtattgtatgttctcactttgatgttagaactaagctatgaggatgcaaaggcataagaatgatatcatggactttggggacttgagggtgacgggtgggaggggtttgagggatgtaaaactgtctgttggatgcagtgtacactgcttgggtgacaggtacgccaatatctcagaaattaccaccaaagaatttttgcatgtaaccaaaaaccacatgtacccccaaaaatgttgaaataaaaatacaatttaaaaaagtttaaaaaggcattttacttaatcactataatacaaaaaagcagaagaaaacacattttccaatacagtagacataacttaaaaatattcaagtatctcatgagatctgtggtatatttatgtatctataattcattaacaattcatctttcacttaataataatatttatttgttccacacacaatgtaataatttaaacacacacacaaaagaattgttagatcatattatatggacatgtttaactgtattgtgaaataccaaactgttttctaaagtgattgaatcaatttatactcctacccactctacccactccatttgaagatcaccatgttccctgtcctccccagtgtttggtattgccagtctctaaaattgttgccaatttactgagtgtgaaattttatcccattgtggtttaaatttgcattttcttgattattaataaagtaaactttttaaatatcaaaaacaaaagagtctccagagtggacagtaagaactaactaaaatctagagtggatcatggtccattttaatctgtgaagaatagggatttcaccctagagagagtaatgtggttcaaaatataataactgattcagtacaccattgtggcgaatgggagggaaatagtgaagattgtcaggcatggcattaatagtgtgagtcacattagctggcttggagggctgtcaccaggcaagtttagtcattttcacaatgctaggtcaaagaaaatacttcttcagtcctggctacttgtctctttctcctctgttttttggtaaatttacaagtgagactgatatacacaaaggtcgcatgccatattgcttttggttagtccccctggggttgaaacctaactttccttttagcttcataaccttctgtttcagtaactttagattgctatgtctctgtggtttatagaccattcagcattatgcaacttgaaaattacttcatatgtcctgcattagtccgttttcatgctgccgataaagaaatacctgagactccgtaattcacaaaagaaagaggtaattggactcacagttccacatggctggggaggcctcacaatcatggtggaaggcaaggaagagcaagtcacgtcttacatggatggcagcagacagaaagagagcttgtgcagagaaactcctgttttcaaaaccatcacatctcatgagacccattaactatcacaacaacagcaaagggaagacccacccacatgattcactcatctcccacttagtccttcccacaatatgtgggaattatgggagctacaggaggagatttgggtggggacacagagccaaaccataccatttatggtttatagaccattcagcattatgcaacttgaaaattatttcatatgtccctggtgaagttacagctttctcagtccttgcttctttcccaggatctgtgtattacagactagttttcttgctcttatttgaagccctcttcctccttcattaaccagataagttttctttcatcttttttttattagggtttgacgtaatattctatttaaagaaagtggtccatagctgaaaagaaaaattttacaaagcaaacacaactcccaacatttttgtaagtcatactagaatggaggtagagaaggtttttagaatcatttcctggtggcactctttttctttcttgttccatattccaaatctcactagaattgtttttctaaaataccacttggtgcgtgcttcccatctgcccaggagcctttgctcatattctattgcttgcagattgatgttcactcttcctagcctgaacaatgggcactttctatatctccataaactagtgctttcaaaatgtgtgagagggagggaaattggtgtgctaaggatgtaaattggtgtgctaagaaatttatatatgccttttcctttgcatctttaaaagggggatttaatttatggcagttcttaaagttatttgatgatagaaactagtatatcctcaacatttctctggactatgttttcttcagaatatagtttgagaaatttcttggtacccattcatcatggttatatcttctgtgacccacatgtacatgatctgatgaatataagaacttgccattgcacagtgaggtccaatcttgggtcccttcctgaaacttactccttaacacctcttccccaatgcacacacaccaaattcgcacataccatcaccaccagtgttgtctatctcatgccccaaacagaaacatgccaagcacatttaagcagactgaaacatttttaaaaagttttattttaggtttgggggtacatgtgaaggtttgtcacataggtgaacttgtgacacaagggtttgctatacagattagttcatcacccaggtattgagcccagtgcccattacctttttctgctcccctccttcctctcaccctccaccctcgagtagaccccagaatctgtagttcccttctttgtgttcatgagttctcattatttagctttcacttataagtgagaacatacactatttggttttcttttcctctgttagtttactaaggataatagcttccagctgcatccgtattcctgcaaaagacataatctcctttttttttatggctgcatggtattccatggtgtatatgtaccacatttcctttatccactctgtcactgatgggcatttaggttgatttcatgtctttgctattgtgaatagtgctgcaatgaacagtcacatgcatgtgtctgtatagtggaacgttttatattccaacaaaaattagccatggtagtgggcatctataatcccagctactcaggaggctgaagcaggaggattgctggaacccgggaggtggaagttgcagtgagccaagatcacaccattgcactccagcctgggcaagaagaacaaaactccgtaaaaaaaaaaaagaatgatttatattcctctgggtatataactagtaatagaattggtaggtcaagtgatagttctgctttgagctctttgaggagtcgccatactactttccacaatggttgaactaattcacactccgaccaacagtgtgtaagtgttcccttttctctgcaaccttgccagcatcagttattttttgactttttaagaatagccattctgactggtgtgagatggtatctcaccgtggttttgatttgcatttgtctaatgataagtgcattgagctttttttcattggcttgttggccacatgtatgtcttcttttgagaagtgtctgttcatgtcctttgcccactttataatggggttgtttgtttatctcatgtaaatttgtttaacaggctgaaacttgatctgcaggaagtcttccttaggtatgccaacccttggtggtcattatactttctgaaatttttttagcatttgtgtcaggacaattatcaactgcttcctcatgttgctccatagattgctgtttatatattctgtgctcacagccagtttggaatttaaagagcaggaattcacttctgcatatcctttgcacacccagtgcctagcaaagcactgtgtctctaggagaagctcagcaaatatttggttcatgacagcagtgattgtaatccaaattgttgcctaactgaagatatagaaatcagaattcttgattggcaaaataacaggtaaagaaagctacccagttggtattttcttaatgggcaaacatttctattctaggaaaaacaaatgtgtttttaaaaggcattctcaaactggaagtttgtatttgtaggtatggcagtgtccaccctgtcaaggtaaaatggaaactcaagaacttattcagttagagagccaaactaaatacagcattttacttcagttaaaatagaacccctttgtggtttattacagcccatggaacaatggtcactcaggaacatacaggtcagctggccatccaggaggccctgttctgacttctccgaatgtaccccagacccagcccatctctccagtagctgccatttctcacacacctgtttgctttggagttaccttcacttttagatttatgccccaaaagtccactgtaatcctagttctgctataatgaaattttgaggatggcagagctacctttcaaatggattttgttatttaatcactgagattattttataacaggataatttcaagagtgagcatacccatttcctggaaactcggacctcagcatcacactcacagtgtgtctggaggacctggccaggcgccagtactttgggggtgctcaggaccctggcagctctcctagctttctctccctctgcagccctatagccacaaaccatcaattgcagtgaaaccaccttagcctttttgtaaggcacagcctgaggaatatcctccatgtgattaacctgatttaaggaggagacaggatgagagcagacactgccttctttgaagttcccctggaagaggccagacttttccactctgacattcagtgagcactgttgctactccaacgtgacgtttccaggatggttccacagggcaccagaccacctgcttacactcaggatgaaaagcctcgtttggtcaaataccaaagaaagccctgtgctacttttggaaaaatagatccagatgaggctttcagggcttgaaatccctagattcctgttaaaattttgcactggcctctaaagcagtctctaaacagatctgaacctccctgatggacatttcagatctcaggcgtgctttctgccctttgagccctattttgacactctaatgctaataaatttaacaaaagaggctagacataatacatggcaatggaatttttactgagaagtgaatggcaaaaatgattttagtcaattttatgagagtcaatatagttaacagaaatcgactcctggctgaaaagtgtattccgtgagtacttaaaaatttggaaaatattttccctggaaaaaaagaaaaactttgaagtttgctttccaggtatgacgtggcatatgtagagaggaaggaatttcagacattgagttattggctgtaaatgtgaggaaaaattgaagtgcagcatagcttagctgaagcagctctcgtgtttatccaatatagttttgttatcaacgtggagtgcctgtttctatcagatcacctggtctctttctgctatccaccacatgctggcaggctgcaactttctaattgaatccctcatttgcattcaagtttgctctgcttctaactggtaaaaaggagaccagcgcaatgttatgttaaccttgtatctacttggcaaatatttttatcagtacatctgtctagagtcacagacatgacttggaaaaaaattagggcattctccaacggcaatgccaagggcatgcccttcatcagctttaaatgctgacagatttgagaaggtgtgacaatcattgctgtgcatatttacagaggaaggaagagttctcttatgtaatgcattgggaaccagagcaaaactgacaaaattatgcaccccttccttttatcaccctaatggctctcctccttcctttggcttttttctcttccctttgatatttccatttgctttaaaaacttactctcaggtggtctaatgatgactcttttcactgtcgtaaaatctctgctctggcaacctaagttttttatcttgtcaaattattcccactgtaagaaatgttatcattcttggcaaagcaaagtaacattagaatcagtgtaacttacttcccttgggaaaatgcagtgctggggccaagcctatctctatcatagctcgtttgaatatcactttatgagctaacacttttgagacagtggagagacaacttgacagacagcaaaattctggctattcaattgtttctaaccctgagtgcttatcatttggacagacaagtttagctaacattctcattcacagaaacattgatacatacatcccagaaaatatggtacagactcctctcgtgctctccataccctacccacgtctttaatattaaaatgacatcaaactaagaacccaaaggactaacttcactctggaaagtagtctcaagtgaccaactacaaaatatgctagttcagtgtacataaaaatggcagtgaaacccatgggcaggattcctctaggggacctgacaaaagagatgaaaatcctggaaacttagtttttctggaatgcagaggcagtgagaaaccagtgtcagtcttcctgatgttctgttccagatgaacaattttgggacttaattaaaagattaagtgtttcactatgcaatatatgcatggaagaaacttgtatgtgggccctctaattatataaaaataaataattaaaaaagaaaacaaaaattaaaaataattaagtgattcaaaaagtaataaagatcacaactgtctgactgtttctggggtttggatgtgcactcccttgtagttgtgtcaaggtaaaagtgattgaagcctggaaggcatcactgaattcccacccaccccttcctcagatgtatcacttattgttatgctataatttttaaaaaatgattttctgaatagacgaaacattgaaacagtaagccttttaaggaaatagaaaaactatgctaggaaattacagagccaatccattgagcagtaactctgggaatatctttcaggtaccttgaaaaataggagcactattaagaagctccttctaaagaactgttttggagtgttgaagaattgtccacacttggactttgatcactgaaataatttctacgtccttgcttgtttttctcatctagtcttgaatgacattccttttccttgctccttgtacatacttgtgtctaaagggtaaacgtaaataaacatagccctcttcaaaaagaacttcaaaaataatttgacaggtcttagagaagtcaaatgtgtttagctccttaggacaatgacttttatgtcaaatcctttttggtcaatgatactcttttaaaaatgtattgtgaaatgtatgtgaacaagaccatattagttagggtaaagttaaactgttctaacaaaaagactccgaaatagactggcttattgaatatcatgtttatttaccactctgctaacaggaagcattctgcttgtggaggatttgttccactctgtcattcaaggagccaggaatctaccatggtgtcaatgccttcccgaaggtattggtctcatttacttacccgccctggtgctggcaaaagatgtgtatatggcaagcacaccctctgtctaatggtccctctactcaaagtagcattcatcacttccactcaccttccatttaagagaaattggtcttgtgaccaatgtctgcaaaggaggttggaaaatttagtctagcttggggtctacacatctgactacaattctattacatggaaagaagggaatatcacattttgatggacttccagatatttaccacccaaagagaaaagaaaaacaaattaaatcaacaggttgctcgtagataaattagtttaggggcagtgtcagccacccgtaatgggtacttgctttgcaagaatatttggtaattttgatagcatatactttattaaaatgtctttataatgctgagtgcttacaaatttgaaagtatgaaatttttaaggcataaggacagtgatctatctttagttgtcagacactatatttagatatttagacctcacctcaattgtttacattttttggtaccaaaactccttgcaaaattttcagatacatcagtggaaactaaaatcaatacattgagaatgaatacataattgcattatttattacattctaattctggcccatttccatagaaatccttggaggcatcaatcgcaatttgtttctgcaacactctaaggctgtggggccacagtcatccataaacataccaggagtcctgagcagatatggatttacatcctgtgtacctaggaactctggggaaatgtgagtttagggcagagtctgatcatagttgagtggaaatattacagagaaagagagagaaaatgatcatatgaatatgaatctaaatctcctgggtagtcaaaggaaatctccttagaatctttagagctgaagataatagttcatacctgtttcccatttcagccgtgaacaacagggagagtttcctacaagtgactgcaaattgaactgaaattaacaaaatcgacatgaaattgcctcactttgtactttattgacctgacttcatttctaaatgttttaaatgaatccagttttaccaaaatgttcctagatcttcttaagcaattgcgtttttggtaaaatgcactttccctttacttgagatttccattctggtaattgtgacttagcttatgaaactgggctctaagttctgtcactgttatattccagcacctagctcagagcaggatgcagagtaaatcttaataaatatctgtttcatggctaaaaaatacataagcagctctccaatgtaaggaggctactggcctgttctgtccactctagagatcatactctggattcaataattactgagtctatgacaccctggtttctatttttttacttactctaaggaatgatttcattcagattttaagacgataacaggagagtcagttaataaaaatagagcctaatcttttagatgtggttaatttttaaagcggttttattaaactgtaattcacagagttgcacaacaaccatcataatctatgttcatcatgcccaaaagaaatcccacattagctgtcactccgtcccctctctctcaaccttgggcaactgctaatctacacttgatctctatagatttgcctgttttgggtatttcatgtaaatggaatcataaactatgtgatcttttgtgactactttccttcatgtagcaaaatatattcaaagttcgtccatgtcatagcatctgtaattaatctctttttattagtgttcctttgtatcaatgttccacattttgtctgttcattcaggatatgtgcactgtttctactttttggctgttgtgaacgatgtttagatgcagctcatttaagcataattacatcgctaaatatacgcactataaatgtaaaacagtggtgttctgtagttaatttttagtcttccttgctgtttccattctttggtcctctagtttctctcaggcctctccaaagctacttttgcttgatggctctggtgtcctgctggcctatgcagtgatgtaggtttcttgaaacatggtctgtatctctgtgtgtagtcagtctgtacacatcgcctcagagttctcttagagtaccaaagaacatcgtggaaggagagcatgtatcaaagtggctttgggcatggatttcaggctccgatagatctaggttcaaattctgagtctcttattagctgtgtggcctcatgcaaattgcttaatcttcctaggccttaataacctcaattctaaaatgaggttaataatggtataattattgaggttttttagtatgaggttaataatgtaaaatgaggttaataatgaggttcatataggtaataatgcctatatcatggggttgttgcaaagattaattggataatgcattaaaatgcttatcatagtgtcatatataaacacaaacatttaacaattatttttaatagtaacattattcttataactactgctgtcattattgccctgccactagattctgagttcttttagggcagggactttgattattttgttcactgctatcgcttagattctagaactctgtctatactattgaacaaatacttcactatttgaagaaggctttacttttgttctggatgataccagtcagtggtcccttatcatgagagccaccttgctttctgtttgcttgaatttgctgcttttatgaaatccaggtgtctcatctcagccacctctgagtcctgtggtatagcctgtgagttcagctgtctggaaatgaagtctgtttgtaacattatcataccacactttatacataaccactgtagccaattgtttaaaaaatagtcaacttgcttaagcacttccaagctccctaaaatctaactaagtcctaagaataaaaaggaaacattttgttttgactgtaaataaatacaagctttccataagagagagagagagagtaattatagttatttgtggtctgaaatgtgaagttatgtgttgtaagacagcagattcttacggacaaaaccaaatcatgtttctgtacatagattttaaatgcttccttccaacccaggggacccaggggagtagataacagttgccacttagcttacagagggaaaaagtccaatgcttgcgtttcgttggcccaaaatacccggaaagcttgcacagtttttcatttctaagatcataggctcttagaactgaaaggcattttggaaatcatacttgtcctagatccttattttcctggctgggaaaaatgagacccagagttgctgagtgacttggctagcaacatccaactagttcatatcagaaccaagaccaatgtgttgtccagccaatagggtgaaatagcaaggggagaggtctgggaatcagacaatcatgaaccccaggatggtccacttgctgacctcttctttgaactgtagttccaagcttcctcatatgttagatgggaacagcattaatatacaccttctgctattagaagaaaagaaaggatttgaattgaggcttttccagaactgagtagagtgccaaagatttgtgtcaataaatgtcatgatggcaatactttctctaggtccccattctctcctctgtgtcttcttctacccaaactgctgcttctagccaaatcctgtttatatggactaccccaccttcagccattgggttcatcatcagtgacttctgaagactgactgaatatagaaaatacctgcacacccatccttctatgcatcatatcattgtttcttcctctttatcatgaaagatcctttatagttaaaggtgatgcatctgtatcctcagggtaccaaggcataggcagcctgtgcaagggaggatttttgttcttgttgaaataaaacattgtattctaaagcagaggcgttttgcaacctcattcttaaaacaaaatgcttaacattactcactagttaagtaattttatggccctcccccaataaatcttgtacatgaaccctcaggaaggtgcacatcccgtggtttatggtgcctctggcacactgccaacaccccagtttgaaaagccaggcattcaaccaaacttgcgaacgccagcccttgcatataattacaggaacctgtgaaagtgatcaccggcagctcaggggctccaagcttccgcaagttctgaatcccttagcaagccggaaagatctgctggcgctgccgtagggaaaggttagcatcctaaattatggcctttcaattttttttcaactttgcaaatattttatcttctcatccttagtgaaaaagatagaagtgcacagttgctgttttcccatgttgtttatagaaggaaaggaggtctcaacagctttttccatccttcataaaacaatgaaaatgtgcctcgtggccaggataaaacagtgatatgcatcgagtgatccaggaaatgtaaaaatacttgacttgaaagactttttaaagatacctctgcacatgttaaaggcagtggcagtactgggacctaagagtgtgcgtgtgtgtgtgtgtgtgtgtgtgtgtgtgtgtgtgtctgtgtgttgtataggaagtatcccagtgcagttcttctccctacaggcctcactcccaactacctgtccagcctaggaagaggtaaaaaataggaattgtggtgagcatgggaaggtggtgaaggagacaagcaacaagagacagaaatgccaagaagttaaagcaagctggctgcaagctatggcagggcaacaattcctgggaaggcagagcctggctagcagaggagctggggcctgcagattggtcggtgcctttgctttcctgctgtttccacttcgtgttctttgcctcctcttcacactaccaactccttccacttcacacgttctatctcaagtgaggcagtgcccatctcaaaggggccacagtgttagagctgctaaaagcaactaggtaagtgggaagatggggttcccttattttcctaccaggctctccagccccagggctgccatggccacttctccagctcccatctcacttcctaccctaggcctgccataatctccacccagctttctttccaggagtgaagtccagtgtccaatcgagttgccatgctggacaaactgaccttgaccttttctatcccagtgtattatcttgtctctagcagtagccatccttaggaaaccccaggaaatgctatgtttgcttaggacactggaaacatggggtaaaatcaatgaagctgttttgtgttctgccgcagggtgaagcaggaaagaaatctaatgggggagtgactcatggtaagagatagtggccctgtctctcaggctattagaaggtaccaaagaggtgaatacagactggttcaggcctgtgtaaagcccaagtatttatccttgtgagaggccatgacatttttcctccagttccccaccctagaacctacactcttctaatccccatcccatctctgcctcccctttccttggaatacaatgttacaggctatggaattcaccattagtaatgtcaagttgtggaacttccattccttctgcttggaaggtagaaggcaggagagttccctaggagtggagaggagatgctagaagcccaatccaaaattccaagaacatttttcttaggatgaagactaccagcatggctttcaagccctagagtggtcttaccttgtgcctgactctctttcagtctgtcctagcaggcattttctctgctgtttgcatcctcagcctgcagaactcttactgcccatcttcagctggttaatggtggttaacaagcaaggcccctggagggatgcttgccctggcgtccctgagcagatcaaacctccttattaccagctctcatggtgttacatggctgtccttcatagcccttaatacaatcaaagctttatatttattggggtgattattttatcaatgtcagtgtctggttttcctcaccgttatgtcccctgctcccagcacagtgtttgacaaatggtagagagtcagtaaaatcttgttaaataaatgcatacatgttcctgtaaaaaaagaagcactatggtctatcttcattataaattaagtcacttttgggcttgtcctgacaacaaaattataatgcacagtattatcttgtgagaatatgaattataagtttcaaataatcaagtgggaacaaacagttttgaatatgaacaacatgtaagttagagttcttatatttaattctagggatatgtttatcttcttttcttataggacatacaaccaaataagtgttttgtcttactataaagatccaggattttgatgtttgcattgattatccttacagtcatcctaggctaacagttctgcaaatggtcatcttttctcttagggaccatccctaagaccttgaataactcagagcagataatcaaactatctaatgatcactgagatcatttatgcatcaggatttatcaataaaaaataaaccctttgaggtactaattgattttttattcccatccccaaaatggcagctcattagtgtctagtcaccagaaaactggggaccatgtggcatccctgtcccctcaccgtctaatatggcacctgttccatggaacatactgaataaatactcatggcattgaaatgaatcacacctatccctcactgagccttggctaataattgatcagagagttcatgatcaccacccatccttgagagggctcctattaaaaacagcagcaacaacaacatgtgactagagcatctgaacgcttatgtagcactgacgttaacaaggataacaggagcttgaggggcattttttaaaaggagtgcttttaatcattaaagtgagatacgcacatgctaaaaaacagtaaagcaatataaaaagtcatcaaatggtaaaaatctcttcccaattaaaaatgccagtatccctcttaagaggcagccactgttgagtttcttatgcattttccaaaaaaataatattcacttcatatataagcctataaatataaccaaattttcagtctttttattttcatggtttccaacttagaaaggccttctatttcaagattatttttaaaaattaacccaggtttcttctagtgatctagtaacattttaaacatgcacagaggctggacatggtgtctcatgcccgtaatcccagcactttgggaggccaaggtgggcggatcacctgagatcaggagtttgagaccagcctgaccaacgtagtgaaaacccgtctctactaaaaatacaaaaattagctgggcatggtggcatatgcctatagtctcagctactcaggaggctgaggcaggagaattgcttgaacctgggaggcagaggtttcagtgagagcaaagattgcgccactgcactccaacctgggtgacagagtgagactccgtctcaaaaaataaataaacatataaaaataaaataaacacacacaacagatattaagccattgatttatgtatatatgcatatatacacacaccatacaggtatacatagatatcacacatatatacctgtatgtctatacaagcatacatatacattatatacactgtatattatatatagtatgtttacttgtctgtgtgtgtacacatacatatagtgaagtatatacctaaactactaaaggagaaattttatatatattacaaaaagttataaatgcatgctcttacctatgtatattggtttgaagaaaaatataaaatacttaaaaaagattttaggagtatacataactttaaagaaacatataagtactgcccatttctttcccaaatgatacctatttttataaatttctttagactcaataattataaggtaattttttatgattaccttttatttatagagatatatattatagttttaaatgcttatatgtacacacgtattatatacaataaaaaatgtattacctattttgtgtgtgtatttttgtgtatgaatgtgagagaatgtggtgtgtgtgtttctatatgtcagttttaatatagtctccaggcagattttaggactttatgactttctttttaaaccttctgtctatggaataattgtgttcattgcttcatctatttcttgcaaaatagtgacaatgagctttctcccactgactaaaaccagacctgttccacccattcccaccccacaaatgagcaagtcatgtaacatgagaataaattaatagtgaagccctttgacagttgtacctcaggtgcttctgatgtgcaatgacatctctcagaattaaacctaccattgtcagtttgtcaacgattttctacaagtacaaaatggaattgcgtccatctcactcagatttggaagcaagtctgattatgggacatactgggcttgacaagctaaagacagatacagacattttctcatttatgaatctattcctttgggacattgttaaaattttaaaaaggtcgtatcttctaggaggggataagtaacataagttattttgcaatagctatcaatgtgaaattttgtattgtcttttggaagtcagaggaagaaagatgggctgcctcggtgcattttccatttgcccgtgattagcatgttctgaacatctcagtgggagtcagaggtatgcttctctttgggttttttcagtgtgaaggatggaaggaactctttcacacctttcatttgcactgttaagacttacatcagaagtacaaagcattttaaactgacagaataaaaagcaaacttcagagcaactttcctgcctatggtgctttccaaggatctaagacacatgagcaaatctcctgaagggtggtaaataaaaaaaaaaaaaaaaaaaaaaaaaagagtcacctttggccctttcttcatctttgaaatacactcgagaatgggctctctccctctgaggctaaatccagtgtgccctggagctgtcagacctgcagaaaggccctttttgccaagcagtctgagagaagactagcggtaattggcaatccagttctccatttccattgtacagccatccctgacaaattaatcacaatcaaatgttggctgcagcaaggggcaccctacacagcaggaaagaaaaatgaggcctcacgctgatctgacagccgaatctttcaactcaccccattagactgaacaaggggacgctgtggtttgcctgtcactaccactacccataaacaaactgctcgctctgcatctcaggacttggtggatccagtaaggccttccttggggcccaccaggtatctgaacaatcagtgcttcagagaaaggggaagggcctcatcctggtgagaaagaggcgctagatagtggcatagtggcataggagactggtgaggacaccgtggcccaacagaatcctgaagtgatgaatctcaggtttgacagtgggttgaggtctgctgcaggctgtaacggagtgtctgtctgtgcgcttactgctcacctgttgtctatcagccatcagtcaggtagtgagaaatccagccctttccatccactgtttagagttcacttatcgggcaagcttctttgttcaacataaaaccaagaatctgaaaataccttaaaatgttatttatatacttgcccagtctctgtagtaaagtttataagccttagtcacagaagagagtctgaggccctcactcttattttaggcataattttaacaagtgtgtcacagcctatagcaaattagaagatggcaggaagatcctgagaggtagatgctgacagtaaacagtgggataatactgaaaggtgacccaaaaaaagatagataagtttgtttccctgcctgccagtagaatataagagaaaatcatattttgaaacgcttggtcttttttaaaagacaaatgcttactctttgtaaaagctgtgtaatgaaatgtccccgtgatgttagatctgaagtggaagagtctctcttctctcccatctcctctgtaatattcaagatgtggtatataactgaatcacatcaagcaagaataataacgctgcctctgttctgatcaagtttacccttactccttataactgtgggcagtggcattcacggctctgccatctggctctcacaaaactcagggccaggggcttgtgggtaggtggtggaatgttctaattcctggagaagatattattattcagactgtataactgaatagcatcagtttctctaagtttttccatttcacctctcccagacaactgagtataaagaagtataattaaaatgttggctttcataaatgttaaagccacatttaaaacatttctcatctctaatactaactcagaaaactacttttctccctatatatttaggactagagattttgtcaataaaaataatggagaggatttgaggtccaaattaaagcaatgtatttcccagaactaaactgagtgtgtcagtggcttgtccaaagtcttgtagaagccagaccatgaacacagcatcaggacctgctgtttagtctttattcagaggcacataatttggtgttcttctgatgactggtttgtttttgtgggaataaaaagaatacagctgaagggatgtacctgaattgctgttttcccctttctctctctctctccctgagaaagatacataataactttctaaacctgctccagcagtctaaagattccagtgctcattggatcatggatttctcattttaacctttctctttctccctccctccccctccaacctcctattcagatgtgatcttaccagaaaatgcaattaatttaatcattcctaacattccattattttgatttgtttttaaaattatgtttacatcatgatccagttcaggttaaaacgcttgtacactgactgaattgacgcctatctttaagttaacaacattagttactatgtcctggaaacctataattgtgcctgaaatcttatgtgttatttgtaattctcacaacaatcttgatagatcagtatcattttccttattgtacaaatgagaaatcgaagaccctgagaggtgacataagtagcttaggaaggggctgaggtgggacaaggacaccacctgacttcagaggtgtctgaaaacagtccttctctgggataaagaataccgcccagagaaacattctcctgtcctaaaaagcaccatgcatgttcaccaaagcctacccagcaagtgtctggtctgaagaattctccttttctagggtctatgccagtgcttctagttatctcatggcgagagaagcttgtagcccccagagtgggaggtctctaggcagctgtgagatttgtgctggagtgtggatattagacccaaagccatgggctttttaacattggcctgtgtctcccacgcaatccgagctttatgcaccagatcgttactctgctgtgaaaatgaatattgggtttatggagaaagctaaacggttgggaaggtgtgtccctagccaattgtcaatagaggctgtgagcttcagaggaggcaattgtaataggttttcagttgacacacagttatgaccaaagcctttgaatcatttttgtgtgctttaactattgtgtgtttgttcagctgtatctttaataagaacagagcattattagcagtttttaaatcattctttgctgtaggttataagcatcttgctgcggtattcttttcaaattattggaatctctctttccctgccttacatcctgccctaacactgccttcccctctcatgttcccctaacaaatgctatatccctctcatttgacatattcaaacacacacacacacacacacacacacacacacacacacacacacacacccttattatacaacttagtttccggactgcaacagttgtctagatgtttctgagttaggaaacttgttgaatcgatatgcaggtcttctctctgtttaggtctcatttacccatcacacatatatttatcaaatatattcttaaggtttccttctccaatttcatgagagacagcctaacattccaggccaagtttccagcagtcacgctggctctcttcataaatctgtaaaataaaaatgagctttctcctttgtgaaatctcttttttataagcttaatagagacccagacaagcctgagggatagctctgttgacctcatcaagtttcttgcagcaggatgtctctgcgaaagtgggcttttaaccatttcgcatactttgaactgtggagctgacctagctgtggagaggaattgattaattagcagtgatggtggatacttattaagcaccacgttgtgccttttgccttgtgctgtgttagatgtttggtgtatattaacccctttactgtcgaaggccatctgtgtgataaacatttactctcattgatgaggaaagctggcttatggtcacacagagaccacaagtaccagaatagtggttggaccaaggcatcccaacttcaggtttcacccacgtagccaacagcgagaattacatcctaccaatgtttagagactttcttcctgtgcatcttcagagacactgggcgtgcaggcagtagagaagtatttcacctgtcaccaatgggcccatttaacagaaaaacagcagaacactcagcattcctttttaaccagctatgtcagccatgatttagataatgagtgtgcatattggtcctacctctgtgtcatctgatttaatggagattccagttagtggcagcttatccggttactttagagactgattaatgagttgtcactgttttattggatatcggtcatcagaggcaggaatacaagtgtctctagcatctgagcaacccagaacattcaacaagtaataaatgaaaacgtcagggccctttagatgtgtgatttatgtacatacccttggggtactacacttactataaaacctacaatgcaatccttatccaaaattctgatggttttaatgtttaaatattctgcttgtgaaatatcatatggctttgagcaaataactgtcaggcctgtcgaaatctttttgtaatgggaagactgtgaaattatagttgtgaaatttgatgattttgaagaagaattaattactgaagtttttacagcagattcactttcattacccatttttctttctattgtaacgtctgtgctcggttttcctacatggattacaaccttctagatgctgactgacctctcatttcagctcatttttttaagatgggaattgattgacattttcaccagtcacgctggctctcttcataaatctgtaaaataaaaatgagctttctcctttgtgaaatctcttttttataagcttaatagagacccagacaagcctgagggatagctctgttgacctcatcaagtttcttgcagcaggatgtctccgcgaaagtgggcttttaaccatttccttttaaggaactctgtgtgttaatgataattgtggtatcttgacagtaattgctgggacaactggaaacctaaaggcaaatactggtagtcacagaactgtttgagtgcctgaaagagaaaagaatctctttgaactacctgatccaactctcccgacatcatccatgccccagcctctagaatgactgactcttcctaaaacacatcctttgcttcagttcctctgggcctttgcatacacagttccttcccctgggagaatctttctgcagatgctatctcttccacgcaagcagtttggagttctcttctgctgatcatcacacccattaatgactcttccttgtagtccctttgctgtttgctatttggatagacaagagtgactgccttcactgcattcaggcacaactatttatgattaggaatcaaaccgtgcacctgcacacaagctccctgaaggcaagtagatagtctttgcacctggtaaataaaattaagtgcttctggtgtgaactgagtcttcaggaaaggctattaattcttactgccaaattcagctagctttcatggaacctagaagcagctgccggggaagttgtgactttggcttctctttccctcattttccctagagcagtagttttcaatctcagcttccctttggaatcacctggagagcttaagaaataccaatgcctgggtcttacccctcaaaattctgaggtacagtggaatggttccttgtcgtgacctagacataggatttgtattgtctcccggcatattctaatgtacagccagggctgcgatcttctgagctggtgaacgtgaagtttggctgtcccttcatgggctttatagttttatctgcaggcctcactttttatgggcagttgacctcacctcacttcattttgtgtgatcttggccagacaggctagcacctgcaaagactgaggtatgaaaagggaatgctattcatttttctttcctttcttcttttttttttttttttttttaaaaaaaaagcatttgacttttgaatatcccttgagctggatgtatgaattaactaaaattattatggttgtcttctatttactgtatatattctgaaattctagtgctcaaattgtttcttctgttaacttttgacagtattagaagatttagaatttgataaggatttcctgccttgactattctgtatcttagatgtttctattttgaggagctaaaatggtataatgatagatctggaagttataaaaccttttgctgttcaaattgaccgtaccaaattgaccatcatctccttgttctttctgagagttagatgcataatcaggcataatctcataatgttaccaatttatttcatgtgattgggtccaagagttacagagtaactgaaatatcccaggtggaaatataaggcaactggatttgcctgcccagagaatgaggagcctcattcacttgttggaaatgcagttttatctgagctttactccagtaccgtccatgatgactgcaagccagaatataacttgactcttttcatgtcgttggcagaatttgttaccaaattcctctgcctttagttgtataaatcatcccctttagttacttccctgttttatggctaatgctctgagttatttacccatttgaggacataatgctctagttgaagcttaaataaatcttgagtccctaggagatgcctggtgtcctataatgattcaatcttttagagttgcttagactgggacttgcatcttatctcttgttctaatgatttcatctccgtgaactgtggtttcccttcttccataaaatggagataacataatataacctaacagggttgttctttctgcaccttaaatgaaaaaaaaaaaaagaaaaaagaaaaacaagtctaagtacctagggccgcatctgattcataaggaacccttccatagtacatcgtaggtattttttagttctgtttttctaaactcaatttccagttacatttttccaattatttcccccagtaaaaggaactttgggctataaatatgaattatgctatataatgcttggtttcaaactgttctgagcatttccaaagatgttttggataataaagcatgcatgtgttttcatataccattgccttgcagatcaaggatgactattccattcacacaaatcacataggaaccaactcataaaaaggaaatggactccacctttttctccataggaagttccctataatagtgagatcacagcctcatttttatggtcaaactcaggacgatatttggattccccagggaagttaactttgctttcatgaagctgctgaaatataatccaagagtcaccatcagtgataaaatcatgggcttagaattgaaaagctggagttaacactccaggtatttaacagccagttaaataccaacattcttattgacaaatttagcactgaatcagagaacagccctaagcttataaagattataagattctttgggacagataaaggcaatgaactgtttttttgtttttttgttttttttttttaaaaaaaaaaaagattgtgccatttattcagtaggtgtccactcagtactacctgagattgtcattggtgatattcatttagttctttcaaagttccatgggtatttccagagtttctgcctcatcgtatacaatggctcttctggacctggcagatttgggccaggatgcctggaggaggacagcattgggcaaatgcagagaagtaccccttcacctgcacctggcctttataattttaacccctcagtggtgcgtactgtgtgagcagtggagagtccttaggctttcagcagacgttcaaggtctgcttggcattttgaaggacaagtgaatgttgcagttgtgagcctgatgcagacatttcagggagttcctagagctgccagtgtctgtttgattgaaaggatagaagttgaaatattatcagaaggccacttggaggtctgaggaaatcagagtggaaacatttcttgagggcataatatctcaaaaatgttactaatatttaaagctgggaaatttgcctttttaaaaatttttccatgataaaaatttgtagagagagaataaaatctcttttagctgcagcctcttcttcattactatctatgcattatcgctgctattcgcccaagtctctcctatctcctgccccctccccgctctcccctttagagtactgaagtattatggatgctcatttggtgttaggatgtaattatccaaggtgaagaaatttagcagaagctgtgtgctgcctatttaacatctgaaacagcttcttaatacctgccatattaatggcagcctttttccccccactatccttgtatagaagcttccttgatctttccaggaagctaaatgctctccatcctgatcattaactaataattatccaagaaggtttcagtcttgattttttgaactgactaaagaattacggctgcctgctaagtttctaagagcgatggaagaagctgggcgaggggaatgggaagtgaagtatgaagttagtaggggtcttctgagttcaaaaggcttcttgctccttttctagacagttttcctctcccgggagcctatgggaacagtaagaactcagattatgattaggatacaaagacagtccttgtggtagatatttgtttccatttctcagcatttgtccttgttttttttttctgttttcacattattgcaccaaattttcttttgggggccacccttctccaccctcagtccaagtggttcttatgagtttctatctctagccacaaagatgtagtttgtgacccaaaactggccatagtaacagatccaggaacacgcctatgacagaaatctggtcaacaggttgattctacacttctagctacagagattgtttcagagatgggcacattgattcccctagagtgatgttttgggtaactactggaaaaagacacgactattgtttctgctgtaattgaacccaggagaacgaaggtttgtagttgttttcagccactctactcccgtttgaacccaagagtgatgtcaacatggataaaacaagaccccagaaacttttcataagaaggaggtgcaggtaacacatcccttttcagtgtttctattatttcctgtttacttcctgtttctgccaggaccaattggcaacatccttcaccctggcagtggcagttggttccagattccaccctccaacccctgtagcacctgagaaccaggcttgagtttctcctcaaaaatattagcaccagcaggcagcacggtttccacagaggtcttggtcccagctccttggggacctctttcaagttctagagcctccaatgccaactgaacagtgctccttcctcagtggtctgggtttctactgtgtggggacactcctctaggttgcaatgatcaaaacttcttccctttgatccaccagcccttagaatggtagctgcttcctgctttgactgcctgttagctcaaggctccccttatgccttttcagcccttcaaaacctatgtaaacaattccttctattacattttcttttaaaataactgtggtggtttctgtttgcctttcttgacctgactgacacagccctgaaaagaaggaactaccaattctatcaaattcccatggcctcatagacatttgtgtatgattggtgatcttttctatgaaatcaactgttttcagaatgagctctgcacaccctagagaaaacctaagtgtgatggagaagtgagggtagatgtggagaagatgaatgagtccacttttcttcattataaatagcttccctttaattatctctctctctccatatatatatatatatatatatatatatatttttttttaatagatggggtcttgctgtgttgccctggctggattgcagtgagctatgagcatgaccatagttcactgcaatcttgaactcttgggctcaagtgagtctcctgcctcagccagcagagttgctgggactataggcacatgccaccatgcctggctctgtattgtatgttttggtaagatttcatgttaaaagtattccaaggatgttctctttggatatttatttattttaaaaaagtattcatttactttacgagaatgtgttaaagtaacattgtctagctatttgattgaagttgtctctttctactcctgccagaaataaattctccctacggtatgtgtcaataaactatgtttatcttagtcttaacacgttctgtttaatattagggttatatgttacatttttcttccctacttgactgtcctctccaggaaggcaagaaactggtctgtatcattaataagcacttaacaaggacataaaagtccttagaatgagtctttacatacaagctggagtacagtggacaagttagttaactctcttttagcctattggtttattttaatacaaggataataatacctactttatacaaattgtatgatcatttgaaacttaaatgaaatattaattattcttattattagttgttctgcaaaacttctcattgtcgacattccagcacttccactcacttggtcctcagaaaatatctattgaataaaatgaactcttgcagttactttgccacatgacaagccacccagaaacttggtggcttaaaatagcaaactgaggattcttcccgaattgctatacattttgtttatgcattcaaggtgtaaatggagccttttctatgtaaaaacaaccaagctgtagacttctttgtgtaaatttactgtgtaaaaataagattttttttttctttactattaggtcaactagcctcatttacatcttttattaaacatactcacaactggtggtatttttttcctttatgaacaaagcgaaattatagattccacccaaatcatgttggaatcctgctaggtgaaaattatatgtctgtaagagctacgtggaatctagtttccagatggaattcccttcttgccaattttgggaatattctacaaagtttccccttagaaaccatttacatgaagtgaaaaatttactctaggaaaatgattggagagaatgcttgtgaaatgtgaaggcatgacttgcatatggacagtatacacattcatagatattttacccgtgccgttgagatagctagtaataatgtgtgttctcattgtgtttgctcttgtctgtagagaccaccagaaactgatttagcctgaggaatatatttcaaactgaaatttttattgtaaagtaattgcaaataacgtgtaattaaaagtgatgagaaccccttacatttgtatagcatgtttactttccaaagcacgtcatgacctcttgcttttataattctaaaaaattcttgaaagataggaaaggcaagttctattaatattatatttggacaaagaggcaaatagatattacagctgagtattcttaaatatgcaagtgatattttgttttgttgacaccttggtttgttgatttgaaagcccagtgcttttgatttagcttcaggtttggtaaaaaaggagaacagtatttactgaatgaataaacttcccctttgtaacatatttgtgtcacaactctgcaattatacaaagagactgatgtctgccttgtgggaactataattgccacttggacaagtttcatgtggttgacattaatagaccatgctgattatgactgacaaccaggggttcttaaacttatccagtaaaagggttttttcccctaatatcaaattcacaagccactattctatagtaataaaaaggcaactatgaatttggtaacgtttaaaaagttatttgcattttattaactacaactaatgtatacatttgtaaagtagtaacagatgtatgcatgaaacatgctattcatgataaaagctagtcttcatacacataggaattctcaaaactcttgaactaacccagtgttcccctgggagatcatggttaatgagttgggaagctttggcataactagagatagccattacactacattccatgtgtcaatgccaacaggaggaatgaccgcctgaagaggtgtgttgaaaaggattctgagagctagtttgggttcagagcaaagagtactgtcattaattagtgatgtttgccagaggaggaggaagtaatgggtgggaagagccaaacatttgccttacctgacttagactatgtggaccacttgactccagcaaaggataatggagatgaccactaatatctagatataacaaaggattaatctaagaagtcagttaaaatatacttttaggccaggtgtggtggctcacacctgtaatcccagcactttgggaggccaaggtgggtggatcacttgaggtcgggagttcaagaccagcctggccaacatggtgaaaccccgtctctactaaaaatgcaaaactagctgggtgtggtggtgcaggcctgtactcccagctacttgagaagctgaggcaggagaatcatgtgaacccgggaggcagaggttgcagtgagccaagattgtgccactgcactccagcctgggcaacagagcaagactccatctcaaaaaacaaacaaacaaaaaactttaaaaactactgtaaaatataaagcttattttaaaataagcacatttaaaaacaggttacatttactgaatattttattccaaacttcccctgctattaagcaccttgttcttgatcctacagcttgaggaaaacctctgtttttctctcaagacaaattgatgattgaagtatcctagtcccttctatgattttagccattcgatgaaggatctttgcacccatcagttgatactcactcatgttgcagccatctcacatagcttgtagtttttgtttgtttgtttttttccagaaacaaggtctcaccctgtcacccgagctggaatgtagtggcacaatcacgactcactgcaaccttgagctcctaagctcaagcaatccgcatgcgccaccatgcctggctaatttttaaattttttggtagagatggggttctccctgtgttgcccaggctagtcttgagctcctgggttcaaatgatcctcctgcttcagcctcccaacgtgttgggattacaggcatgagccaccatgcctgacccatctaactggctgttcttttcacgaaagacaagtcattccctgacaccatttactcagaaatgggagggagtggagatatggagaaaagtatctggtagatgactttgctctatctgtgcaatatcactgtttatagacatgcatttccctaataatttaagtcacttgccctatgaactagccaacctgcttcctcactggtttttgaaatatctttagagaaaaaatattccagtgatatgtttaatttatatgttaaccattcttggaatctcccagtcccttctaaaactcttttgccttagctttatcccactctgactgtattgaagataattaaacataatcacatcatctgacccttatgtacctgttcagatggtaattgtctttcagaactccatcttaagatagcaccttcttagccgtccctggaaattaattgctctgcctctagatcggctttgtttctatcttaattattgctctgcctgaaaagtctattttttgcttgggctttttgaggtgaggatacatgtcttagtcatccttgtatctccaatgcctcgaactgtgaatagctcctggtaaatgggcataaacactgggtaggactgacactcctctgaggcacttacctcccgtggagggagacctgatttgatttttttactctctttctaccctcagcatattccccagtaaaagctagcttgtacctttttctttacttgatatactctctccctatttttttggagattatatcactttttcaatactctatataggtagagtcataaataaagataactaaggtgaatgagatttgccacatttatatgtaggaatttctaaacaccttagaatgaagtgcctttataagaagaatgaggcctactttcatgggatatttaaagtataaatgctatttttttattttgtttttaaaaagatgtatctaccatgatacgtcataactttagaatagtttttgacttttaacatgaaaatgaaaaccagcatttagccactcaagccatgttcctgaaggggagccaggcaaggtggagagtgatgatggggtacagctctgtctgtgttaagagctttcaggtgtcctggcttcagcaaggttctggcccaggccgtgagacaaatgcttggcaatctcgggatggagtttgcagagcaggcagaattttctcctcataactttagaacagatgaatacacatttcctagattccttgaggggagcgccagctcagggctatccatagtccacaatcgggcagggtgttgggcttcaattcttctctaagcgtgtgaggcatgagaaaacggggcaaccctgcaggtcgggaggaaggggtagacatgtggctggggctccacaagagtgacggtcatttcatcaacatccaaagaccttgcatgaagatctaacctccatcactgtacccacaagtgctcccatgtgcccaccttacctttggtggcatctcttctttcgtaccctgtggaggaaggtgacttccatggccacacctcttataccatccatatttactgagcccatgcttaatgtatcagacagggtcctcagctccgtggacacagtgataagcaagtaacacatggctccagctgccatagagtttttaccctagtgaagggaaagtaaacaagtaagtgacatattttgttaaattctgtgtactgtaaaggaaatgaaacagagttatgtaatagagaaggacattatggagtgagggtggtggcagggggttactttaagtttgatcccagactttcttgatcagaaaaagtcgtggctgggcattctgcacaagtctttgcatctgtgtgcttattctttcattcatttgttcattcattcattctttcattcattccataaccataaatgctttgatctatttagctcattgcctggcattgttaacatatacagattaggcaggcttccaaattattttagccctgaggatatattaattcattcaattaaagtaattattcaagtactgtgttgacaatcccacctgcatacagccattggtatggggcaaaggctggtaaaagaacacaagatggtgtgattcatttagggtctgacaaagtgaacggtggcatttttatgaactggatcagaatctaacaaaatgcccggaattgttaagctcctcacactgtgatttggcctatgggcatgtcactggaaccagtggtctcatcattctttgctattccttccctctatttttctatatcataacaattccagtctgatttctctctaacatacttcctgtgaaaacctttaaaacaagggcttggagagatactaagaagaaaagagactgtattataattacaaagtgaattttatttatttaaactgattatgtgacagttgctactctgtaagcagccctccaaaattatttttgtcctctgaaagaaggtatttcatggctagagaagctcctaaagactctttaaggtttccctagagcctataaaaattgaaattttttgttttactcctgaggaggaacattccttagaggcccagcaagtctttatagatgcaatcataatttgcagctatttattgcaaatgcactgggtgctgaagttgggcattgcagcagatactgttgctgtcctgcccatggtcctcctgtctatgctcaccatgtccatacaacctgacatccactcaggagaaagtgtgttgctctatgaaggcattctctggctgctggaacctgctctgctgaagatcaggcaagtccagaatgccaaggaattgacatccactacatcccagctgtcctagatccacgagtgatgggattggtggataagtacccatctcctttgctcctcagacaagccaactccgaagtgtatgttctataccatttcccaaagtttcccagtgggctgtagccctagctgtccacagtggcaactgctttgtccttcaaatatatttgtttgcattatcctccaaataaattacttgtgctgaaatctctgcctgaaggtcagcttgtggaagagccaaactaagacaggtacattgcatacattatctcagttaatctttcctacctctccaaggcgaaacattgcactccccgttttacagatgagaaaactgggattcaggaggttatttttttctctctctctcattccaaatattctctgtctctcctctctctcttattccaaatctccttttctttatattttattgtgaagaaagtggccacagtatatggtctcttaggaaggtgcagccatgtggttaatgaattttgcagcagaagaataaatcaaatatttattgattcaaattggtgtaggcatggtaaaaaaatgtgaaaagtagaactttgtttattcattccacaaatgtttattttctgctaccaagtgccaggtactctgtttcttcctgagtgtatagtggcaagggagaggaggccctctgagaacagcagactgcattctaatttgtatgaagttcttactgaaatgaaagtttctgtgatgttaagattgtatgctactattcagtaaatgtctagaaagggcaatctgatttccgagcttctaccatgatgccagttaggtggctatatgtcagaaagcagagtccaggttctctctttttactttctggatagacctttactctttagatggcaaattttatgttttcctcccactagactataaatgtcttttgtagataatgaatatgtctgccgctgcattgaatttgaataaggactaatggccagtatcagaacataattaaatgcaggatccacatcaactaacaaaattagatgcaggacccctttcaaaagtacttgtgctgaggaagtactgaacatgtcaagaggatacttcctccatacttctattcaattaaaaaaaaaaagaaagagaaagaagctattgatttcagttagtgggaagaaattgggtttagccttgatggtgtcttaactacaaacgaaaccaatatcctggtgttgttcctgttccattcctcatgctctgatgatttcacagttgactagtgatttgcaccttgcttcaaattacttaggatgtattatggcattatctatgaaaacagtttgactcaagaaaaaaaacagcttgtagacaaagagagaagctcagtggctgtgcagtcacagagcagagagggcttaaaaggtttgtctggacatggaagcaccatctttgtgtcaataaggtgagtttgttccacacactttgccttttgtgtgcttcttttattttttctattatccgtcttctgctgttcttgcatcctttctcctcagatagatcttctgtatcaaaaggccatgctctaagccatcttcctttctcttcctcctccctgtcagcaatctcaatctccatgcaaagtatcactctgtcatgcaataagacattgtccccaccttgggaacatttttgctctcttagaagtattagaagatggaaaaatattcaagacccaaaggatgaacccataataatggaatttctgttcactttgcaagacctccaagaatggaaggggggatatttttgaaacacatttctatatagttcctatcattttcactgagatcactagaatatagaagatatttaggagctcatgtagtgaacactaaagccaattgctgacaaccactgattgacagctatgcattcaacactgacatacgttctgtgaggaattaagaaattaaaaagaagaaaaagtaatacatggtcctgatcctataagagattactgctggctaggaaatgtatataatatgcacaaaaacgattgatgttaaaatctgttgattggcatagtcagagatgagcaaaagaaaggaggtgggaaatggggatgatctgaaatgaaaggtagaattcatttgcaggaagaaaagaaggtagcacaggtgagggcatggaaactggaacaaacagggtacacatggaatactgggatgtggctgaactgaaagtccatgttggggagttgtgaaatacaagtgggtagtgagatcaatgtcaagctacggagggcctgggatccacaaagatgatggagcttatgggaagcagggccccagtgtgtccttaggcagggtcatgcctggcagttgggtacaaaaggggctggaagcagaggagggggagagaaatccaagtaaggagaccgactgagcaagaatccagtccacaagaaaggggccttgggcctgggcgatgccagtgggaatgtaaggagccatccaaagagcatgtccagaagacaacaggatacattcaagatggagaacgcatcagaagggattaagggggtttatgcaaatggccccagacacctcatcccaatattactcctagcagtaatgtaccaagcaccgactccataccaggccctattctaaaggttttctttttttaacttattttaccctcataatgatatgaggtctctttatttccactttctagaggcacaggtaagttaagcaatttgctctaggcctcaccaaaaaattagttgaaaacaacttagttgtcaacttgacaattctatagtttgcccatatttctcagaagtaagtctatttatctttctgtaccatttttattttattttattttatttttttgagacagagtcttgctctgtcacccagattggcgtataatggtgcaatctcagctcactgcaacctccgcctgccgggttcaagcaattctcctgcctcagtctcccaagtagctgagattacaggcatgtgccaccacacccagctaattttttgtatttttagtagagacggggtttcaccatgttagctaggatggtctcgatctcctgaccccatgatctgcctgcctatgcctcctaaagtgctgggattataggcatgagccactgcgcccagccctttctgtacaattttgaataaacttcccttcttctcagcctcttggatgtttgtttcaccttgtcactgtaaaactgaagcctggctttcccctgaggtaccatctcctcctaaccttcaacaggggttggagggggaaactactcctttgtatgtcatctccctgccacctgcggagtacggaggaagagccagggcatcccttgcacttccgggccactttcttgtcctgcagagataccaccaatcccatcttggcttgtgtccacaaccctcatgggctctccctttccaccctcactgcctccatctgtggtggtccagggctgtttctcagtggcaggacactggccaccttcttgcctattcttctctgccattgtttctggggatattacatcctgatgtagcagttcctgtattcttctgcctctatttcagccgccatcccagaccttgccttacctacagcttctgcatcactgtgattctgaacatagaactcctctctgccacctttgatctcttgtcctccctcacttccttctttgccttctctcagtccttggctttgctgatgctctgttccctggcatgcttcctggtctcccaactcatctctattcttgggcttataaaaagttttttccgcctccttcatccatcttggatcctatggttgattatatcaacaatggtcttgtatgtgcccctttctcctctttgttttttgtcctttcccttctttattagtcacttagttctcatccttggggaaatactgctactcatattttccaattctcttccaaaactatcaacatagggatgacaggccagctgtattttcccatcacacatgctctccttccacacttgaacttctgttgcttctcagctgggcccttaccacttatcagtactcctagggatcatctctaatcacttgcctactacatccttccctgcattcaatcccagtgttccctgctccactcaaggaatggcagttcaggaaagagtactcattataccacccattgtgcgaagcatttgatatgattgcatatattcaaacctcaacctggtgtaggtagtgttattctcatttttttcatatgataactctgggactgagacagtaacttacacagaactcaaaaaaaactttatgtttcatgtctgtttgattcccacacctgtgggttttcaggtcgtaataaagcctccactgctgacctgaccttctgccaagtttactctgtagattacttagtttctttcttaaatgagataaatgaacctgtaacatgggactttccagttccttcttcttttccaccacattttttttgtatcttcatccatttccttctccttcttttctgtctaaaagaaggaattatcccctaatcttccttacagtcagctcctctgcctttgttatggattccaactcttctacctctttctccagattgatgatctgtcagttatcctcctctttctgatcacttttcattcccccttccaaactaaatatttttctttcacagcaaacaaatctgtcctcttacttaaaaacaaacaagcaaaaaactacttttcttgactttaagatcctgaacaagcttatcttctacctttcctaaaactccttgaataaagagactacatttactgtttttaccatctccccgcaatgatcccaaatcattttcaatgtggcatcttcctctttcctgatcccaaaccatttccttaaagtatataccaacaaccacataggaacagagccaacttctgtattctgggtgctcatttttcttaagttttctgtagctttgagtgcttcaacactatctcttcttttttgaaaaaggctttctcttgacttttctatgttttcttggttcttttttcacctattggcccacatctttcccaggtgctctttcctagctaatcttcttcctttatttccattttgtctctctttactctttcctttaagtaatgtgtcttacttaactgcaggcttagaagactatacccttctctaactttgacttttcaagtgaattcagtttggacatctccttcatttgtttcactggcctcagatttactttgtctaatactaaatctatcatcttatttttctttcccttcctgttttttttctattaataacaccattattcaagccttaaatcccgttgctcataactatttctttcaccttgttcccacatgtaatttgttgtcaattattttccagccttttttctctccacatctgttgaatatttcccaccttttcccctcttgctatcatccaagtttattctatttcctatcatttcagtacttgttttattaactagtttcttaccttatgttccaatgttctttcccataactaaacttggtgcagtaaaatccatgccttatgcttttcgggccctgtacctatgctcacagtacctctacagaatcttgttttctatttcttatttaaatcccattattctagggagtttgccataaatacatttcttccaggaaatttttctggtcttctgttctctgctttttatccctaatctggtaagaatctttcttgcccctaaactcctaaaacatctttttctcatacttctagtttattgtcttaatcctaatagaaaacaatagcaagaatgaacttttgagcccctccacccaaattgactcatctttatcacttactagctgtgtggccttaaactagttatttcacatctctgagcttcatattactcatccaagtaactaaaataataaggcctggccttcaggtatattgggaagattagaaacaatatatggcatggtccttaacagtgtgtttggcccagaaccaccattcaatagatgttgagtgaaacactttctctaggtagagtatggggtgctgaagagtatgtacagactagggtatagagtaggcattcaaaaatatttgcacagtgaaagggctgggattataagaggcaaacatctaccatcaatcctctgtcagttttaaaatctgtccaccagatatcagagaagaataaaattagactgggtgaatgtctgacccatttatcatctatcagggagtaacttttgcctgaagacatccccccaggacaatagaaaccagcattctaacattgaatttcaactgtttgtagtgaggacagccatccctggtcccattttctgagctgagtattaaatttactgtttcctaagcttgaaggaattctacacttgcatgcattttaaaaaataatagctattggttgtgctacagtgactttgccaattcccttagtttccaactctgctaatatccatcctgctcttaacagcttcctgacttgtttcctttctctagtcccagtttgcttttctcttcacaagtgatatccacgtgggtttactaatcagatttgcatgtttttcaatagcacactcctcaaagtgtccgttttctatcagctaaaagaagcaaaattaagatcttttgttttccaacatagaagtgtgtctgcatgttccagagtgtggttttggagttcagactgcctagatttgaatcctggctcaagcccctgttagctctgtgagtctaggcaaactcatgccattgcggacctcagtttgtttctccataaaataggaacgagaattaattatgtctaatctgaaatagtatcattgggagaacctaaatgaaataaggcaattgaaaactcttaagatagtgcatatctcattgtaagagctcgatatacattagctgttaataacaacattttatcataaatcatttataactagcaacttcatggttgatttatgctttagctttccaaattgtatttctatttattcattctacgtttgtggatgtttatttttttgttggtttgtttttattatcccttaggatgaaatttcacttaatgagcgaggcttcatgttgtcccaactacccaccttgcacagcgttgacatctgagcggggatagtgtgagcaaaagataatggactagaaagcatctcacactctacagtggagatcttctctcaacctctaatttggtggttctcatctttctttgctttttcctgcttcagaatgcctaatgtactcccatcaatatcagtagctggctgattttcatgaagtacagattaaaaatgagcaatcggaaaactgactcagttccagggtgcctgccagcatacacagtaacttcatacaaatcagagaaaaaccaccctttgggaacagaggcaaccccataggtgcgtggcttgacagtttaattgcttttgtgcaagagaaagtagttcgttcttaggggtcagagtggggaggttgtcacccttgaacttgaacacagaccttggcagctgaccctggctggatgtcagccctatccactccttgacttagcacaacctgcatggaggccttgtcctgtaggcatatgtctccccacagcaggtaggaatcaccgttgtactcggaggcaggatcgcttccccctcgcccctacggtcagctctctgtacctgggggatccgcatctgcagattcaacagttgctgattgaaaatattcagaaaaaaaaaataaataacaatacagcaattaaaaaatagtgcaaataaagaatatagtatagcaactattaacatcacatttacattttattaggtattataagtaatctagggcctattttaaatgtttaagaggatgtgcataggttgtatgcaaatactattccattttttatcagagacttgagcatctgtggtttcagtgtctgtgggaggtcctggaaccaattcccttaggataccaaggtaggactgtatagtaacatctgctctgcacctcaccatcccaccactacaaggtacctctttgttgcttttcctggatgatgaatctgcaagaaagtttgaaagccatgctgatgaaagtttttctgctggcattaaagatgtggcaagctttctgttaggtaggaatgaaaggtggggacaaattcttttccttggcaactgcatgagagtatccaggaaaatcacattcagatgggagatcatttaatgcagcctatggagggtgaaaacagaactacatttgtcagcatttacagccatcattgtgttccctcagcaaacctccccatgctgcagcagccacaccccgcagtcatccatcatgctggctgaagagccctggccgcctgccacacacgtgccaaggggaagccccatgccccgttagtgtcagcatgtgctgtgacttgtaacaaagacaggaatgagtcctcgtccagatagccatgtaatcctcagagaagagtgcactgtggctgctgcaggcttgcccagaaagtctcctaccatctgaagggtaattctgatggcagaaaacattcaatcccactattcttagcctgactttctacttctagctttttcaggctcatcaaaccctctaaaatcatttgaggagaagaaaatgttcttcgttgcgttctataagggaaatatattgcaaaaaaaggaaccataggcgaacaaagaaagggaggagatggggccacccctattcttccattaaatttatgtcactcagccttgagagtcaagcaaaatgtttgaggccaaatacatcttttattaagttgtaatacaaagataagttatctagatttttgactgatttggcacttcacaatgttatactttttcgaatcccaaattctagcaactataagatgccactgtaattttgtatacctttagaatacattaaatatgatacaatgccttattaccccttaaaatttgtattttatatttatcaaaagagcacttttagattcactttagacacaggcttttgtgacatatcactctttcgcacacagaaaaggaaaatgaaagtgaaataaggagaatgaggtattccttagccttcataaagttggaatcttctgaatcactgtgctgctcaaagtcactgatagtcaagttttcttttggcataggatttgcctctgtgacatcagaaagtattgatgatgtggcctctcctgaaaacaaaacaaaacaaacatacaggcttggttttccaattttaaaactatattgttgttttgcccccccccggtaagtctgtcaactgagcacagtgtagtttttacatccttactttggtgtttccctgagctggtagagttgtatttgagacaaaataactattcattcaattggattgctgcattctacttcagtaacagagaagaaaaaccagcaagatatccctgtaaagcattgctatggttttggaatcctgcagataaaatggaatgtcttcaggtgtttgaaaatctgggtcatatgtctctacttgggaacttgaaaaatgtttgataaatgtgtttgatttcaagatgatggtgtttcttttggtttgtcagaaactggctctgatacatatttgtaagaaagaggaaaaatctcgaattactcattagactatcaacaatatgcccattctttgaagtctgactgaaatcctttcttctctatggcatcttctagatttccgcttggactgatctccactgtatctgaatttctatagtgtttttgctccccttttccattccttttctctatttttagtttttttttttttttttttgagacagggcctcactctgtcacccgtgccggactacagtggcgtaatcacagcaaactgcagccttgaatttctgggctcaagtgatcctcctgcctcagcctcccaagtagctgggactacaggcacgcaccaccatagcaggcaaacttcttttgtatacataggacatcactatattgcccaggttggccttgaactcctggcctcaagtgatccttctacacatattttacagctgtgaacctccatgcccagcctggtgtattattttttaaatcagacttttaaatcagatttttaatgaggttttttttcatcagattctgtctttggatacctgttatattatttttaaaatttgacgggtatgtgcgagttttaaaatttgagacaaaaagttggataaaagacatctgagaggcaatccctctcagttggacagggagaaaggagggagagaggaggggagtaaacccaatgaagggtacattaacaaatgggttattgctgtggcaacaagggttcatttttgttggagactgtggtagcctgaactatggcctcaaaaagaggtccgcgtcctagttcacagaacctatgaatatgtttccttgcatggcaaaagagactttacagatattgatgaagttcaggatattgggatgggaggattctggatgatccacatgggcccaatgtgatcgcaatggtccttatatgaggaaggcaggagggtcagagtcagagaagacaatgcaccgtaacagcagaagcagagggagggaaggagatgtgatagtggaatcagatgttgcagtgacgtgaggaaaaagccatgagccaaggaatgcatgtggcctctgaaagctggagaacacaagggcatggatttgctccagtgcctccagcaggaatgcaatcctgcccaagccatgatttttgctcagtaaaattcatttcagaatattggcctgcagaactgtaaggtaatgcatttgtgttgttctaagtcactgagtttataggggggttgttacagcagcagtaggaaaccaatagaagggttcatttttctgagaaaccatatggaccaggcttcatagctgtgccagtgaggttcgaggaggctgaggtatttgcccatcaattctcatcacttactggataaggattattcccagaggtggcagctttctatcggttctggcttgttcaagctgtgcaccctcctgtcccctctaggggccagagaaagtctttagaaagacaggtctatataaaataagatgccataggcttgtctacaacttgtctactgatgatgcatgtgacatgtgggatggatcaagggaagatgggtgcactggaattacctgccaccatgtgtaagtacgtgtatgcatggttgcgtgcatgactgtgtgtgtgtgtctgtgtgtgtgtgtgtgtgtgtttcttcctccccctttattaagtttttttgagcctagacgttctctcccattgaccagagccccaagcacagcacccaaatctgggaaaaacacttcttgaatgattgggtggcagaatgtgacagcctgtgaatgtcacagtaaataagggagttggctattttacagtgatgtcttctctaattcttaaattaagactgtgcagagaaggaagaattgctattccttggaaagattcaagagactctggagatgctatgtagtttggttgcaaggtggctgtcaatcacaaatgcaagttgtcaccaggcaaaatggccctgtcctgctgcgtgaccaatctgcaatctaagactggctcatcaaggttagcagataaatcaacacaaaaagagatgaacattgcaggcagtgctgatgtcaaacagagatttcatgcatctggcagaaaattgagcatattggtaaagcactaaagacttccttcatgaaagttctttgctccctggtcctgaaaggaaaattagattaatgctcacaaatccttcttgacatctgaaggatggccttctcttgacaaggctctagacaggaaaatgtgaggaacaccagcatggccttccctttgctaggtatctaatctaacctagctttctggaggcacttgttaagtactagattctcgctctctttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgtttttagccaggatggtctcgatctcctgacctcgtgatccgcccgcctcggcctcccaaagtgctgggattacaggcgtgagccaccgcgcccggcctagattctctctcttaacccttggcattattattatttttagcagttagcttcagcaagtgaagcactgctgattggagatgtgttttgtattctgactgtacttgcaagctctaccaagtacattagccttcaaaacatatttacgataaaggctgagtgcctgttccttaagagaaacctgcagaatggtctttatttttcacaccagctgcttcttcagatttgaacatgccagacaaatgtttgatgctcttgaatggtgtttgagtaaattaattgacacccaccgactgtcaaaatgtatgtattatgtatgtaaatataaaaacacctatatgcatgaatatgcagagatatgttttaagggtcattttgtggctaaaatatttgaaaataataatataagtaaagtatgatatgaaaattaatcttgtagaaaagtcagcagaacctaatggagattttagtgtagagaagaatgtgattaagccacagtagatccagaattttgctaatgatataaagtccttattgttaccagcctcaaggaaatccctgtctagtgcatattcatggagagtgaacgatgagcttgtgaaacatgtgagatgcaagtacagaaatgttggcccaactctattaaaaaccaatgtgtctcataattaagactctaaacacccccccttaaaactggccaaatgttggaatgagctggtgcccgccgcttcttaactcttcgctccagttttggggtctgtgcctcataaccatagtcacttttaaccaattctggttgcctccctgacagaacctgggattctgtgccatttctatgtgtgcccctattttaggaactaggtctaaagtaattaacagtttagaagtgataatctagtgaattagcttttgtgagggttgttttataatagcacaattcccttgttcactgcctactcctcctctgccccccttctccactgccttctcttccctgtcctgccctgtggatggctgcctgagttcttgctggctagcctctggttgggtttgtgtcataggggtgggaaggagtcaggttaccaggaggatgggacattgggagaaagtgattcgtgtatttcttacttgtctccaactccccatttcccaatccttcatttccccatgccactcccttttttccccacctggctatccttcccacccctgcgttgataccatctttttggaatgacgttgtccctccatgactgtggttagctgggaagcctgtacttcccagctcctgctctctcttgttgggctatggttacattattcccccacacttccacctctgagtgtctccatgtatcttgcctgtattttaaccatgcctgtgtcttcgtaagtggtccctttatcaaatttctgcatttaaaacatctatggaaatcctatttcctacctagaccctgatggttacactttactttctctaaccatagcattcttcaaacatgaaggaccacacgtatttaatatttaatcataccatgcttaagttgatacattggaatgccatagttctcatttcgctagcatgctattcaaaactttatttgtgagagaaacaaaaatagaagatgccatgtaagataacattatggtctgggtttatctgcacatgtcagtacatacctgcagagataggatctttgtctatggaagcaaaccaggaaggtatctgaatgccttggttcagtacccatcactctggaaatgactgaatgactgatgtgctttctaaacatgaggcagaggctggccaaatttcctttcaatctgggtgatgaaagctaagatgaggtaaatgttgtcacattgtgtttacattctactatatagtatatatggtatgtatatttctatgtatatgatatatatgtttacctacacatgtacacaatagagagagataatctcaaatatgaatggtactgcttaaacgcagtgttaactaaaagaactgcattacataaataaatattatggttataaaagaaaagaaaagccagagagcctactctcatgctttcgttgtatagctaaagtcatagaaaataaacattaaaaaaaaaaaactaatatttacaagacagcatacaaatgtctgtagtttaatttgggtataaacaagctacacaggtgctgaaggaattgcctgcagttaagagagaaggtgactatgcagaaataaattctaagacagggctggcttctgcccttatggaaaggtaaattagcccactgatacataatattagtggccaccaaaccattgtgacatcttgaatttcttctttttttttctttttctacggaagtctttacgggattgttagaacagcattggggggtttgtgaatcattatttattttggaggtatggagggaggtagcaaggaatgaattgtcatacccacacatgcctatccaggctcggatttcctcctttacttcaggccatacagatgattccactgtcctcttctctgttctcttgaaactgccactgcctgttccatcccaggctttctctcttaaacctggctgaagtaaaagccaagatttcgtttatttccttcttactcttaaagaacaaactcacagttactttaagttttcaaggttttttactaataagtatggtataataaagatttgacagataccacaccaaagaagatatacagatggcaagtaagcatgtgaaaaaatgcccgacatcatatgtcataaggtaaatacaaattaaaacaacagaaagatacccttacacacctattagaatggccaaaatccaaaacacggacaataccaattgtcgatgaggatgtgcagaaacagaaactctccttcattgctggtcttggcatagggattgtaaagcttaagaaaatacattgaagtccttgatctactgtctctaacccttcaaagggggtaaactcttttgtgcgaataccaaggtgtgagattgctgggtagtgtgataaaagtatattgagttttgtaagaaactgacaaactgtcttctaaagggctgtaacattttgtatccccaccggcaatgaatgagagtccctgttgttccacattcttaccagcattcggtattgtcagtgttttggatcttggccattctaatagatgtgtaatggtatctctttgttgttttaatttgcatttctcttatgacatatgatgttgagcatctttacatatgcctatttgccatctgtgtatcttctttggtggggtgtttgttgaagtcttttgccaatttttaattgggttgttcatttatttattagtgagttttaagagtttcttgtatatttaggataaaaatcctttatcaagtatgtcttttgcaaatattttcactctatctgtggcttgccttctcattctattgatgttgtctttcacagagcagatgttttttaattttaatgaaatttagcttatttttttcataaagcatgtatttggtgtcatatctaaaatgtcaccagtatatccaaagttgcctaggttttatcctgttatcccctaggagttttatagttccttgttttaaatttaggactattattaactttgaattattttttgtgaagtgtgtaaaatctgtgtcacgatccatttcttgcatgtgattgtccagttgttccagcccagtttgttgaaaagacttgcttcattgtagtgtctttgcttctttgttaaagattagttgactatatttacgagggtctatttatggactctgtattgttttccattgatctatttctccatccttttgccaataccacactgtcttgattactgaagctttatggtaagtcttgaagtcaggtaatatcagtcctctgactgttttccaatattgtgttggctattctggggcttttatctctccacataaactttagaatcagtttgtttatatccacaaaataacttgctggaatctgggttgggattgcattgaaaatatagattcttctttccaactgaaaagttgggaagaactgacatcttgacaatattgagtatttctatccatgcacatagactatctcttcatttatttagttctcctttgattttttttttatcagttttggagttgtcctcatatagatcttttacatattttgttagatttacacctaagtatttcattttcaggtagctaatatagacggtattttgtttttaatttcaaaatctactagtttattgttggtacataggagaatgtttgacttttgtatattaaccttctatcttgcaatcttgctataattgcttattttctccaggatttttgggtcaaacctggatttcctacatagacaatcatgtcatctatggataaagacaattttacttctttctttcccatcattatgccttttattttattttattttattttattttattttattttatttttcttgtcttgctgctttatctaggacctccattgtgatgctgttaagttcctggtctgataatttcaatattccttccatatctgattctgatgcttgatctgtctcttcaaacttttgcttttttcttttagtaagtcttgtaagtttttcttgacagccaaacataatgtactacgtagaagaaaaaaaagaacgacaataaataagcctttagtcatgtggtggttagatgtcaggggaggggaagtattatatagttatgtgattagatctcagtctcttggcaaccctgtacctctgaactgtgaacatctcaagtgtttcttaggtcctccacctcttttaggtggggcaagagggctagagtaaactggaattaggcatttcctttcttctatctggaaggctagagtgggctagagttgagtatttccctttccccaggttggttaggatctgatagaaccccaatagtttaggctcaggtgaaatattttctcttgaaggcaggccttattatgacacacagaatgctgtggcatgtttcaagatgtttcttcttttttcccttcccacttctggaagcatgaggggatttttctctaatattcattgtgagaacctggtccagctcctggaggtaaaaactcacaaaagcatgatagccctggatgaatggatccccttggagtttccatcattcagactggtccacatggagcctctagtaatccgtcagttagagtttaggcttttctactccagtactcgttcctgcggaggcttctgctaagggatttctgctcagataagttgtgattctctgtacccacctgtctgtctctccagttttggggacagcagtttgctctgtgacctcacttcttcgaaggatctaaagaaagttgttgctttcttttagttggtttagctgttcacgtgttggcacatgtgttaggacagagtgacatcttccaaactccttgcatgttgaaccgcctatatattgttattctcactatctaggatgtctaggaaagtaagaaaaagatcatgtgctggctctcattttgtcatcctcctgactcttcattttctttgagcctagggacaaaaatgaaggcctgttactttgtaagaagaaaaatgtcacatgttcataagtgaaatactgagcaaacatcgactcgatttttccctgaggaattgcttcaatctacacaaaagctccaccttcccaaagaggtccatcaaagtaaatctctaacatttgtgtttaaatggatagttatttctactatgagcacatcctgaacttcttttcctgccccagcaggttttcctggcacattacaactccaggctatcttgtatctgcttactacagctcaagcaggagaacagattgatttttgatgagaaatatgccttttctggggtttccttattctaccacaaacttggtccagagctcattgtttgtgaaatactgtcattcattattaagacgaacaatgatgcctgctgtgggaaatgtgcattttaaaatgcagttttcctcctttaaaattctgtggcttatttggtctcttcattctcctgtcattcgtcaaacacttgctataccccaagtgccttgctgtggttaagaggaatgagccaggttctgtctgtttgagggaaatggtacatgcatcacttccaattacatttctctaggcattttcaggagcagtaacttatgtatgggtaaaacttagaaatccaaaaccagccaaggggatgttttaggtagaatagtaaaagatcttgtatgcaattattgcatgaatcgcagtcgattactcaggtcattctaaattcattttagatgatttaaagaaacgtatccatattactaggatgtggtgaaatccactgtatagcaatttggggagtttaagaagtttcctttgggagttgatattatagacaatgacatgtattttataatttcttcagaggtttggctataaacaagacagttttgttgaaatctgttcatctactatcagttcctcttcctcaggaagagaatctgaaaaaaaaaggtaggtaatgtcaagttccaggggcagagaggggatagtgaatccatacttgatcttaaaaattgagcccacctatacttccagtcatcactctgtggcacattgaagagcatggagcccccacctggttttccaggcctactgtgcacaacagcattcctgtacctttaggctttcttatatctttcagctttctctccttactaagcaaataagatacatttagggaaggagggctaacaagaagacctgtaggggagcaaaatgcttgtgacttgtgcagtttagtcttcacaacaagagagagtagacttatcccctcttatatgttaccggtgaagacattgaggaatagagacctgttttgctcactcagattgtacttttcaggggaaggattcaatgcctggtaggtctgactctaaagccagggtttctcttgaaccagatctcagctctctttgaattcatcaaattggtatgaaggatttattatgcagagaatatttttaccttggacagatagtcagtaattgaagccagattccaaaggtggcaaagacctagataggaatgaaaaccatcttcaagtgttgtatatcctcagagggatttctgaaacattgtgtgttcaccagcagcattagttctcactcaatgtatcagtcatatttttccgcattacaaacaacctctaaaaccaagtagctgacagcaaatagcatgtattgtcttatttacaagactgcgggttggctgtggtttaactgatcaagactgggcttggcctaaccaagctggactcttggcttctgctgggcacaggtcttttccttctttttcatttcaggtacctgtctgaaagggcagtagttatctcggacattctctttccataccagcaaacactttaaaacttcacatctgctcacataccactgactaaagcaagtcagatggccaaagtcaacattgatggggcagggaaatatgttccacccagggtggcaggctctgcaaattcagatggcaaagataagcgaagaattgggaacacttatctaatccagcactctcagaaagtgatctaaaaaaggtgtcacaagagtctaatggtgttactgctcatgtcagacttgaagctatgtcctctgactcaacactggaattttaggaatgcctcacttgatatcttttggaatgtctttgaaaatgagttttaggatgatgtcctccagcagattttaattatatcatataatgtacttttaatcacaaaattgtatccaattatgtattatttttaatcataatcttagtccttcaaattcttttcatctctgtctcaatcagcaatagtgtggctgccattgtataccctatctaaaccatagaatagaagtcttgcccactggaccacccttttttaggcagattccacgtgctaccagcggatgaagtcagacagaactcagaatagagtgtcatggccaaggtctgtcttaagattcaaacatgaaaaggaaagattctccatgccaaatgttcacctcaggggagctgaacactgagaagttttacagaggaattcctagaattttgagggcagtttacaaactcaggccttcagggggcttgactatcactgaagagcaaaagccaatagtcaggggatttgagggctatctttctttcttctacactaagataataagggtgaatgctgctgagacggtgatgacgtgttcagcatgcctgcctctggagaatcatgcacctgtctgtgcctgtgagagcataaaagctccatgagacacaagtggtttacatcctgggagtcagtaacaaagctaagagaccctgtctggtgctgtgtccctgaaaggggtccttcagtctgtcctagtctagggatcctaggacacaggcctttgtcaaaaccccaagccaaggggacctagctgtcattctcctaggtcgtgtttttaagttgatcaaggtcacgtgcatggagtgtctaggccagcagaaactccagagagcagcacagaagtttgtatcctgccctccagtgagagggcttattctcataggcctcaggtggcacagaatcactgcaggatgctaggcagcctcctaggacacaggatcaggcaggtatttctcatgttcccaaatgtggcatgacaccatgttgagcacctattttgctttgagcccgaaggtggaaaggagaacaagacagacagagctctgtctcatggagcttaaattccagcagggtggacacacaataaccaagcaaacaaaacggacatcatttcaggtagtgataagagcagcaaaagacccctgcaatccaaggtgaggagtttagattttgcccatagtgcagaggaagccccactggggggctcctagcgtggatgtgacatggtgtgctttatgtttggaaagatcactagctaccaggactatgcaccatcgaatgccacccattcaataagcagaaactgcattttcatctctcagtagatcccaatatacgccttttctattcaaatgtgatgtcctcaatgaactcctttgattacccctgtagggaaaatgttcttttaaaaaagaatttctaaaaaccctattccaggtgattctatgagatctttcatctcctgtctcagaagacttatccaggggtagcaggaacagcttgcatagaatagaatttgtttcacgaaccatttctccagtcattattataattccttaggcaaaagatgatttcaaaaataccctccgaaatagacactggagctcataagtttgaggagctgatgaagcttgcatagattgtaaccttgtgtcctataaaaatgcagttcatttatacctgttttgcagagcagaggaaacacaacttgaaaggaaaacttcatgttttgcagttttttaaataaatgaaagaaaaagtgtctcaagaccaaagctgaatatagtagaatttatggagtatcatttgctttggcacacataatgtcaagtgaaatgaaagaatggtgtgaagagatgaggatgagaagaagtacagaatttcccttttccctttttatattatgactaattctagaggccctgctagggacatcagtgctaagttgaataaaataaaggaaggggtaagacaggaccatggggaaagaagcgatgtcacaaaagttctgtagtgagccagtgggccacaaatttacacgctccagtcatgtccagagtgatggtacctaaatgttcaagtgtaattgagccatcagaactgccagcttttctaccttctcaagagattccttgggccccacacacactctgcaatgaagacattaaatggtagaatgggtgctgtcacctgagaaagagggtagcacatctaattccatgggtcctctgggcatagcttatgcagaaggccatgtgtttggtgctctgaaacagctccctgcccacaggggcttccaatctgatttcctttctttggggtttcaaaccgtgtaacatccagactggagtgtctgacatagaggctttctggtatgttccatccattctgaggaccaacaacatgccaggttccaggctccaggctagggtatggagggggtgtgggctggtatactggtcctgtcccttgcttgagtcttccacgagccacttttcctctcctgtaaaatgggagatattatatacattttgaagggagttttcaaggtttgatttattttttgtggaagccagaggtggtttggcttctaagaatagcctaggctcccacccatgcccaccacagcatatcattactttctcttcaagcagatgcaagtccaaactgccttactgggttatattgagtctattaaaactgcatgacaaagtcacaccatactttgcacacctcttggcatttccttccttccttccttccttccttccttccttcctcctttccttccttccttcctttcttcctccctcccccttccttccttccttcctcccttccttcctcccttcccttcccttcccttcccttcccttctttctctctttctttctttccttctttctttctcctttctttcaacagggtttcactctgtcacccaggctggaatgcagcctccaattcctagtctcaagcaatcctcccatctcagcctcctgagtagctgggactgcaggcatgtgcctgggtgatttttattttttaattttgtagagataagatctctctatgttgccaagactggtctagaactccttggctcaagcaatcctcctgccaaaacatccccaaatgctaagattacaggcatgaaccaccgcacctggccttgggagttttcaatataaatccaaattaattctgttgaggtgatcagacccaacaccaggtcatgggggcgacgaagtccaccggagtcaaaggaatgagaaaaagtttgagagagaaagtgggaccagggagccatcacgagtggggaggctacgaaggtcccgagctctgggagccaaagaaacaggtagtgaggatgtgggggttgaaaggaagcagtgtatcaagtgaatgagaaacatatggctacttgagctaatgggagtgatagaagcaaggagccagcaagtctagcagatatgcaagccctacctcaacttctgtcccaacactcagcttttctcccaacaaattatctttgcctctttccctcaatacagtaaagtccaattacattgctgtccatttacagagcaactcatcttcctttttcttttctcttctactttccattgtattcttatgaaaattaaacgaggtaacacagataaatgctactaagtagagtgacttatacataataattgctcagtaaatgctaacagcagcggcactagcagcagtttattattatttcaagattgctgtcttgtctagtgagccaggtgtgcatgccaatgtgtgcctggactagatgacctttatactccccgaagtgaaatattatgttaccgtcgtgctgacagccagtgagctccccaactcctccccaattaattagctattttatagaacatttctctactgtgcatgtgctagaggttacaagtagaatacagtggagaaggggtgatcgcaagatcagacatgacacctcattgtctcagattcatcaatacattttgacagctgtcatggtttgactacccccaaaaagcagatttaaaggcaggggtttgtgtgtaagttgttaatttgggaggtgacttttggaaagagagacaaagaaaggaagcaaataaagaatgcattatcatgggatttgccactgtgggcaagtggagtgtgagctcactgagcaactctgggaaactataaagcacacacctcagcattatcccctgaggggtgagggagctgaggtgttagttaacccaacaactctcagtaatcattggttgaagaatgttttgggggtgccttgttccctggtcctttagacctgccctacatgtggcaaagtgagctctggccaccagaaggagcccttgggtaaaaggggctggcaccagaaggagccctcaggtaaaaggtttaagtcaaagcagcttgcaaggacacagcatatgccaagaagatacatgcagtgcatcgtcagcatctgctcttgttacccaacttatgaatatgccatgttatgtgtataatactcatataccaaagccagatcacaaaacagctgcaactccactctcttaacgacagactgtggccacctcacccttgcctactaggtgcccctttgtgctcctgggcgaagccagtgacacctttttagcattctgctgctgtgctcactgcagtaataggggcagtgtcactcttattacttcacctgttttatcttttgtgaaactcagcccttagccagaatggtctgagtggctggtctagcaagtgcttaacggtgaggctccttcagctcatttctctcaagtaatttgatttcattgcactatcagaattgcttttatgggttggaaggaggcctagggggaagaggttgacaaaagctgttttgagattaaaaaaaaaaaatgtattgcccagtacctgccatcacatcctccatctacaccctccaatctctcctcccgtgcatggtagggtgtgcgtgtgtgtgtgttcaggagaaattaaaataacaacacacaatgcatctcacatttgtatttcttttcacctgagcttgaaaagtatactgtttgatttcctgtgatccccacaacagaacttgtgtgctaagatggaaaaatattatggctatgttctctgaaattatcaagcaaagtgtaattttgcattgacagtcaatgttgacaatccctgttcaactgatgtcaacatattgatcaacccagtgatacatccttctcactcaggacaatcataggtttctatcagtgctgaaagtctcacgtttgataacttcataatatttttattttgagggtgtgcacgtgaataaaaataacacggtgccatgctttcctcattaaagagttggcaggaatagagagctcagaagtggatgtgaatttcatgtgcagagttcaagggagtttgatttttttaaactgctgctcctaacttctggatatttataacaatacagtaccaatttagagcttttagttacttggaaggctggttagtatagcaactactttctaaataatatgcagtctacacagggatttatgatttcataaaattgctggtgttttatcacagctttgggccccatgctcggctgggtggggtgaggatatggatgaaaaccctttgaggttaaaaccaccacaaaatacatttttcagctgaaaataaaatgattgagtgcataaagaatagtttttagatttgtgagtttcgcctggacattggtctctagagcgctgccttcttacaaactgcaagaaaggcagttaaagctgaggtgagacctggcaacagatctagaaggggatgttgacggaagccctgggcagactctgaatggtgcatggggttaaggttttaaagcctggcttaaatataccaaattattattataccaacattatgttcaattttattttaatttttttctagtgagaacctccttgaaatgattgatttaaagtatcaccatatgcctttctatgatatggtaatctatagccccaaatagactttcattttaaagtttaaaacaaaagctaatctgttgcttctgactccaaaaaggacagttttactggcagagtaagtcatgtctatctttattttagtggaatatgctagagttctagtaaacatatttgaattttatatcaggtgaacaaaattagtttctacatgacagcctttggacaaagttaaagataatagggaaatatcaataacagtaaaaaataaaaagtaaatagagaggaaaattgtccccagcaaagtgaaaaccagatttactgtagctgcattggaaccattctgggttttcaataattccaacaaacatacagtttagacatggggtagaatcttcaatgagtctttattgctatgtctttctgtagtgaaatttgatgaaaagaaacattggcttaataaccaagtgaaaggaaaatgtccacctaatgagttatttgatgtgctatggatgaaaacaactgtaaattcaacttgctgtttcacttctgtctcttttatttaaattgtcttgatggtctgctgacagaattggtcctttcttggcttaggaacatcactgctttgcagcgagaagacaggcaaatcataaaacttgtcttggcttctagttataaaaagtattgactagcctaaagctatctttaatagcttgaaatgtggtcaagagaatttaattagaaagtacatctcaacatgctaaataaatagatcagcagagattattaaaacacatcattttacactttcatatacttctggtgggagtgttattggcacagctgctttggaaaactggcagaatctcccagagtcaagcataacatggagtccagcagcccttcctcctggatatatactcaacagaaacacatgcttatgtccaccaagacatgtatgagaatgttcatggcagctttattcatattagtgtcaaactgggaatagtctagttgttcatcaacactcgactggataaacagattgtggaatatccatacaatggaatgcaacactacaatgaaataagctactgttatatgtaacaccatgggtaaatcaggcaggcataattttgaacaaaatatagacaaaaaagaacacacattatataattcatatatgtggagtataaaaacagacaaaactaacctttgatcatagaagtcagaatagtggttattttgagggctgggcattgactcaggacaaggcagctttctggggtattagaagtatcttataccttgagctgcataatggggtgtgtgtgtgtgtgtgtgtgtgtgtgcgcgtgtgtgtgtgcgcgcgtgtgtgcagtatataaaatatttgcaagcactttcaatacaaaagtaaataagaaaaaaatcatttatttatcgtataagtcaactttcacatttacaacaaaagttaattttatgaatctatgctaatgagtagaaaactaagctttggaatgccagtagaagcacagaatctgtgtgcacctggatacacacacatgcaactccctgcatgcctgaccctaaattattcatggcttgttcagcctcattgaccctcatacttggaagaaatttcccatgtcatctaattcagtgattcatctgaagcttgtctgtagcctcccctccgggtggccattctacttttgtgaacaaaagtcccctggtgaccagaatatgttgtgatgttctgaggaaggcctttttctcttggaagtccatccctaggctaaaatctgtctttgtctattcattggtcttatttataaccccggaggtcttgtagttaagtggagaaagaattgtcctgttgctgtttatcctgaacatcatgctttaccttgtatatccatgtccactgaaagcaggcatattatcagggatattcatcttgatatttttctccccttttaattaatcacaaaacatcttcctatgaggaactagattttcacataaatctctatatttttccccagggatgaaaagggatattctgaatataacaatctgttgagtaccttctcagcatcccttcctcctccccatactctaaggctaaacacccctgtgctcccaggagtgagccttttcctgttgtcaatatgtacaaagatccacaagtctgtaatccagtcagtcattcaacacctagttattgatcattctctatgtgccagcaatgttttaggtatccagtgataagcaaagacagatgtgttatctgcctcccagggttttcactctattaaggttattaatcacatatttacataaataaatgcagaactgcaactgtgatgggtctgtgaggtaaaggtacatggtattatgaaaacacaacatagggagtcatcagtgtcagagaagcctttcctgaagaagtgatcacctggcagaggacaaataaaatggatatacactaggaaaaaaggaggagaaatgtcatttcagaaagaggaaagagcatgagcaaggccttatgacaggaaggcaaaataaaaataccacattcaaagaccagaaagaaggccagtgtcgttgcagtggaggaaacaaagagcaatgcaacatgagatgagactagagagacaagaaagggccagcttattcaggggagaaatgttgccactaacttggggagtggcttgaagctagagtcggcttcaaatgattgtgatgcttgtgatgcttgtgaaagagtattccttggaaagtagctgagcaaacaaactaacgagaaaacaagttttgagagagctgtttaaatcagtaactttgaatcgggaatgttgcatcaaggtccagggcacgatccatggaggaagttgttgtggaagatgagcgggtcaatggactggctaagcgcggggtgggtcactcttgtggatgttgaaatcacgtggggttacagcaaaccttgaggttaagatgaaaaccataactcaatgccagatgctctgatgaatatgagagagtgaccaggaggtcacaaataattgagaactgaccatagttgccatggttctatgacaacttgtataatttctctgtggggaattatgtcttctaaaggtgaatgttaatactgatggtcattgcaactgagtgtgattgcagtatttattcgttttttatagccctataattttatgatgtaagtacttattcaacatacctaacatttggagaagaattttatgagatgagaataaataagagaagactgagaaataaatctagaaaggccccctggggtcattggaatgtgtaacacaaagctaaggtgcctgtgtttattctgtgttggagagtcaacaaaggctgcctctgttttgtgtaaggttgaggtgtaatgctaactatgcctatgcctaggaagaatcacttgaaagtggcttgcaggatagattggagaagggaaggaagaccaaaggagcacagctgtcaactacagttgtctgggtgagggccgatcagaccttgaatgaaatcaatgggaaagggaggaaaggaaggggcggtggaaaatagttcagagggacaatgcctttaggacttggttaccaacaggggagtccgtcaaacatggcggtaactaggagagaggtaaagccatagacagaaaccagaaagccagggatgacatttgttttaggtaggagcatgtattgcattgctggtgctgaagtgtattaaagggaagtatccaggcgattataaatctagatgttaaattcagggcagagatggactgaaaaggcctcctatggttaatcccctaacaggaaatgcccatcctggcctccttctccttctttttttttgagacagagtcttgctctgttgcccaggctggagtgcagtggcataatcttggctcactgcaacctctgcctcgcaggttcaagcaattccctgcctcagcctcccaagtagctggcattacaggtgcccgccaccacgtttggctaagttttgtatttttagtagagatggggtttcagcatcttggccaggctggtcttgagctcctgacctcgtgatcctcccacctcggcccttcaaagtgctggagttacaggcgtgagccaccgcacctggccgcctccttctccttctttgcagctcacccgtactctcattctgcttttctctcccgttcatttttcctaacctttcccattgattcctcgggactcacagcttatttctgagaataatgtctccttggttccccattttacagccctcttcctcaaatattctattatttcctgcaagcctcacacttctttctaacttagtcctctttatctgtgtccacatacccctaatacacttgtcatgctgcattttgtttgcctctttacttgtctatttcctcccctagactttgggcttttagaggacagggactcattaaaagtatgacatagctactcgtgtggggttcagtaatactttttaaataaattaactgacaattaactttaaagaaaatttaagagttttacattttggtgcattcatttaaagaaaacgaataggattaaacaattcataacaaatgcacaatcccaaatgtggtagacattgcaaaggttcaagaacttacgcacattttctgtataacagtcattgtctctaagaaaaattaagcttggctctgatttgttttgtcccctttcttaatgaactctctagcaaagcctgtagaaacctaatcaggaaagcaacacatattcttggaaatggggacaatatctgtctttttcttgtcctctcactcattttttttctgaagacgtactgagatctgaaccatcagtttgaactactagaatacatatttgccctccaataaaactgggtcttttaagtcttggttctctccatttccgcaacgtctctctctttctgcgtctgtatggaaaatgttccaggagactctggaccagaagatatcctcatagacaagccgtataaggaaaaaaagagggctgagtttaggatgctgggaatggcacacatttaatgaatgccgctagaaagaagccaggaaagaattggtcaaacaggaagaataagacgtggaagaaggcagggttgaaaaattcaggagaagaagtcacacattcatcaagacagaagtagattaatggttaccaggggctttgggtgacagattggggagtgaccgttaatgggtacagatttttgttttgggatgataaaaatattctggaattagtgatgatggcaagactttaaaaacatggtacaaaccactgaattgtaaactttaaaacaataagtaataaagtttaaaaaataaaaattctgtgagaggagaataaaacataaaaaaactagtcaaacacatctaacactagagagcttgaagataaattgaaaggtgatgggatttggtgattaggaaggcagtggtgagctcaaagagcgtagtttcagtagcatagttactcctatctcttctgcttcctgctctgtaaatatatacattgataaggttattccttcacataccatcactattggcagaatgtttgatgactctgcaggtccaggaatgtgtttggtttagatcagctatggtgacattctgaatgtgttttggagactctgagcatgtacgcttctgctctttgggacaaagcataagtctgtcattcttgctgcccttctaaaaccaaacctatgcaacaagacctgattatctcatgctgtctcaattccaagcatcacctctgatggccccaagtgaaacaggaaataccctctttgaattctgacaataagtttctgtggtatgtttcattggtggagttctgctggccttgtgactggcagaactgaccctggactaactgcatgttttctctgagacacatgtactttttttttaagctgaggataataaactttaatctgagcacttcttacaagaaaataatatgaaagtatattgtaatctattatgcatatgtaaatatgtttttaattgatattgttataagattagagacacaattaaattatttattgtctttttgttttttaaactctgtactggtgtaggaccagccttcttaatgcctgtgtgtaggatcacaggcttcatatccatgtacatcttactgaggcctgtacttattggttgaactgaatgttgtttaaatgagaaaactccagtatcatagcgtgattagcctcccttttgccttcatctttcgttgttcatttgttttttcctgctcttcatctaggctttcccaacgagcctgctgcagtcattgccctcaacaccattaaggaatggcttgccaagaatcaccatgaggtaggaggaacgacataatcagtgaacatccaagatgatgtaatttgatgctcagttccccccaaaaaagcacataaattttataaatatcaactacacctagtcattgagccaaacctagctgaccattcttcacttgggttacatgagtaattaaatgttttttggtaattgatagaatgcagcaactctattgatctatctggtgaagtgaccagattcatttagccataatctaatttttttacattggtggatagtatgggttatatgtgtgaaaaagagaaggggatggatttcattaagaataaggagttttcctatgctattttccttaaagctaagttatctttgttgacttgaggttcctggtgtacagtaattgtctggtatctgtgttctttggatttataactaatcacttccctaaagtcacttctgagtgtgagattgaagtgggcttgtataattgatcacaaaatcgttatgagcgggatttcttatgaaactaaataccttcatcagagtattcatcatcctcctattctgcttacttaataagatctttgtgatacgtttagtgatgaataggggaattactcaagtaaacaaagcagcaaaataactagagaccgtggagcgttaaatttcagagatttgtcagtttacatattgtaacagctaggaggtttcaggcaatgcacagtcttatgcatttttcttctgattttgtttttctcctcagttattcacataagggctataaaaattgtgtttcattttctgatggaccatgaatttagctattttccttgggtaggagatgaattatttggaaataattagatatggaaacaggtgacggggttttcaaatgagaaagcacttggtacttttgtgtgtttgaagaaacagcagtgtcattttctaattattgtaatttcggcatttgttgaccacgtggccaaacctatccatttgggtgcttaccctttattttcttcttactttgaaatgtataaatatggcaacttcaatttaaaggatatcttaaatcacctaaaagaagcaggagaaaaacaaatagctaaaatagccagcttacaaaacatgtctttgacacattttattttcttttcacaacaaccttatgaaatctctagggtaggtatatgttatcttcatctgcatttgccttcaaaaggttaaatgacatactcaagattggaaagtcacagagccaagagactaatccagctctcataactcactggacgttcctcattggaatgccaccaaggccagaaagagaaactcagttcctttaaaagccagttatcttcaatatattgcttggtcatagtaaatgttccacacctggattaactgctttgcaaaagtgtagcatgttgcatgagtgaaagttgataactgagcaagcgtatcagtgcatatccatcatttccactagaatagtaatccaaggatatgccccactggaggaagttttcatgcatcatcttgggatgtgatggacatatgcataaagtcatatcatcgaggatgtagtgatgaagaataaacatgttggtcacaggtacatctcatcaacaaattctactcattgattctctctagctaaattattcagaaagttattttccatagaaattttctaatctagtgttttctacttaattcacttgcctaccctatctttgagtccattcttttgctttcatatccttttatttttctgctaatttcttgggtccattgtagaaaatatagataatttggattgagaaactcagttattgctattgcaactgtaaacatatcctgtactgattcccttttaaaaaagacccctagtttcaatattctaatttaagcaagtcaatttgaacatatcaggtttttctaaataaatgaattataattggtaggtcttagataaaagctaaataaattgattagcagtattttgatttattttttcctctgttaaaacaaacaacagactaggttaaggacttataaaagagtattgcttctaattgttttctcttcattgcagtattattttgatgttctgattggttaagctacttattcattaattcactcatttgataaatatttattgactccccctaagcaacagatacttttttatattccagggacagagcactgaaaaacaaaatccttgctttgtcatattggtagtctagaaaaaaaaattatgtttgcttaacataaattaagcaaataaaaaataaagaaatagggaagttcaaagagtgctttacaaaataaaacagggcaattggagaatgtgtttttaggtagacgtgctgaggacgtaatcttggaatacagatttgtacaatgggaaggaggaagccaagccatacagaggtcttgagttaaaacattccacacagagagaaccataggagaaaagcctggaagagagaatgagctcactgcttgctagcaatgatgagacccaatgtggttgaagcagagagacgaaagaatggcaggagacaagtttggagaaatagacagagtcagattatagggtcttgtggttcatagagagactgtgaattttattctagtgggtagttgttgaagtgttttgggtaggagaataacacatataattcaccttttaaaaacaagcctggctgctcttccgaaaaggatatcttatatttataagatatcagagtaggaaatggcagaccaattaagaggatgctgcagtaaatccaggcaggagatgagggtgctctggaatacagtgatggtagaaaaggaggtaacaagcgtcaagtttggggtacactttgatgatgcagccaataggactagaggattgttttctgttaggatagggttatgctgcagttacaaactacccccaaatcttggtatcacaaacagcaaaggtatgtttcttgctcacactgtttgtacgtcttgagtcagcagagggaactgacttacaaatccgggctgacagatactttaccatgtgaaatatcatctatcacatgacaagaaaagatagataatcaattcccttgtagaaatgtttctacaaaggaatgatgtatataactttcactcacatttcattgtccagaaaaaggcacccagggactaagttccaggagacaagaaaatgcagcctttttgtatgttcagaatagagcaaactgaatattgacaaaaattagtaatgtctgttataaatgtaaatcagatgtgatatatgacaaaaagagaagaatcaaggatgacaactaaatttttggcctgagctgctgggtaaattttggtgcatttactgagatgaagaatattggtataagagcatgtttatatgaaaaatataaagaagacaagaattgtgttgccatgctacagatagttaagtctgaaatgattttagatatctaatgaagatttcaaatagacaattggctcttggagcctaaagctcaagatagaagtaggaaagaaagaccgggtgatattgatcagattaccataactttaacttgggttcggcctcagtttgagattgcttgcaagaaaaaggaatatagtcaaactagcttacataaaggagaatgtgttgtataagtgaactacattcttaaaaaaagtcttgaaatccaagggccggaactagagaggggtctcatgaattatagaatcccaaactataaatccaataagaaccaaggtagctcattttcattctctcccactccatctctatctctcccatgtctctgtttcattattattatcatgttgcatgttatcttttattctcattcacctgcttacgcgtggccccatcatgactgtgtctgtccattcatgggtcaatcagccctgcttgaggcaaggcctgggttcagtggataaggttgcattttctgaagctcttagctggtgaggttcccccaaaattttcctttaaaaaacaaaaaagaggaatctatgtaatgtgagtctcccatcagtgctcatgcttttcttattcagctgagtttattattcaacattcacaaatttcatagtttgtggctatcattccccataaataattgaggctgtcatataattgatgagcttttacatttcaccattaacttactctctgatttctaaaccatcaggaatgtgcactttttctttcccaacacagtagttgatttgcttatgtttaatttcataaatcaccgccagctggtgtagctggatacttccacacccagagaggtctgactagagtcccagtggtcaggagggggaaaatcatattctgttgcccaccatccacttgtttaatttacccaaagtctgaactccaagggcacagcatatatttaagaggactcagaaacccgaggggaggaacgctgctgcacacacagcacagtggctcaaacagtggcagctctagcagaagagctaaagcagcactttaacaaaaagaaaagaaaaaaaggagcattctcaaaaggctgtaattgaggcacaaaaatgacttagaactgaaaaacatgatgactcttgagttgaaaatcttaaaaaaacaaaaaagaatattcactactgagaaccgaattattgctatgagaagatcagatagatgaattatctcacaacacagaagagaaatacaaagaaatgacaatcatgactgaagaggtaaggtggcagagaaacccagggatcaaacatgaggcaggcagggtctgaagattacccactggcattttcagctaaattaagtattaagaacttctgagttcagaaaaccaaaagaaaagaatatcagagttggcagtaaaaattgacagcaggtagcatgataacctttctctaagtgcaccatttttctcaagtagtaactttattacagaaataggtgagcaaaataagggactgttatggaaatgaacagtagaaatgtggcctagatttctaagttggggtggctgctctgtgttatcaaatgcaatttcatgcattccttatttttcatgcaatctagaaatataattctttgcggaataggtatttccccactctgcagctctgagaccccctgctcatatctgaaagttagcctaagaaatgtttttacagtgcctgttctattgttctaccccagggactcatatggcatttggctattggtctctgagacaatgcacatatttgccattttttccacagaaaagtagaacaggatgcatttcacccttcagagccacaaatgtcctgatattgtgagacatttccaagtcatggtggtcatattcaatatttcagataccccaagggagcaagcatcctacagcacatagcaccatgtgttcgttttcccaggaagtcctgctagtcagggaatacggcttctaagatgacgattctgagctggaggatcagtggatttcccaggaacttttaaatgtggaaccctaaagtactgatcaaggattagttgtaacatgaaggaaacctgaacccctctcctcctaccatcaattataaagaagcagatagatggacagaaacccagcgttctaggaggctctaggtaaagctgtggccacctgcagctatccaaaggggagcccctggttcccctgaggcccggccccagcatcatctctgtgggctgttgaggatggactccttcccgctgcactactccaagggaattccctaatatcctccctcctatctatactgctctcctccctagacagatcccattgctctgggctggggacaattcaatggagaagtgtttggttcatctttgaaggcctttggctaggtcacctgcctagacttggaaatcactggcaaggaaaaaccccagctctgcattttcaaaacccaaatgggttttcttttatataggaggaaggtggtacttttctctcctcgcgtacaaggtttgggtctttgcccgacataattttttttaactatgcctttagcacaaacagattgttgttcaaaatgttaaatatcatctacttgtcatttaaatagtttactctgtgccttcggagggaaacacaacacctgtggtattgctgtttgtcacttaaagtagcaagcctacagatgtggcaggggatcctgagatgctgtatatgtgtggcagcatcgctctgagacagatgtccagctcggcaagttgatgccagccaaggctcccagacctcacccagtgtggtctagacctcaccgtaagatgccgatagccagagacaaaattagctttgagttcatccttgatgtcctttggaagtagagacgttggtttctactgcgtggaagcagttagccttgtcaccctcccttgccttccagtattcaggcacatgattcacaaactgctgaagaagctgaacatatttctccaccccagaaaacagaattaggaatccactgtagaaatgcacgtccagcctcctgagtggttcagatgctgctctcatgctgatttgacaagatcgagaacacagccacttgtttcctcattactgatcacaaagaaactgttgcactttaacttctggtgccaagactatttttcccccttcttggcagaggtctttgagcatatgcagtgttaaaaattgtttgccacttttatttcagcatcacgttatggatcaccgaaaaaaaaccccagtgtggggcctgccttatgtctctgacatgaaacgccttaggatctttgtgattcttaaaaagggggtttaaatgaaacatgaaatgatgcttacatttatgatgggaaaattatatatttcgaaacaagctccaaattcctgtggactattatttacacttatgcaaaaggcataatgtgccatcctccaattctatgcaatgcaggggtgtggttaacattcagagacctggaaggagcaaaggaaatgctccgtgctctctctcaggaatgcctttttatgtccacaaacatcatctgagtacctattatggtcttagtttttggtggaatttagtgttaaaatttgtgcacttgaaaaaataaattgcagctttgaaatggtcacatcctatgcagtaatgtggttatggtaataatcatcatcatcctaatatgctgccgtaaaaacgtatcctttgagtagcccaaatgtgtcgttcaggtggagccatgacactcataggctgtgacaccactgaggacagttagtcccagattttgcagatacgctgtgtcgcttttgctcttcaagaacactgatgacttgctaacattttatattttctctctacctctttatttttctctccctctctccctaccgttctctttctctctcactctcctttcttccctcctttccttctgtctccctccctctttcttccttcctccctcccttcctgcttctcccaattccctcctccctttttccttcctttttctttctttctccttccttccctccctccttccttccttctttctttctctctctccttccttcctttcttccttcctttctttttcttttttattttcttcttttctttccttttcttttttctttcttttcttttctcttctcttttctttttctttctttcttttcttccccccaccagcccgccccagcccagacaatcccttatcactctgagtctgtcattgtcgggatttgtgacaagcagttattgttcccacggttagaataaaagctaatccccaaggcagcttctccccttctgatgggggtgttccagtgcttggtgtcaccatacactgccacacaagagtttgccaagtggacagatccaccgacacttccagcttcaccctgctttagcatctctcacaattggcataatgaggttttggagccagaaactaaagccccaagacaacatcaagggttgctttcaggctccatagccctgttgtggtcaataggaagcacagtgcatgggaaaatatgcattttgctgtttcagttagtgagcttattaccagttagccagtgatggggagggctctaattacacacttttaggcgttgagctgagcttgcccaaatgccctgtcacccattcttactctggtggggagctcatcaaagttcaacaaatgttttgttttatttcctcccagtaggggatatcaggcaatcaaggccttggggtgctctagggacaccaacctacagtcctatgtagattagggtggcttgctgtcttctgcacttgcatataatcaatatacatcctcctcagccagccctcctgaacctagtactatgtccattatgccccactgtatctagataaacagaatggagtgcatgggaatgcagagagaacctagaaaaatactctgctgggggtgagtggtttggggggttgggattttgtttaaataggcatggagggtaattcatatatactgctaataggtctagaccttctagaaagagttctaggaggtatagaataggtacatgaaggagttaaagagggaagaaagaggtaagggaaatcaatatttatctgactcctgatgtgtcccatggcagaggcatggcccaaagatgcattctgtcttcacaaaactctcttcaaggtagttattttaaaatctttaatttcctagatgtgacagttaaaggaaattttaaaagtcaactaataagatactttcatgttctactataaccttgcttctgtggcctgtctagcgttgggcaccttacccagatttagccatacatgagaataaaaccaaaatagattgattagggtctttccatgggatttctttgccacctggagtcaggaataaaaaatggtggtgaacctgagggatgtggagcacagctaccgtgttccctaccattttggaaggttcttctttaagaagataatttgaagatgtcccagatttgagggcagttggcaagagtcacagaacccattctgttggctcaagtgaagaaccaaaactgaagcaaaaagcagtatattttagcaaaatgcaatggccacccattttaagtttttacaactcaaaaaataatttttaactagagaaaagaaaaggttgagaatcatttggagggttatttttttcaaaagtgtatgctttaaatagtttattctactcctttcagagaacctgtgctatgttgaaccactgtttatgatgagaatattttacatccttcagatgtgttggctggaaaaattttgagagtcactgtcctaaatagtaaaattagagtgctttttataaaatcagtctttcaatattcccttcatactggaggaccatcaaaagatagtaattaactaatgaattaattttctgatggctgtatttttctccttctttcctgcaacctggaggtaggaaacacacattaacagaagccagtgctgaggagagactaagaaatagcatgagacaggtgaaatgcaaactctttaaaatcaaacttcagggtgcaggtattaaaaaaaggagagagaatgcagtttgctcagatgacttggccaggatgttcctagggttgggattggtatatctgaaaaagaacggatccctttgcaaagtttggcttagaagttccaagcctgcaggaatgtactcaggagctcactatgtaacagaagctcagctcctcttccgtgcagcaggaatgggaattgtggctcctagaagtagagtggtaagaggtagggtgcagttataaccaccactgtgtaccctcactccaaagaggaagtttggtgttctaatcagaattttccacactcttacatagccttaaacaattaactccatctctctggactcagtttcttcatctgtaaaatagggagggtgggcatgtctcttctagcttcaggattctgtgccattgatgtgtgtcttctggagcaggcccactgatgcatcctggccatgcctttgaccatgtcttcatagcacaatcagacctgtaagaaggcttacactctgtgattctccaggctcctccagtggcataccaaagatcaagcaacatttgcatgtgctgtctgtatgcctttaagatgattaccaacccccatatgggtgtatctttagagttgatattaacaaccttgacccatttagtgtagaaggagaggccgccatgttgattttctgtaaatgatccggattatatggtggtttcaaaatagccaacttttaaagctccttatgaaattaaatgtgctgattatccaaatgatgtgacatttttataaatagaaagtaaacctctgagcatgtggttggaactacatcagacacagggataaaaacaacactgggaggtcctactgaaggacattctaacaaccattttctggagatagaagcatgcaccttcatcccttctaggtaggaaggaaaaagaaaccttttccttgtcctctaccttgatggactaggactcgtatgctgccctgattgaagggaaaattaacagttttgatacggtcatctagctcaactcagggaaaaacaaaaaaggcatttcccctttctagtggaagtaaatgatttgcttgttgatgggtgatgttttcagccaggctgctgtttccgatagaagctgtgaccagagctgaaccatctcattgtttctctaatcacgtctaggcaaagaggtggctcctctggaaagactagactcctttgatgatgccactgctactcactagggtaagaaaaccaaataggtctggcaaaacacttgcttctccaatttcatggctcaatggaaaacatactggaaaaaacatccgaagactgtgggtctctggccatgcaccgctggaggctgtaacggtgagcccagtgacagaagggctggctaacgtgctgtcctgcaatcagttatgtcgtctacatttctatttatgaaccccttcgaagtccatgacagaaagccccaaccttttagtgaggagactattcatttgcaagaagcagagaatagaagaatattgggggatctactattaactaaacttgtgttgaatagaagttactaaaacctggtcagattcacatctgtgattccaggttaagggcctcaggcaaggaagcgaagccccacgtggatcctgaaatactggccttagactcgattccacagcaaaggttgcagccacccagcatctgagctgctgggcaccagggcaagtgatggccagtgacaggaaggagctatgcacgcatatatcctctgttgtgtgcactctttaaaagaagagataaggagaaaaaaatatttaaatgatatcatttaagtttcacaataaaccattgactgaaataagacatatgaattctcttttcttccaatcggtccaaattttcacatgttccttagcttctttctgcattgatgtgatgctaagatgtaaagacttttagttgttgttgcttctctgacactgctcctcgatataagcgcaaaacttcaccttttgatcatggggtctttaaaaaaaggcccagcaatctcccctaaagctggagacaaaactgggtttcctggacttactgagatgtgatgtgtcagtttacaacataaggcctttctaatgaattttaaagaaaaattttgctcatgtgaaattttcactttatgtgctgaccttagagcttgaacattgcataagaataactcagctgtatatattttgcaacataaatgttgcctgtttgtaaccagcagatttcccttaggctgggcggcttcttctgccctgttacctactgaagtactcccctaatgaccaagaggttgctcagcttgtcagtgagacaagaaaattcttggagatgtgacaatcattctggacctattcctcacctgtaagataaggtgaaagtcatctaggaaaaatccttaaatcagatactggggcataccctaaatctactgtatcagaatatctgagaagatagtggcctatattttgaaaatttcttcaggtagtggttgagaaagattaggccagttgctctcaacaatcttttatggctaagacatactgcaataaaaactcccatttgttctcttcaataaggaaaaggctatgttaagtgagaactgtgagagtaaatctctcctctcaaccagtttacgactggccttctaacaaggggttaggagtctagggttggggctgtattgtctagctagtcctggggtggccacagcttactttctactcacaagcacttgacatgggttgaccaataagtgagtttgatgaagtttacacataatgtaactcaactcacattaaatatctttgggagttgctagacagcttttgtggcaccctgtaaacagtagaggccttttgccatcttttagaaaggattttagtatattcccaatatcctgttgatagtaatcattgtctctggatattgcctttgatgcctctatgcaagagatgcatttaataaattactaaaaatcattagcatacacaacttaattcttctttgagtacttattgtaggcagatttgaaaataaagccaacagggctatctcatggatcttatgtaattatattggttcctgaaacaacttttgagagtcaagtactcagtcatctgaagcaaattaattctccctggacatgaaggtgccattaagcatagcggcaagagatgattttccggttggtaccctgttgtcctttactgaagccggtttacaccaccctcatgtgaatcagaccctggatgtggagatacgtgccacccacggtgcttctaggtccccccaccgctggcacaattagatttctttaaggaattaggaaatgaaactctatattaaaattcattgctgagaacactacctaccttaatattttctgctgttcaaaattttcctctgaaaacaattagaggctgatggggtgtgcatttgacagtgcaaatggagctacaaatgacctgggtgggcttcagctaagcacagggcagcttaggaatgtattaagtggagtaattatctcatatggttttcccttgggttcagtgacatctacaaagttcgtttttctaagttcctccttctacaaatttaaactcaagggaaataggatccatatgtccctgattaatttgcactaactcatcaaacgttcttttctttgtaacttattagatgtctacagaggatttcaactgttttttataagttctttcaagcctttttgtctagaggcaggaaatggccatttgccagcagcaagcgaacccctaaatagtcacgttctgttcgggagtcaaaggaaaaagaaaatcccctgttttctaagtacagctgggtaatggttttctttagaggtgatgataaatgtattctctgaaatgtattattagacttgttaaatgtgtaattaaagggattccatgaagttgttgcagcaggaatgggatttaaattgcccccaaacccccttccacacacacattattactttacctgtgaaaatcttaaaagctgttggtttacccagcagcttagagccttgaactaagtgaaacatgaaatatcttcaatatatgtaccagaggctctgcgtgtgtgtgtgtgcgtgcacgtgtgtgagacattgacaagagaaagattgatatactcaaaccctacatcatactgtttttcataaatttccatattgaatccaagagacctcattttgaggatttaaaataatgtggcatcttgcttcattaccaataaaagtaagctttttggcctacccataataccccagggtaactggatttcaaaagcaaatcaacttgagcttggtctttcactaactaaaaatacagtcatgtgccacataatgacattttttgtcaacaacagaacacatgtaaaatggtgatctcataagattctaatgaagtagaaacattcttttcacctagtgatgttctgatgattctgaactgatgtgggcctaggctaatgagtgtttttgtcttcatttttgtaacaaaaaagttttaaaagtcaatgaacagatttaaaatgttaaaaacagaaaaaacttacagaataaggagataaagaaagaaaatatttttgtgcagctataaaatgtgtttctattttaaactgtgttattacaagagtcaaaagtttaaaaaataaaaaatacaataagttaaagttaatttatattaaagaaacaacattttcaaataaatttagggttgcctacatgtacagtgtgtataaagtccacaacagtgtacagtaatgaaccaggccttcacatgtactcaccactctcacccactggctttcccagagtaactcctagtcctgcaagctccattcatggtggatgccgtatgtaggtgtgccattttttaatcttttctactatacttttactgtaccttttccatgttcagatatgtttagatacacaagtacttatcattgtgttacaattacctacaatatggagaaaagcaacatgctgtacaggcttgtagcttaggagcaatagtctgtaccatataacctaggtgtgtggtagtctgtagcaccaggtttgtataagtatactctatgatgttcaaacaatagtgaaattgcctaatgacacatttctcggaatgtattccatcattaggtgatacataaccatatataaatgaaaaataatcacaggcattgaagtattgagtgcttcctttgtctaagtaccttacttgaattaaataatttaattatcacaaagatgctatgttatagtcataattattccccttttttgatgagatgagaaaacttagactttaaagatcatacagcaaataaatggcagttgagtttttaattcagaattccaagttcataactacaatcatcaaaagcattgtattttcccttaatgataaaagtaaactaccgtatcagagatctcctttcaatgcttatgaatctcactacagtctaattcagatctcttctagcattatcccatgtcaccctccatgctgcagctcatacaacttagaaagagttgcttggtaatttatttgtgaaaccaagatggcaggtccatggtttggtcaacttttattgtcttgcctttagcacaatgccaggaccatactcattgcaagttgaatgaaataatttacaaatgggaccttttattatccagcctgctgctcttataagctcctaaggcttcatgtgattagaactagagctgaatagtcatttgtggtatcaacatttctaagccatggatatttccattagttcattagtcaaacatgatcaaatgattaacaagcccaggaaatttcaaaatctccctgagagcaggaccctaatagtgactaatttctcagcgatcagtgctgcctttgttgcaaacacatggctcttgagattacagagtaaaatctgtacttactcctgttatctctgctcaaatactgcatctttggtgaatttttccttggccttaggaaaacttttcccttccaaatatcactgtcttttactgtggttgtggatgtacctgtcagctttcccactgactcaaggactgcaattgtgtaaattcatccatgcattgtttttgttttgtgttttaatccaaggagcctggcacataaaaagctttgacaaaaatgcattgaatgaacgaatgttttgaattgtttcttaaatgatggagctgagcatgtataaagccagtgtatctgtctcatacagattaagattcaagccttgaactctgttcctatcctcaaatgaggaaagggactgaaaaccagccctagtgtgcagagattcagccagactctggatgtagcccaggcttggagaaaattctaccctgctctttcctttatcttggacagatggcagtgtgctggagttaggcagctttagactgttgtctaaaatgggaagcttatcctcaggacaaattggagacagtcaagacttcagaaagctcacccccaagcctgagcttatgatctgttgatctatagctgatgggcacacggcttaccccgtttgcctgctttgctttctcttttcctgcaaaggcttgtgtgattttaaacaccagacaaccttggtctttaggtaactgcattatccttttttcagttaatctacttttaatttttctctctttttttagtccactcaacattgtcaacactgtcaaagatgtcaatgttttcatttccagttctgatgatactattttttaattgtcatgtatttccatatgtaacctgtttctgaaaggaaaatatgcccttcaaaaaaaatgttggcagcttagatttcatgtgtaattctttcaaaagcctctcagtctttatttatttatttagcaaatattcactgagtagctggcacaccctaggcattgcacactatttatacaaaagcagttgatatacaattcctgtcctaagaaagcttacggtctgttggagaaaacacaaagaggcaatgatcacaggataatgtggaaagtgctaggataaagggtgcccagggcagtgcgggtgctgggcagaggacagagtcaaggaagactctgggtgcgttctggtttgaacagaaggtagagggcagcctgaatgtttttcctggggctttttcttttccttgggagtgaaatccaaatgcctgtcttaccacaagaccaagaacacctgatcctcggtccacagactcaagaggtctcagagagtttgtaaatttggggcaaagtttacagttattttcactaacctctagttaaaatttagtactttctcccatcatgactgtagccgcaaatcacagtggtatcagcagtctttgtgactttgttatcagtagaaatcacagatatttcctatcacataacagttgttgcagagatctcaaaacactacttatgctcatcttgactttgaattatggtagacccaccataagatcttgtttcaatgtgttcataagtagtatgcaacgtaaccacataacacattgtttccttgtaaatggtatctcaaaaaaaactgtttcttttgtaatcttttgtatttttatttatttaaaaaccatattctgggaaggatccataggttctgctcaactactgaagaggtccatgttactaaaaagtcccggtggccaccacataccatttctcccttgctcctaccctccagcctccttggcctctgactccacccgtcaccctcatgctccaggccaccaccacatttgcaggtccccccacttataaggctcttcctaaagctctctgctcacactgacttcttttattcaggtcttatctcacacagcacctcttcacaaagaccttttcctgaacccccacacaaagtagacctgccctcctttcactctccctcacttcaccatttgatttttgtgtacaattcatcgctactggaaaagcgtatatgtattggtttatcggctgtcatcttactagagtggcacctatatcagagcaaggacttcaaatggcttgttctcttttatattcccagaacattgaacaatgcctggaaggtagtaggggcttaataaatgttcactgaacaaaaagtaataaatgagcgaatgggagggggagtagagaaaggggtatgccagacagcaatcagcgacaaagatgcagaggtgacaagaagcctgaatccaggagcgtttactgcaaagactgacagcaatgggccccttgtgcgcagggtcccttggccctctcactctttcctggcccctcagcagaaataaaacaggctcataggactctttttgataagagtagagaatacagtttgaagaactcatagtcttaacagataaatctggaaaatgctaatggagcaggttgccgagccatttcttattgcccaaccctgctgcctctttcacctagtaaagatgaacagacatgatttgcataacgtgcaggcacagaccatcaaaagtctggaaatgaatagagctggcaacagacattcttttcaaaggcatctgccataaagctagactcctgagagaacttgcagcatacaattttgggtgcccaaagagcatgctttatgagggagaaaaaaggtgatgggttcattgttgccagaatgtagtgtcttgacacacagtttgagatgtctgaatctgacatttaatagctgagatgatagtggtcaaatacttctcgaggtcagattcatgcagagttcctgaaaaggtgagaaatcactgagatctgtaatgacaaagctgatgagaagattgatgaaatggtggtggcaacaggacaagtcttcaaaatagcttgtgaatgatttattttgtagcagcagagccaattgacaatagcggattgctaattaaataccaaccactgggaaaataccataaatttcttttggctcagtattggcaattgtgtactttgaagcagaggccaaattattttccagtgagtgcttcattttagacctaaattttgtgggcctccatctctttttgctttcccttcaacctccagcatatttgatttaaaagcaaaaaggagaagagggaagaagaaagaaggggaagaagagattgaagaagagaaagaacaggtgggaagaagggaagaaagagggaggaagaaagacactcccaagtgtcctaataacatcctatcagaaaggcttatggccacgtgcggtggctcacacctgtaatcccaacactttgtgaggctgaggcaggaggattgcttgaggccaacagttcaagaatagcctgggtaacattgtgagaccctgtttctacaaacaataaaaaaaagtcttgctttcattcttttccagtctgtggctaattaggaaactataataactacagtttattgagaacctatcataagattggtgttttgctaagtgtttatgttcagtaagagttaacatttactattttctatgtgccggacattgtgctaagtgtgaattctcaccaggacactatgaagtaggaactgttaactcgctctttccttccttccttccttccttccttccttccttccttccttccttccttccttccttccttcctttctttctttctttttctcttgctctgtcgcccaggctggagtgcagtggcacgacctcggctcactgcaagctccgcctcctgggttcacaccattctcctgtctcagcctcccaagtagctgggaccacaggtgcccgccaccacacccggctaattttttttgtttgttttttgaattttttagtagagacagggtttcaccgtgttagccaggatggcctcgatctccttaccttgtgatcctcccaccttggcctcccaaagtactgagattacaggcgtgagtcaccgtgcccagccgtttctctgtttttcttataaatgaggaaactgaggcagatagtcttgtttgaaatacactgccattttttaatgagtgtgagaatttctgtaaaacaatttttaaagaaactttttatatgaaactagttgataagaattatagtttgctaagaaatacaattgaggcaatttaaggagaatctgtaagataaataagccgtatatttaaattaactgctggctacagttaggaaataaaagagatggagtcttactcctcaaatgagtaaagtgcgaagtgacctcagtttagaaagcagttaagatgggctggaagaatgaggtaagaatctggtacctagagaagccttatctccctctgtccactctctggtttgcactaggttggagaaagccattcttggagtcagggattaatgaatgtgggaatgcagagcaaaatgaggttgctctccccaacagttccataatctgaacctctatagctgattgtcaagggccgacctgcaaaggcttttgtggcaaagtcgaggagaagcctagaactccatgcgatgcagaggagtctcttctgttggagttaggggaagcggcgagaataaaagaagcactgcaatcaattccaacaaataaaatgagaactgggaaaacttatcatagaaaaatgaaaacttataatagaaaaatgattaatgatgaaaataggtaaatgtttctttaaatggctttttggatagaactgatctatttttttcagttaatgtagattaccatttggtggtatcacgaagcttttatgtttaaaatccacactgggaaaggactaaataaagttccacatggatgtcaggagaagaacctgtcttataattttgtgaagtgtctagattggggcaaatacccacagggagtggttatggcatggagaccttccccaacatggtggaaccacactttctggagcgagtcaaagtgccaatgaaccaaagtgaatgcagtgataactgcaagagcaggccatccatccctttcaccctggggtgatgactatagcgatgccagcgtgacattgaaaaccaggacacattaacacatttgtcacccctatgtttttaaagcttaagaggagcctagagcttcaagattccctctagtaacaaagacccccaactgccatgacaattaatcctgtggaaagctgagggtagagtgaacagaggaacggcaagatcccattggctgtatggtatgccgggtccctctgtggcactactgagagtcagacgggcccctgatatgctgcatactgaagagactacacacatgtatgaaacagcaggtggggtttagatattctctgatcaagttccttcacttgtttctctgacagaatccctggcctgtgccttaacaacatccacacattcatcttcccactacttcttgataatgagtttgaaaacttgccatggactgcacatagatctcactagagttcatggcggagctgcagccctcaacttcagccagcctttcattctgtttctcatcagatacatttaatggcaagtgggtgtttaaaccacagggaagggacagcaagaacaaatatataattagacatgtttcctggctgtgtgctttgtggataggcctgtaggttttctcctgggtgacttgccctaattgtatcatcagcttcccccagcagacaactgggctgagtttgatccatgaacttgaagcacgaggtgaagaatcgtgcatctacaagagcaattataattataattaagagtgggttggttttcttttcggtttgccttctcgtttttcagtgagcatggcagggatttccattaataataaagacattctagagatgtagaattaggaactggtcgactctggttaattggcatactattgtattcccataaattctgtctgggactgctgtgaatagatttaaagctactaggaagaaataaaatatacagccctttacaatgaagttgttttaagcttgaagcttttgtgtttttagtgactttgaagccggataagtattaacttgagtattttattgtggagaatgctaaagtaacggacatgataagagtttctggtggatattcataaactgcctttggatctgggagacagagagttttatgaaactgtgtaaaaatgtaaataacagtatggcacacatttactttctgccacctcttgggtagtccattctcctcatttcctctcagaaaaagcaagattatggacggtaaaaacccaactatatttataattgggatatgctaattgcagtattttaaagaagctaacacagctcaaaataaacagcattttcaatttacaaatagtgataacaaagattaaatggggattttctttggagcacaatttacagtggattttagtgaaagttgaaggagccaagtcagttcgtatgcagcttaaaagcatgttttaactggcgttgtcttcaggccacaggcccttcagtggtagaaagaacaccagaatggggtcagcaggtttattaactggaagtctttggacttaagttgctgaagatctctattagtttgcccatctttgaaatggagaagataatgtataattcacaaggctggtgataatattcatatgcagggtcaggactagggtgaggtaatcaaggtgcttgggatgcacagtttaaggaggcaggtctcagccgccaactctgtgcttgcatagccctcatattctgcaccccaggagcctccttcacctctctctagtcctagtgctgtaaaagaggtagccctattaccatgcctggatcatatggaggctcaaaataaaatgtttttctactgtttgtcctgtctgcctcatagatatcttttgaaaagtacatagggaaaaatagagaaatgtactcaatgcagtgctctacaaatgttagctgatactaaatcacaccaaatcactagtaaacccctgctacagttattagttgcaatggtgttctcatttgcaaagatacatgtgtgtgtatatacaaacaatagatattatggtcgtttgaagaatttcaatgaaaaatgtgtattactgtgttgagagtagccctttaaagtaggattgtattttttcctgaggacaaattataagctttgtgaaattagggatggtcttctcttgccttatttaatttgactgccagcccagcaccgtaagtatataggcaaattgtatcagaaaattagtagggttggaaaaataaatcagaactgaacattgttctagacttggatggcctttagctggcaactggtgctaactgctgggtgactggagacagcaatgggtatggcaagggtttctggtagatatacgtaagcctgccttttggatctaggagacggagagttttatgaaactttttaaaagtgaaaatgacagtatgacacaaattcactttctgccacctcttgggtagtccatctatctcattacaactccagcaaaagcaaaattattgatgataaaaatccaaccatttggacaattacaagttaaactggggaagatgcataagtaggcagctagagggactggtgttcttaccacccagaaactggatcatttgggagagaagcgcaacaaaaccagccatctatggcagtctctgacgaagccttaagcaccctttaaagagattctacaagaattgcctgactccatatgatttaaaagctaaatttattcagagaaaagaaagattttttgctgagggaaggacgttgctgtatgtttcatcacttgagtcgtggcagataatttgggttgagttcaaacacaatgtacttttcaaaatgtaaatctgtgaagaaaagctgaatttttagagccatcacagttttagaaattttatgctgtaatctgattttgtagtcaaggtcagtggctaaagaatgctgttggaagggcctagtctgggtcagacaaaggaccgatttggggaagatttggctgatgtcttcttttgtgcagggagagttattctctcactgggttttctgtgcaccagtagggaaagaagctgcacacacatggtatgtgtgtctgtgttactccaaaacccatcccaggctgtgctgcagtccttagtgaaacggagagattttgatgagtcaccaataactggtttcctgggactgatcatttaacatatacaagcgcactcagatttctgctgtggtttagaatagactggggggtgaaaacctgcccaggtctctgtttcatattgtgggaaatgtttgtcttcattctttctccatagagaggtggtttccatgatcgatggacagtctgaagtctagaataatggtaactatcatgttctgagcttgtgtagctatcatgttctctatcttgtgatgtgccaggccttattccaggtccttcatgtcgcaccagcctcgtgatctaggtgttctcttgtctttattttccagatctaggaactgcagcacagctaagttccatgatcaaggtagtaaatgtccctgctgtatgtacctcgcccgggctcacactcatcctgatgcagtaacttggaagtcctttgtctgtgtgcacattcatgtttgcttttgaagaacactgaagagattctactttgaacagaaaatatttacaccgaggtccttgttctctctgttgagtgctaaaagtgagggccaccaaggcaaagtgacaagtggtgccaggctctcagatttgatgcttctgcttggggtagatttgtgaggggatctccaactccagccctttcaggggccaaggcaggccacgtgaatgagtgaagcaggctgggcagagactccactaacttgctagtgtcccttggacacagctgcagacacttgttgccaggaaggattagccagggttgcctcatagtttaatttttctggagaagtcaagcattgagattaaaaaatttttgtaacaaatgttgagaattaattttaaaacttttttaaacagtacaaactaacccaaacatatctatgggccagatatagctaatgggctgtcatttctatataatttctgttctaggtgaatgatgcgtcacctacaaaaggctttggtttcttgatcttcctgttaggaggaaaaggagctatcacctataggaaatcccaggactggggaattgtataatagagggacttattttctgtgtagtgcctaggtatagccctgtacactttatctctctgcactataccgttccttgagcactagctacatgtagctattttaattaaaattaaagttaaataaaattaaaagttcaattacctacttttaccaaccacatttcaaggactcaatagtcacatgtggctggtggctaccatattggacagagcaaagtagaacatttctattgtcactgaggttctactgaatagtccaagtccaactctagattcttaggctctggcagcccaggctatcttacaactaaatgttctttctggtattggctcttcctggtattggccaacagttactgcgattgccccactggcttaagcttgtttgctttgcttaggtctttccattagtccaaaaatatctcagcattcggccatttccaggtgccttactgttggctcataaagatgtgtttggtgatgatgtttggtcaccaaagaagaaaggaactcttgttacctcttgcacttctccctcagactatttactgccattataatgttatatttgttgggaagtgaatgcttactctccactagaatcccactaagagccccaaggaaagggatcatgtgcttgccattttttcttcggttccctacagagttcctggcagagtggtcagccacaactgttggataaagttaagccctgggtaggataattttcctttacaacagtatgtccagtgtaggcaaaacatcattcccaacaagaaaaatggcacatctcaaaaaaagtaatttccatcatgtgttggcttataacgtgccatggtgagattcagaaccacaaggtccctgttcctttcacagtaatgaacccaaagcaattgaatgcagagctatcaacatgaataagggcaagtcaactaggactttcttatgcatccagcattaaagagtttttgttaacatccacagtaactagtgaaactttgtgtgaaaacattcacagtaactagtgaaactttgtgtgtttctgaggtcacattaaaaggcggtttgggtaggctaattatccttttatcatcctttttggtgttatgactattcaacctctttttatataaacttaaatatcctttgctcacacaatgatccagacagctggatactccttatagggtagtcaagagtattcagaggtccctcttcaacatctactggctgccatggctgagcatcacatccaatgtaaaaagctgaatattcttgggacaaattaatattgatggttagaaataataaaataaaaagatgttttatttttaacatctaataaaataaaaagatgtttttctttaagttttcaaaaagagaaaatagatttttctttatttcagaaaaggaaggatgtacggcattactgtaagctccacaaaggcaaggactatggttttggggattgtccttagaatgtctttccttcaggtccatctagtgagagtcttttaaaaaatatatcagatgctgtggcggacaccaaaccaattgtatccctcattcccttgctgtaagttagacaaaataagctagctggaccccaaatatctgatcttttgaaacaattagatgacaatgatggaatgatatataattaggaatcaccaaaaatagttcaggtataacataaatcctctagagagttgaagaaagatgagaatatttggggctaaactgatgaggcaaggctttatggaaaaagtgagaaaaattgacccaaagatgtgaataggtgagagagtggaagggaagtcattaacattggaggagagagaaaaaggagactgaatcctggtatgagccaagtagcaagaatgagtagacaggatatgtttatagaacagtaatgattctgatttgactttttactgagaaaaggtgggttgactgttttcagccaattatatatgagatgcagaagttggatctactaacttgatttagccagcaacacatagttagaaatgagtaaaaccatattgggcgtgtgggggctctgcctgtggtagttgacacttctttttttggccaggatggcttggttgatctgggcattaaaagaggatgcccttctttcctaaaagtgaccttcctagatagcaaatagaagataatgactactgtttagtcaatgaaagatgtgcagtccccaaataatcaatatttcctaggcacaattcatttatgttttgtttgtttcaaaattttgctagcaagtatctcaccacgtattggaaatgagaaagatatgaccatcttattttggtaacagttgtcgtgggtgaatgccaaaatattatgtaaaataaaacctttaagtatggggaagtaagctcactatctcagctttccctccccttgtctgagctcagagcatcaagctgttaaggactgtaccagtgactgcatgtgttccccagagaaaatgaaatgagcccaccagatatcagtaaatatttcttactgttttggtttccatgtgtcttaagtgtgaattttgagtaaaggttttattcaagcaaaaggctccttactcattttttctacaataatattactaaagtttagttaatggtattcaactatctgttctactcagcaacataatgtaatcttatgaaataagaaattatctgaaagggcatttcttttcacatggctttataaagcatccgtgttgaatgtttgatggagaaaatgagttaataacatgagaggtttatgcattaactatttaataaccagtggattcaggtaattctgtttctcctgctaccacccgaagtcacaccgctccccagattcctgatgtgttgcagccatttttctccctatatcataactacccagcactaccctgcaaatcctcagagactgcccataggccatctgatcatcagtgtaaggcttcagaatgatctgaggtccactactggcctctgcatttcttccttggagtccattcacacaatttagtaaatatctctccagtgtttctccaaaaggcaaaatccaaacactgatgtttggtgcacatgaggccaggaaagggatttgcgagctgctctagattctcatattttccaaatccctttttcttctccccttcagtgccttctgtctttttctccattttctccatagcacttatcaacacttgacaaactatatcctttgttcatttagcttgtttgttgcctaacaagttcccagtagaaagcaagtattataaagacaaggatttttgattattttatctgctgttatatctccagtacctagaataatgcctggcacacagttagtgttcaataaatatttgtagaaagactaatatagagcaatgtttctcaacctggggcaacttagccctccaggggtatttggcaacgtctggacacatttttttttatttgagacagagtcttgctctttgcccaggctggagtgcagtggcatgatcttggctcactgtaacctccacctcccgggctcaaacaattctcctgcctcagcctcctgagtagctgggactacaggcatgtgccaccacacccagctaatttttgtatttttagtagacatggggtttcaccatattggtcaggctcctcttgaactcctgacctgccttggcctcccaaagtgctggggttacaggcatgagccactgcgcctggcctggatgcttttttatcatgaggattgaagggataagcagtgctattggcttcctacaatgcacagaacagtctcttaccacaaaggattatctggctccaaatgctgaagttaggaagccctgatgtggagcacagaatccttgggagccctgccaagaaggctggctaccatctctcctgtggctctctggcttatctcctggactgtggctctttctgtctcatctcctgaccacacacttctgtttgcgttttttcatccagaaattaaaatatctcatttgttcctttgcagttatgtggtttttttttttttcagttcctttaccaccactactttaatgtagctttttgaagaagaagaagcaaatgcctgagcttagctgccatcttgaactcgaaactcttatcacttttatcttgtttgagtcaccatttctctgaagtctgtaatatgactgctaccaatacagcattctctcttctctgaattcttagaatacttaccatcagttttgaccatttgggtaatgtattagatagaattactgctctaacaaagacactcctaatgtaactattaatatatcttaaagaagatggaagtttatttctccccaatgtaacattctcaaattgggaggcctgagtcagtagtagacaccactgctccacgtgattgatcagattcaggctcctccaccttgctactctcccattcttgatcattgttctcagccaaaaggagaagagctggaagtagacagttcttgttctcagtttgagagaaaacgagaaagaaacagtcctgtttagcatttttcttctaaatatgtgctctgtgggatgcgtgtgtgtgtgtgtgcatgcctgtgtgtgtgtgtgtgtgtaagtgttaatatatttatttctggaagataggatcacaagatttgtaactttaattattttgctcctttatatttttccaattgtttttacattgaacctatactatatatatatttgtggctgacattagatattctttaactatttgttaaagaattactattaaattaaacgtctatgtaaagatcttcctttagaagggtaggaaataaccaagtggaggatagaggcttcttttagacaacaaagaactcaagcaactgtaaatacaagcaaaaaaatgtaaagccatgtttgtgattttaagtgaattgaaaaaaaaatctcttaaagtatatctttaaactgtaatagttacgtatatgttgtataacctttcaaaaaacaaatcaaatgaatcagatgtttgacacagtagaattaaaactcctaacttgactgatatccgccccccccacctttgaccgattatgttgacatttaacaaattaaagttaaatttaggagttgggagaaagaaagggaatatacaatgggaggtggacaaaacagtgtgggagagtggacacagaataagggccacggtgtgtattcagagaggtgacagacatcaacatatgttcatcagcaagtgacggaggtcaacaggtagaagaaatttgagtgaggacatgggacatttatcagcaaagacatgaaaataagacagtaaataaagcttgtatttgaaacagaaaaaattaagtggaagtaactgataataaacctgatttaattaggcctaaaaagttttatttgttacctgttagtcaccatattttaacccttctttggccatatgtagaattagctgctgtccctctaccaaccttaagagatatgaaagtggggaaatggaaactcatcccaagaggacagttgaggttcatttgatgaaggagacagaaagctttgggttaaagattaagtgatccctttgcaaattaattcttatactaaggtactgtgaacatgggtcagttttcaagggtttctttaggtttaataccataatactaagatttcagtagcatgattattgagcaacataaatagtgtatacatttttccaagctgtttttttaattaagatattatgggccaggcatggtggctcacgcctgtaatcccagcactttggtaggctgaggcgggcggatcacgaggttaggaaatcgagaccatcctggctaacacggtgaaaacccgtctctactaaaaatacaaaaaattagccgggcgtagtggcaggcgcctgtagtcccagctactcaggaggctgaggcaggagaatggcatgaacccgggagccgagattgcgccactgcactctatcctgggtgacagagtgagactccatctcacaaaaaaaaaaaaaaaaaaagatactatgaacatttttactttccatgtacgcgtataatgttttttctgattatgtaacagtctatggagtggaagttccaattaatatactcctgacaagattagcaaggttggctatcagatgtatatttattgaagaaaatatttatttgacaccacttattggtttattctttatccttagatactttttaatgaaacaaaatctttctacattttgattgtcataggtgacttatttaagttgaaaaaaataacttcgctttttttttttttttacaaattgctggagttgtacatcgatgagttaaagcttataattttaaatattaataattaagaatagagcaagtgctgctgccatttattcaaaaagaggcaagagatgttaaaatgaaatcgataaatgtatttgttgaaaattaccagaataaataggaaaaaaattttaatattttgaatgaaaaggctagaatatgacatattctaaatcccattgtattttacttctctgaaaattattttaagattatacatttctatataattatttttacaaaatatgatttaataacataaacaaaaataaaatataaacatgtattatttatgttaattttctctttattaatattttttcttctcctccagcttattattataaaaatcttcaaatatagaaaaattcaaaacatagaacagtaaacacctgtgtcacctctaagatttaacggctgttatattgtaggaaaataaaaacttatttgctgtatgaatatatgaagtactgaaatagaataaaaacatacaaagtagtataaacacacttttatttctgtaccacattattgatattgtattgatacattgttatatttttgaagaatcacaataaactctagattggagaaatactcactcatagactcaggccctggaaactaggagagtccagtgcaatcgtttttgttatgactcgttctcttttatttttctcctttctttttaaatcttctttgtctttctatctgacagaagaataaaatttagcaaaataattattcactaaagaaatatctaaatgaatattggttacataccaaagatcgaataattgcattctataatagggaagtctgttgtctttgtggttggttggtcttgtgttatacagttcatgaatacataaataaaattcgtgtgtcttttgcaaattactcttttattgtgttccttggaaataaatcactataactaacatgtattgagtactgaatgccttttttctttttgtaatagactggagtgaatttagttctgcatggtaagaacttagtatatgtagtaagtcaattttaacttactggtaagtgacattttaatgaaacatttttaaatgggcagatctagtgttgccagataagctgaagcatgctcagttagatttgaattcagatgtacaatgaataattaccttaatataaatgtgtcctaaatattgcataggacatacttatactaaaataattactcattgttcatctgaaattcagatataagtggatgttctgtattttgctttgctaaatctctcaaccctagcagaatgtgatatgttagatgtttggtcatctagggttttgtttcatatactttttttgtctttttattttatgccagaatcatgatttagacaaaatattttgcaagttttagctacctatctgaaatgttggaagcaaaccaatcaacaaacttggcaccgtcactgaggaagagagaaaagtgaggtatattaagttactcaaccatattttttattttatttttactcattgattataattttttctctaagtataccaattatataaactcaattataagaacaaacaagtgaaacaaaacaaaataaaccaaaaaataagcacacctaaaaaacacagaatgctacaaacacactacctcatattaaatgtattgccctccagaatcagcctctgttctctgaaaaacactgacctgggtcttaggaaatcttaccccccatcctggtgttgtccttatgagctctctggcatgagcaagtatcttagtctcctaggattctggttctcatctgtcaattaaagggtttgaaagattgatatctgaggtcatttccagacctgaggttagagtagcccatgatttcagcttcaagttcctggacaataattatgtatccatagcactcatgagccctgtacttgtttaattaatctgtgtttgcttgttttttaaactgcaccatttctatgtcttcattcttctttattgaaatggatttagttttcatcttaataggtgtaatgatgttattcatgcaaagcaataattcaaaattaaatccaaaggaaatcttttagcagtattcacattaagatgctggatgtgccctttaaataaagtcagcatttctccctaatgattttgaggctcattctaaaagtttaatgccagaataaaatggtattttccttgggaagaacaattttggtggtcccattgtagagcaatctttttaagagaattgcagaaggtaaaaagaaatgtacatagatcgtgataattttaggcattaggacagtgctacataagacagatgctttctaccgtaatttataaacatacgctttaggacatgtaatttttcccatttgtattacggggtactttaagtgtagttgtaatactttagagttatttcagacaacaaaaaaacccttagagatcatctatccaactttctgtctctgtctctgtcgctctctctctctctctctctctctctctctctctctctttttaagaagaaactcagtcccagtgcactaggtgactggtacaggggaaagtaacttagggaagaaaaggaagcatcctgtaggtactttgcaggcatagctgatgttgtatcataggcactctatgggctggcccagccccagaattcctgctataaaaggattgaaagtgatagtgtggtcctgggatggaggagggagggaacttgtctgagatgtgcctgggaggtagggtggagtgggagacttgtctggaagctaaatttgcatttcaagttcattatttttgctcaggttgtctaaatgtggtaccttgatgggagagccagggaagtggggaggagctgatggaaatcacagaggggctaaatgcttcccatgccacttcttggctatgacaccttagccaagatatttttttcccaactgtacagatgataaccctgaggctaaaaagcatttctttgatttgctgaaagttacagaataatgggtaggattcaaactcaggtctgtcaagccagaaaatctatatgtgtgatgcattataccatgctgatggaataaacatgacctcaacaactttgaaaccttccttgaaaagagacacaaaccttcaggaccatacgtgattgtgtttgctacatgtagacacacatccttctgaacatagtaattcaaattaaatttcttaaaagtcattgaaaaatgtatagctagagttatgtctctatgtgcaaattaattgctagaagaaagtaaaacataattaaaattgaatataaagcctattacattaaagtaatgaattatttattttaaaatatccacattgacccagttccattggttggttttaaaatagcaacatgtttttctcctgagaaaagcgtttctgtataaatacattcattctccctcccttacaggctctttcttgactgaacaaaagtaatttatgctttttttttcttacttagaagttttcataatcaaagggagtctctaaagcatgtaataggacggtagatatgaaggttgatagatatgtttcatcagtttcaagcacataaacagttcaacccccaatatacaaatgttataaccaacagtataatttttagcaattcatgtagatttgatgccagacctggctgcaaggtagtgtggagtaaacaaagcaaaggccctggagttctgagtttgtcagatcctcagtgtcattgctaactgcttaggctttaagcatcttgccaactctaaattctactctacattcttgccaactctaactgaattcagcttctgaattcaactcaaaattaaatttctaattaggattagaaaattctaaattctttgaccggatttataaaatcaaatataaaaaacatatatatatgtttttttgagacgggctctcactctgtcacgcaggctgaaatacagtggtgtggtcatggttcactgcagcctccaactcctggattcaagtgatccttctgtctcagcctaccaagtaactgggacaacaggcaggtgccactgtgctcagctaattttttaaaatttttgtagagatggggtcatgctatgttgcccagattagtcttgaacttgctttttaagcagtcctcccacctctgtctcccaaattgctgggattacaggcatgagccaccacatctggccaaatattgtatataatacatgtttctggtagttcccagggacaatgaaagccttttattcccacagcagtggttctcacaatgtggtccctagaccaatagcatcaatatcacctgggaacttgttagaaatgcagattctcagcctccatcctaaacttgctatatcagaaatcctgaggacaaggtcagcaacttcggttttaggaaattctccaggtgattgggaactaccgttttacactatgatattaaagggcgatttcaaagaatagggtaattcccagattattatactgagagcttcacaactcaatctctgccttgactgtatcacgaagaatccttaaacagaagagagtgagccacaatggatggttgtggaagtgaacaaccaaggcaggtggtactgccatttcctgatagaacactttccaatcccgcgtctcccacctctgggtttccatcttcctgtatctattttcataatgagtgttcatctaagcattccaaataagttcatactggataattatggatgagaaataaattggcaaccagaaaaataggaaatcatccctaaacaatgcctattgataaatatctggaaatttttctgggaagcataggtatgctgtttcacaatataagacatgaaagaatgttcccagaagggtaggagtggctggactgaaattgaagtagtaatttgaggtgtcacagtggacacctcaaggtcatggcattttatttattgttgcaattataagaacaataaaactgcaacaggcagcagggtccatgcagtttcaccagccttccacacgataccgttccccctcatcagcacttctgatttccagaggctcgaatccactaagcagcctcagcaagcacacacattaatatatttgcccaagacagaacagtttttgagctggcagttgttgataaagacatgtcacccctggttttgttctttactgaaaggcctccgaataggaatggtgaaattctttttatcacctccacatgggttgtcttcttggcacaaatgaagagaccggagcctgcaatcattcctcaactcctaaaacaaaggaaggtggattccattattctaagggccctggggattggacatcttcagaagcattcaagaaataaggaagctgcatgttaaaaggcctcagtgctgattaaaagtaggaacaaagctaggtgctcttgcatttatcacatgtattaattgtactgctatctttggcttgcagaataggatgttataaagaatgcagtgaccattttggcatgttgaaaatcccattattcatatgattaagaaacaaaagtgaagtcgccaagcactgggttatgcccatctaaagatttgttgatggaatgaaatttatcttttattcatactccaacaacttctgaataataatttctagtgctgctcttcggtgcgtttctggtggttctgagctttattatgatcgtttccatcctaagatatacttctctttttagtatttttataaaatttgataaaaagaaaccagtggaagtgatcatgtcacctcttgtttataatgcttaagtggagttttctttgtatagtcagcaaaggatggataatctcactactgcttgttcctgcaacctcagtgcatgctgttcaccccttgccctctgagttctgaactgactaccctcctctgagatgctcaaaggccactgatatggtttggccatgtccccacccaaatctcatcttgaattttagctcccataattctcacatattgtaggagggacccagtcggacataattgaatcctgggggtggtttccatcatactattcttgtggtagtgaataagtctcacgagatctgatggttttataagattaaacccctttttgcgtagctctcattttctcttatctgccaccaagtaatatgtgccttttgccttctgtcatggttgtgaagcctccccagccatgtggaattgtgagtccattaaatctctttttctttataaattacccagtcttgggtatgtctctatcagcagcatgaaaatgggctaatacagccccaagctcctttccactcatcattttgcacatgttgattagtcaccagggatagtctttcactttgcctgggaaatcccactcatcttttttttttttttttttttttttgagagggagtgtcactctgttgcccaggctggggtgcaatgacaccatctcagctcactgcaacctccacctcccaggttcaagcaattcttgtgcctcagtctcccaaatagcagggactacaggtgcacactaccatgcctggctaatttttgtatttttaatagagacagggtttcaccatgttggccaggctagtctcaaactcctgacctcaagtgatatgcccaccttggcctcccaaagtgctgggattacaggcatgagccaccatgccaggccccacttacccttcttctcacaactcttacaaatctcattctggagagcctgcctctggctcccatgctagatcacgaccccagtcatatgctttcaaggcatcttagagttttgccttagagtaattatttgattaatgcctgtctcccaacatagaggccataattttttcatcattttatccctagcacttagtagagtgccagcctggcatattgtgggcaataatagccatcaaatgttttgagcagggaataatatggttggatatgtcttagaaaaataacccttgtaagtttggaggtcaaattggggagtggaacgattaataatagagacttcttatagggaactattgcagttttccacgaaggaaaaagaaaaacaacttaaaaaaactacctaaactatcaattttatcatccattcacccatttgctgaacatttactgagtgcctacaatgtacatgtcagatactgggctgggtgctgagacaataaaggactctatttggaaaatgaaaggaaggggatagattttaaaggggtctaggggtagaatcaataggacccactaaacaatttgagatgtaaaagacgggcttcaaaaggaatctaagatttcttgctcaatgaccaaatagagggtgattctattaacccctttttagaacttcaggaagagtagcaagtcagaacaaaaggtggagagctcaagttgaacatgtggagtttgagatgctcatcagatttccagatgaatcaactggttcaatcacagtttttgaaatgaagcatcattgttcagtgcaaatcttccaggggaattcaaatgttagatacagagaagtagagactgagaagagagcaaggcccatttaaaaatataaaagtttagttttaaaaatgctgtctttttgacctttacaatgtgcatattttgaatgagagtaagcaaaaacaattgatttttttgtaaagaaatgctgaagaaatacattcatcaatactgtagtttgaatataaagaaaatcagaatatttataaataggaatataaataatatagcactcttattggatagcaatggattaaatgggtatttgctactctactgcttttttttgagctgattataattatatgaaatatattttagggcatgcaattataactgtatgggcatacctaataaataatatgtctatatcgcataaagtataaattataaatatatatgaactatataaaaatatactttagtcacttaaaacacataatagaacattttattctgttttttcatctttttttctgagtacgtaactcttgcacttgtccctttcaggcaatgcttaagaatgtatgtaaccaacaaatacaatgataaatgtcttttgcagcaagcttcaaaatctcaagagatgtaggggcagcataaaactctaaccagataaatccatggtatattgtctgagccaaatgctttctctaaaatgagagagattcaaatcagtgacaagaaggagcatgtggggcttaagctgactgtaggaggacacaggtgtgcttcagcaccacaaatgaacgcagaattatctaagaacaccttgccttgccagctatttaatatcacatgaaacgggccaagaatgcagtgatattgaaacaccaatgccagtattgtttttcctgtgtctattccagcaattgcttctttgttattgttgttcaatgaggtgttatttcaatactgaagtagaattcattaaagtaaggtttgagtggagatattttcactggttgattggttaaactgaggtttctttttgcctctctagttatccagtgtattgacagccatattttaacaagaaaaaaattttgacttcacacattcactcagtaaataactacttagaaggttcttgagccgggcacggtggctcatgcctgttatcccagcactttgggaggccaaggcaggtggatcatgaggtcaggagatcgagaccatcctggctaacacggtgaaactctgtctctactaaaaaatacaaaaaattagccaggcatggtggcaggcgcctgtagtcccagctacttgggagactgaggcaggagaatggcgtgaacccgggaggcggagcttgaagtgagccaagatcgtgccactgcactccagcctgggcgacagagcgagactccatctcaaaaaacaaagaaggtacttgatggacaacactctctagacttaggtagagcgataaagtgatgaccaacttacagctgaaggggaattccacatgttgggcatagagaagagtaggtaaaggtatagggatgacagagaccatggttgctcagataatgacaaacagctgagcatggctgggtgcatgaactaaaatattgcttgaatgtggggaagtaggatggtgggttgcataactggtaaggagcaaaccgtgactagccttaaatgtcaatctacagagttaagatttccaaattcattaggacatgtatcctacagtgtgcaaggatttttactaaaggaatgacatggccagatttgccatttggaaagctgaccccggccatcgtgtggaggatagtttggatggtgaggcaaggaatcagaagagaaggaagtgtggccaaggaagagactcttgtagcaattcaaatgagaatactgaacactgaaccaaggacaagactttgaatgtggaagcaggggaaccacataagacaaatctcaaacttggatgctggggatgaaggataagggaaaatcccaggtcaattgggttgatggagtgtatattggtttgctaaggcttctgtaacaaagtgcacaaattgagcagcttaaacaatagaaacaatagaaatgtactgcctcacagtactggaggctggcagtctaaactcaaggtatcggcagggttccttctttttgagggctgtgagaatagagtcggttccatcactttctcctgacttctggcagtttgttgacagtctttcatatcccttcgttctagaagcatcagcccaatctcctgccttcatcttcactgtgagttctccctgtgtgcacatctgtatccaaatttctccttttctagagatgccgttcatattggactagaggcccaccttactgtatcatgacttcatcataagtaattacatcagtggtgagaccctatttgcaaatcaggtcacattctgaggtactgtggtttaggtcttcaaggcagggatttttagagatacaattcaatccacaacagggtactactcgtggaaacagagaatacacaaagataaaccagtgtttgtgggaggaaattattaatgcatcattggttatgctgagtttgaggtactaagggttcatgcaaatagcaaatatttctgggactggacttaaacaattctagaacatagaaaccagcatctctcaaaaaagagaggccttgggtacactgcctactataatctcttttatttgtcttttttgaatttaaaaagtatttaaattatattagcagaggaacagaaatttagatattgcctggaaattttaaaaatcagaaggaaagggccaagtagaaaaaataggagactcttcccagatgaatttcaacagcttggtattcgtgtgatgagttgtgattaacaggcaagcaggccaaacgtggttaatagagctgggtctttgagttttctttagaaaatgttgattctataatataagtgacacatctccatacgccccaaagcagcatctggtttgatattgaggtttcacctaacagttttcttcagaaaactggaacatttggccaatttcttaatatattaattttaatagattttctgtttctaatgaaaacattcttgtgaaaacatttgtttttcatatgcataactccttattgcccaatatacataggaccttatatatggtagatgctaaatacatccagttgctggatgactgttgtgtaaatgtttgggacacaacctttgaaaagaatctcaatagcccataactccatgtagcatacaggcgctcatataatgctctcccttccccactacaccacatgggaatgttatggttgctaagaagcacaaatgatgccaccaaataagtctaacttgggtgccaagtctgttcttccagtggtatgggcactatctttaggcagaggcatccagtaacagttggaaagaaacccgtgtgactgcgacctgtacaatgcatgcaggtgacagtcttctctgtgcctctaaatgtgacaggcatcttggggttatacaaaaaaaagtatatcagatagtgccttctatggagacagtcaaaagctaagattgttggagtcagatcgacatcttcatatcccagctcagccagctctcgggctgtgtgaccctgagtgagtcaggagctttctcaggttcaacttctttataatgtggaaattgtaataacattaccttttagggttattgtgagcacaatgattgtatagagattaaggcacataaagaagttcacaatagtagatatggttgtcaaaattatcatcataattataccagagacctgaggttcctgtgtacttcatgaatctattaagaaaccattccagaaagtaggaccagtgggagatgaccataatagccatcgatattgcaaatggagaggggcaaatatgggtgcttctgtgatctgggaggggccttggaaggaggtaaggcttcagtggccttcaaagatagagtcttaaaagaagattgaaaggacagaataaaaatgtactgtctgaactccactatttcaaacacttgactgatctttgacttctctgaaacctgttccttaacacaatttctgaagaaggattggttctcacaatatttactattgtaagcttcatcaaacagccaagtgatttctttaaaaataggggttttgacctttgcctttccctggctgggaacttaatcatcattctttggccataataggccaactctatttgtgggcctaggacttgatattggagatcacgtgacatccttgtccacgtcctacgcagcacaacttgtcaaaccagagcagatggctcttccgagtctaccccactggcagagggtgaggacgtgggaaatgaagaggtcctttacagcctgggcttctgggttgctatgcctgtcaagcagcaaattatgataaaaagggccatgcaaaatttaacatttttttaatctcttgagaactgactacaatgtttactcttttctggagcttcccggaatgttttatataaaacttttgctactaaaatcctttggagttttagaatgatgatgggaagtatagcagagtttaagttttggtttgagtccactaaaccaggttcaaatgtatcagttgtgtgtccctgagcatgttacttaacttttctaagtgtcagtttcctcatctgttcaagaggaatggataataaggccctactcgtaagattatagtgaatattaaggatacagttgtatactgcaaaaggcttttgatacatgatagaataggccctcaataaactctagttattgttattttaatggtgccacacacaggtgatcaaggtttcagtgccacaaccattgaaagcttggagtcccaatgccagtaatgtcatttttaaattttcaagtcatgacagcagaatggtgagatgttctgctacagagaatagaaacttttagaaatggtttccttccaagcaatgaggtaaacctcctcttaaaaaaaaaaaaaatcttagttttccattgttacaatttcaagcagtggcttaaaacagtaagcacttgcaaattatgtggctaaacacagtaggcactttttggcatgtgaatctatgggactatagttcaggccaaatggctctgctagcctcagctgtgtctggaagtcagctggtcattgactgactaaggctaggtctggccaggccaactatatttgtttcacctgtcttttatccgtttccctgggacaagccagcctgcctggacatgttcttctcatggtagaggtataagatagagcaagtccccaaagcaatcacccaaatgctttgctagactgcttacatcacatctgctagcatctcattggccaaagcaagtcacatggctgagcacagcatcaaggggcaggggaggtgactctcacactgtggggaagtacagtaaagtccctgagggaaaggatgtggatacagagtcggggaagaagagggagcatcatgtgatctacctcagctttagagtaaccgatagccaaggggccatcacctcacagcgtctagactctgggaaacagacttttgccctagtattgattctttgcctggagtcgtatcatttgctttagtacctggctatggcgttaataataatagcacagcagaaaggttcagtgattcttgtatagctacagactgagctttataaaataacctggatgcttattttaagaatatagactctgacagtagcaagaatttttctcaattgttttgaaaaggttctcacctattgaacagctaggatgaggagggttgattagaattttcagtgcatgctctgaattatgccatggagacatgtgcaagactaatttgtttgtagcaacagagaagccaatcatgattagatttcctggcatgttattcacctgcgaggagagtcagacttgtgtccaagaatctcaatgtgaatttggtcataactacatccatacagtgctggagggtttgataagctctaggtgtccaagcatgctcttctagaacttaactgacttctgcatgcacgccagccttcctagtgtaacttagggcagagctatgttttacttagttgctattgtctttgtattttatttaattattattaggtaaataacagctatctggaagtgaaaaagtcaaccatgatggctgatttttagagaaaatatatcttgcttttaccctctgacttctagcccttcagttccttggggaaatacttgaactcactgagcagcggtggggtcacagtctgggcttgtatgccctcatttccaggccgcattcctcagaggggccctgagtactttgggagctgatagagtttggctgtcatttgaaaatgttttcctgctaaatgttttcatttagaagctaatttatactctgctttcaagtaagcttaactccatttcacatccctgacatgtagcacacactgcagtgactgggatggaagtagacaattcaatcaaaggatgatttctccgtggaggaaatgaatattatttgttcatcttgcaattcagaattctgagaaaattatgatgtttggcaaaggcactggcaagacagaaagacaaataaattgcatggtgtgagaacagccttcttaatatgaaggtttccttaaaacagtgggtattggctgcaggcaaaatattaagctgcaaatcactggtttgcaacttcttgatcatcggttgtaatcccaagaacatatttaatttcatatttagtcctaatttctttttgttccgtaatgatatttctgtcactcaaaataagccatctgttggcagcagcccacaggaaacagatactgcacactcagtaatcttggagtgagtctgttgcattgtgagaatgaaaaacgggcctcttcagaatcatagggtcacctttaaaattcctaatttttctttttgtcttctctttggccatatgtagtagtggaaataaatcttgtttcattgtcttttctgagatgtttgtgaccagaggtcagtgctttggactcgaggattagagagtttccagctctgcttggagatgcatttcccatttttttaaccctctatttaatcaatacctagctttgccatattttcaagaaaaaatatacctggaagtattgaccagaaatcaagcctatggcaaaagaatgccttccatttgaaggttatgagatggagggcaggatgtaagacagggagcaccatgatgtgaggagtgggcagaatttgataaattgacattatctccatctagtctttgaccacgcgtatttgaacagaattccaaatggaaagaagagacagctgggcacgatggctcatgcctgtcatcccagcactttgggaggacaaggtggatcacctgaggtcaggagttcaagaccagcccgaccaacatggtgaaaccccgtctaaaaatacaaaattagccaagcgtggtgatgcatgcctgcaatctcagctacttgggaggctgaggcaggagaattgcttgaacctgggaagcggaggttgcagtgaaccgagattgcaccattgcactccagcctgggcaacaagagcaaaactccatctcaaaaaaaagagactctgaccatgacttcacatgatagctaacacttcttgaacgtctgcagagactgtgctaaatgactgtaaatggattttctcctttattcctctcaacaaccccagcaagtttctcataatattatttgcattgtaaggatgagaaaacagtctcagagctccatagctattaagtgatagaatcttgatgtgacagccagggcagcttgatttcaagatatctcaatactgaagttaaaacttggaatgggttaaaaatgaagttgttctatccatcatgcctgcagaaaacctcctaagaataaagaaaataattcagattcacataaaagaaaatgttagagatattgaaatggacactcaaagcacatcaatgcaaaggtgagggagacagaggagcttttgatcttcccttttgttccctcatgttttgaaacatgcttccttttgatgccagctctttagaggttgctgcactcaagctttagatgactcttctatctcccagagcaattaaaaggtaatgtcactattttaccacgtgacgcttgacatctgattcatatatcactcagcctgaaggcatatttttcatactcacttgggtgcatgtcaagcagtgaattgatctcttttaggattcaaaaggaatccccttttccaaaggagattctggtgagtgaacaaaatgaatgtccctattacttcccatctcctttaattagcaagccagagagctaacaattatctcacctgtcagctctcttgacagcttgctgttgaatcggaaccaaagagagatcacctgccccaatttcaaaccccagcaattgatatcaaagtctccaccacccaaggtctacttaaagcccattagtgtggccttcactatatttcagtttcagttacctcaaaccaatatctcagattattcctccttccatcatggatattctgactcataaatgtcagtacatggtggaggttgcctcatctcacaaatttccactgtcaaaatattctcagcagtactagacagatggaaccaatccagggagcaaaacaaatgctaccccagcttttggcgcactccaaatgtagcggtactagctgttcttatctcataatatgcctatcgccatcattttttcccctaacaatctgtccatgatgacaagttctattccatgttcttgatgagggatcatgtctctaagccatatgttgtaactggaagactagcccagttgttgcctttacgtttttaaataagtggaataataccgctcatattaccttccattatcttagtacttatctcagtctggttctgtatcctcatcatttccctgactgagaaaactaaagaataatgtgtaatgtgatcgcaaatttgtaagatggaataaagcatttagtcgttctcctctgccaaattttttgattcccattttcagaggatgatttgtctcctgccataagtggacatggtgccactgagcatgtagcaggaccgagcagctggccaagacagatggattcctgtgttgatctagtgaagtttcacctttgtaaatcttccttgctttctcatgcctattaagcgatcttcatctcagaacagcctctttgccctggttttaccctctctagtaattgtgtctcagtgaactgtggttttagtacaagtaccctatgaaagatgtttgcaactctggtcatagttgggaagtcaccacatactatgctttggattcatccaaataacccttctctcattgccatctatctatatccatttacttatccatccctatccccctcccttcctccatccattcatccatccaccatccatctgtccacctatctggtcatttaatatttcttttggaaacagttttggaacttagctttaccttgtgatctgattatatgaaattaatctagccttttctgatttatctaggaaagaccttctttttcagagttctaattaagggtttgaaatgccacagttaaaacatagtgattttaaaacatatcataaattctctaacactcctccctttgagaggaggagtctgtgttccctccccttgaatcggggccaaacttagagatgtgcttttttttgttttgttttgttttttgagatggaatctcactctgtcaccccaggctggagtgcagtggcgcactctcggctcactgcaacctccaccccaagggttcaagcgattcttctgcctcagcttcccgagtacctgggatttcaggcacctgccaccacgcctggctaatttttgtatttttagtagagatggggttttatcatcttggccaggctggtcctgaactcctgaccttgtgatccacccaccttggcctcccaaagtgctgggattacaggtgtgagccactgcacccggccagtgatgtgctttttactaatagaattaagcagaagtagggctatgaaattccaagctaggtcagtaaaggccatactatccttggttctcatgagttaccttccttgggggaagtcagccaccatgtaaaacgttatactactctgagaccaccatgcaggagaagagatacatagactctctgaccaactgtccagctgagctcccagccaatagccagcatcaactctcagtccgggatgtgagccatcttggacatccagatcagtcaagcctcaaaggatttcagctccagctgacttcttacttcatcctcatgagaaaccccaggcaaaaactgcccagtcaagcccttcagactacaactgggccctgaatccatcatcctcaaaattgtaagatagtaagatagttgttgtaactgctaagttttgggttaatttgttatgcagcaataatagcagaaataaaaacaatatatgactgagttacttagcacttcaagggaaagcctaccattttgttttatagaaatgggctaattcttcttctagttttcacctttctgttttaaactatagcttgtcttgcaagctttgctgctagagattgaggtagaaatggatctagaaactatggctgtatgtcaatttcatttcctcaaaggatcatatattttatgcagatatggagagaatatctaagctgcaagagtttggaggtgaatagaagaaaaatagaagattttgtaggttatccacatcaatctatatactcctagtttaggttctcatattgtgttatataccaaatgtatacatctcttgatgactggatactttgtgaggccttctgttagtctttggataatgtataattcaacacagacagaggttttattttgacccttaagtctcacctccagggagggaagagaagccttcacattgctgtcacaattctccagatggtcctaaaaggagctcacttttcttgtctgccccagtcccagtcgtcatatcctataatcgaagcagcttcctcttgcatcttcctaaattaccacttagcatattccctgactgtgggcatattcagtcagggaacatgttaactcaaaccaaatattgtctgtgcattttctatctatgtgcatatcaaccttttttttttcagcgctatctgaacattaagcattaagtttgcgacattgctgcttcattccaaatgcgacatatataccctaagaaaaaggacattttcttatataagcacaagagcagtatcatactcaagaaacttggcattaatacagtaatatatctaacattcagtttatattcagatttccccagttgacccaatgatgttttctggttttgtttttgttaatagagtatctttattaatacagtatctaatgcatcacatttacttgtcagatctctttatcatcctgtaatctagaaaagtttctccatctattttggagtggtgtttggtaaaattaacatttttagagaattcatacccactgttttattatttaaaataagaaatatttaaataaatatttaaaataagaaatatttaaataaatatttaaaataagaaatatttaaataaatatttaaaataagaaatatttattattcagataaaaatgtgtcttattatttcttcctgattaaattcagattatgaatttggggtaggaatatttatagatgatattattcctttccagtatatcccatcaggagatacttatcatcagttagtcccattatttgtaattaaaagtttgattccgttaccaggatggtgtcctccatattttttattgtatcacttttttattccatattttttcattttaatagtttatgagcaatcaagaagtgacactctgacactgtgcaaatattcagttccccaaccagttttcatactatggttttcacatccactgatgagtctcacctgagtcaaccattatattgatggctgcaaactgatgaccttctaatcctgttccctgccggggtagcacaacaggcactgggctaaatgattgtacatggattttctcctttattcctctcaacaaccccagcaatttctcataatattatttgcattgtaaggatgagaaaacagtctcagagctccatagctattaaatatcagaatcttgatgtgacagccagggcagcttgatttcaaggtatctcaatactgaagtgaaaatttggaatgggttaaaaatgaagctgttttatccagcgtgcctgcagaaaacctcttaagaataaagaaaataattcagattcacttaaaagaaagtgttagagatactgaaatgtcctatgtccccattccatgtgggtgtagggaaggagataggcaatgtgaagccagggagggctgtggaggttcagctgctccatttataggctttcaacagatcgccctgttttcagccctaagccttacccctttgcttagggctactgggtatctccacttcagaatcctctacagagttccctggcaacagtcaacacactctgactacttctcagcaggctctcctatttcagttcttcttccttactatctgttatctctcatttaatatttaaaaaaaaaaaaaaactacatctcttgtcttttgtcacctcgtttttcattctctttgtgggcttttatttatttatttatcatattattattttaccataactttagtggactttcagaagggaccgaagagaaaaaacatgtactaaaacatgtgctcacgttttgtgtatgttggtatttttattcttcagttttacagatgcgtgccttacatttctactcacatcatgttgtttcatgtagcagaatattttcaggctgggcgcggtggctcacgcctgtaatctcaacactttgggaggccaaggcgggtgcatcaggagttagagaccagcctgggcaacatggcggaaccccgtctctacaaaaaataaaaacttagccggatgtgatggtgtgggcctgtggtcccagctgctttggaggctgaggcaggaggattagttgagcctgaggaggtcaaggctgcagtgagcggaactagcatccctgcactccagcctggcagacagagtgagaccctgcctcaaaaaaaaaaaaaaaaaagaatattttatttctgtgtaaacagattattattccttttttatttatgataattatataagcacttattactttcatataaggagaaaatcttcttcaaatttttatatgcatacatttttttcttcaaggaaatctatgattaagcctcttttataaaaaggtatgctttatgaattaattagagctagggaagttaggtaagtatatggagtaggaacacatgttttcctcccctcctcataggtttctagaagttcttctcttttttggaagacagaggaattatcactgccttgccagaagtagcatctgggcctttggtgtattcttcagcttgtttattgacagcttgtaaacgtgcatagatgttcacagtctttctttagttttcttgaccattctgaaatctttaaatgatcttttcctgtccatggcccttttagtcatcaccaaactagatctggtcctcagagaatcctgatttcttgaaaatctctcattattccgcaatactccaatctgctattaagtgaatactagaaacaaagtggtaggcactcaggatgttaggttttggggtgtttttgtttttaatgctgtatgtgaaggtgtgcatggcagttgataaggatgcctactctgtttcccttggcccagctgagtttacctgcagccttcatggacagttcccagataacacagacagcttccatgtcaaaaacctccatctcccactcctttcctggggacttctacagtgccatggtagttttactcagttctggtgaatagcagcctagaagtgacaagaatttaatgcctccaagggcatcccttaatcaatatgggagaagattcactgaataaataatctggtatctcagtccctcattggcactgttttaagaatgtcctatatgagtcctcagaaaaaatctgagcctcagttgcctacatgggttaccctctcgttaaaactcctcttattggatttctcccttctcagttgcctttcctatcacctcccctgttcttcctgggatcatcccaaataaactaactgaatccaagtctttgtctcagggtctgcttttgagggaactcaaactaagacaattacaaagactaaaaatttccagagaaagtgtaattatatgttgttggaaatttactctgctgaggggaagtgcacaggaaattattctttttagatctattaacaggcaactggtaaatttatgttataaataacatggtaatttactcaaaaatttctggaacccctactaggtgccaggctttctgctagggactgagaacacacgagtcgacaaaataaacataacccatccctctccatcatagagcttagattctaatggtgatatggacaaatcatgtcaattataattcagattggggcatgctatgctagaggaagtcccattactgcaggaatacatagggtcagaaagactgtgttcacccctgtttctcaacatctagcacaaaacctggcatatgatgggtatttgtttgtttatttgttcgagatagagtctcactctgtcacccaggctggaatgcagtggtggtgatagctcactgcaacctctgcctctggggcttgagcgatctcctacctcagcctcccaagtagctgggactacaggcacacaccaccatgcccagctaatttttgtaatttttagtagagttggggttccaccatgttgcccaggccagtcctgaactcctaagatcaagcgatccacctgcctcagcctcccaaaattccaggattacaggcatgctgggcacattgtggacgtgcccggccaccttgggtattttggaagtatttattgagtaaaagaagcatattcaagaatgagtttatattcaaagaattgcaaaaaaagatcaatgtcctacagaataaagcagatagaggcacggacaagaatcaggacttgtaggccgttgaatactgtttaggcctggagacttcatctgaagagttacagcagacaagaagcagagaaattttaggcattaggacagattcagtttagcagtttcacatggccactctgcagacactaggaagaatggatcaaagccagcaaaacagggatcagaaaaataagggagagggctatgctgtaatccacatgagaaataatggcaagaatggcaatggagatgtggaggcatggctggactggaaagagatgtaggagttagaatagatgaggcttagtacttatttggtatgagaagtggcatagagagagacagtgctaatattgcccacagttctgatcagcacagctaaatctggggctataggaggaagagtaaatctaatggtgaaggtgaagagagaggaatttgctccggtatagtgcttaaagaaggaaggcagttttggcagagttgttttgtattacatttctctctgcccacaaaggactctttatttatcaaaaagataaatctaaaatatgtcacttgaatatagctagataatttatagccttgtaaatctgaatggacttcaccttagataaaaacttggtatgttaacttttccatcaaataagtttcatatttttggctttagaacctatacatcatggtagtcctatttggccaaaaaaaaaaaaaaagaaatatcaaattatataatattcattttcttaaacaaaacatggttatataacttgtatgcttaggactattgtttgttggaatgatttaatgaactagattatggccctttaggtgcagtttattatttttaaatttcttcttttggaaatgtgaggaagggtaggaaggttaaatggaactgaagtagcaagctgggccatttaaggagggcatgagtttaaattctgaacgctgaataaaaatgtcctaaaataccttcatttggaaggaaatgactttagctgtttagccttggagggaataaacagctacatgcatactaatcttctgaaccctgtgctatgttcatagccttatcttttattcatttcaaaccatacaaatctttaagggagagaaacccctgcttcttgcagcattgcaactaaaatgcagatgctacatttctatcagtggaatttgagttattcttgattttataccttaggatatagcaaatctctaaagacagagtgtaaaggggtatgagtgtgtctattaatgggggaagaaggagtgtgtgaaggggatcccagtgggtgggtgaggagggagtgagaggcggccaggggtggaagcttacacaagagccaactgcagccctgtggtagagaagccctcctattctctgatatctatttcccaatcagaataatgaccaattccagtccctcttttggaatagggatgtggagagtcataatgggatttgaaagctgtcctgcttgtagactatcatttgaacttgacattttcacttgagtgccttcttcttgcaactagtttacggttttatcaatacagtttaatacacttttaaagccatacttctggcatgatctagcattttccaggaaaataaaagaggcacatactgtaactgttgatcatggggagtgatggatgggttctgccctctgctagtgcaaaacatatcactgaaagtctagaggaacaggtaaggggttgatagttgggacaatgaattttgaaagatactctgagcttatctcatttatctaaaaaatgacattagaaataaccagcacaacacggtgaaaccccatctctactaaaatacaaaaaattagctaggcacctgtagtcccagctactcgggaggctgaggcaggagaattgcttgaacctggaaggcggaggttgcagtgagccaagattgcgccactgcactccagcctgggtgacagactgagactccatctcaaaaaaaaaaaaaaaaaaaaaaaaaaggaaaagaaaagaaaaggaaagaaccataaattaactgggattgaaagtgtgtgtgacatttatatcatggcataatctccaaatgaagaacatgtttatttgatttggggatagcttactcaggattcgttgcctgatctttatttctctcaggtcctaaatgggactctttggaactcatgcattcctgacttattcagacctgcttctgaaccatgcttggctcagtaaagcagagaggcttagagaaggaaaattaaaatgggtcatatgcatctgtgtcctctttgaggcatgtcacaaaaacagccattctgggaacactgtaaacagttttacccatctgtctagtttaatctatttggggattaaaccttctggcttctcagagtacagggttgtgtgagaggctcgttcatttatgatatgtgtttctggaatgctggttacaccaatataaatgatggatttagggcactgtgtttacttaaagaatcatggatctcttgatttatactaagacatctggttttttttttcccaaaatctttgcttaaactgaagctgtttatccactgataaaataacctctgtgtattcatggtgcccagttgttggtaactagcaattatatactactttctaaaatagttttggttaaatggcatgcatgatttgtagtaatgaagttcttcaatgataaaaatattggaagagacccatttgaattttagctcttatatgttacaatgtacttcacactggctgtgtgcttagtattcatgttttagaaaataagaaaagcatttgggagatattaccaaaaagaatcactgcctctgtttctgtttatcctgtgattacagttttcttattaagaacaaatgtgggtataaactcaatacattgtgggattcctctctggtcaatggaccctcactgtgttctgacttctctctctttcttgattgatggtaatttgctacagtgaacttgaatccagacttcagtgtaagattgatgtgtgttaggaaaaagggaagaactcttgcccttagaatcagtttccaactttatttactgtttggggctttttccatgaatttcaattttacctatctaggacccatattagcttgaccattgcaagtagggagggctccaatcagtcatacagccatggattgatgagtcatacaatcataattaaagaggaattggcagcaacataaaattcatatgcaaataattgtgctgattcatcattgcagtaaaattcacttctctgcatttcttcattcaaaaagccacattcaacggggcactccattttaagtaggcaaatttggagattccttaaaaaaaaaaaaaaaatgttttccttaggaacaattctgtttagtaaaatttagcccaggctataaaatacaggctaggacaagatacgggttaggacctctactttctcttcattctttgattaggtagttttacagttcctgattctattacttagatataacatgtagaagaatatctacacttcagatgcagagagagaaaaaaataaaaggggtaccccacaagaagaaacagcaaacacacacaccaaagacaagaaatgtaagcataatcttttgttttttcccctgacacacagatttagcaagcttaccattggccccttgggtcatccccaaaccagagctttaaaaatctgtggttacctgagaccctagagctaagtcagacattctaggacctaagccaaagggccaatagaaactttagcccaagtaatggtcacacatgtttactatagagagcaaactgaattggtctcagagtttatctttctgaactcatgatggaacacagagagtacagaagggggaattgggcttaatttggtgcagctgttagaatatcccctggtctctgagctatttgtttgtcttactgaactccagcagattaccattgtcgggcaatctggcacattttgctcctttgttcatccccagccatgttatgtaggagtcatcaacttccccctcataaagacgaccactcagaaagcactttcaactgggacaaactcacatagtaataatctaatgtgtggctactatatgttaggcactgtaatacgctttactcaaatctcaatcaatctctacccaattctatgtggtaagcataactaagatataaaaagatgacaagagtcagaaatcaggtaagacactcagggtttctctactatcgtgtcaatggaaattcattagatcctggcccaaagcaatcaagcccatcttgggctgcccgtgtactttggctctagccagactatgagcacttcaccaccactaaagacctcagtggccattccattctgattatcctgctgacttcttgcctactgtgctctcttcaggaccactctgccccagctgccaaactttcaatctgtggcctgagccaccccagcaccttccctcctgcactgaaatcctcaggcatttctattaggttgttgcaaaagtaatagcgggttttgctattactttcaatggcaaaaaacacaattacttttgcaccaacctaatgctttgtcccacactggcctgcagagaacagcctctaaaacacttgccaaaggtgctggggttcccccaacccacatcttggtgaaggggctcattttggctacattgaaacgtggtttcatatgtttcatatgaaaccagtgtgttattatttttccccctttcccttatcttttagtggcctcaccagaatttgaaaagttatattcctttgataacataactcttcctcccattggctgagctcaagaagtgttggttaggaaagaaaacttcaggcagcccactgaattctaactctgtgtctgaaattctttcctacattaaaaatgttactgaagccctgatagtatcatttctttgatatgtgtatatgtatttcttataaagaaaagattagtttaagtgactatcaaaattaaacattttgttgaattattgcaaaactctgactgaaccatttagttatgctactaggatcacattttcctttttgtataatgcattaaagattctcactttgggaggccgagacgggcggatcacgaggtcaggagatcgagaccatcctagctaacatggtgaaaccccgtctctactaaaaatacaaaaattagctgggcatggtggcgcacgcctgtagtcccagctacacgggaggctgaggcaggagaatggcgtgaacccgggaggtggagcttgcagtgagtcgagatcgcgccactgcactccagcctgggcgacagagcgaaactccgtctcaaaaaaaaaaaaaaaaaaaaaaaaaagattctcaggctgactatcacatgtgtggatgaaggtaagagcctagaacaattagataacaagagtgaataaaatattaaataaagaatagtcatgattaaatcaatctctggagtaggatcactaaatgcatcaaacaaatgttagttgagtaaaatagaatcattgttatttttgagtttaaatattgaaatcgcaatcttatttaagaccaaagtaggtttacatttgctccatctcctcacccatttcccatattcttgccaccccataaaatgagaacttctgtcaacccttggaagaattgaggacaaagagctgaattctctccattgttctctgacttctctcatgggaagagagatgacgggttgagtggcaagagcctgacaaccattggtccatgttcttctgctgagtaaaatcagtgcattaagcatcactgcgcatgtacagtcactcttcttgggctcacagtggtcaataaggggtgaggagatggaattttctatgaagttctctgcctgtctgtcctgaaaacccaattctcaacaatctataggtccaagttataaacatggagtcaatggatagaaagacttctgaccttgtgttcaagctacattttgcaatccagtcttccaaattagaaggctgatgttttcatctctgactcttgcacatatttttaattcatccatggtttggaagttagagagttatgatggtttattattctcaaactgcaatactttttatttagttcatcaaaattaaagacaccacagccataatccatgtcactttctgcctcaaatctcaagattttgaccaaaacatatggctatggtggtctcttctagtttaaaagggcaaccatgttttcctatcattttatgcctgttcgcctatttgtggctggctaaagaattgtgaaagtaagagacattgtgttggagtaaaattaggagacccaaatttgactcccatctctaccagttaactacctgaggaaatttaggtgagtttcttaatctctgtactactcaggtcactcatttgtaaaataagaagaataaaaattactttgtaaaattatagtatattatctgaatatgataagatgataaaacaattattaaaaagaaaagatgtaatgctagtgctagatgctggggggattttgccattgaaaaataacctggaaataagtcaagactgatcatgggctgagttcaatgactcatgcctataatcccagcatttgagaggctgaggtaggcaagataacttgaggtcaggagtttgagaccagcctggccaacatggttaaaacctcacctccactaaaaatacaaaattagccagtcatggtggtgtgtgcctgtaatcccagtgactcgggaggctgaggcaggagaatcacttgaatctggaaggcagaggttgcagcaggactagattgcaccactgcactccagcctgggccacagggcataacaaagtctcaaaaaaaaaaaaaaaaaaaaaaaaaaaaagactgatcatagtctttctgtataggtcaatttttttttccattcttggacacataattttgctttaggtggtctggtttatgtctaaaacagaaggggaatgggttgagtaaaggggaaagaataaactaaatgatcaaagtcaacttgtttccagatgtctagatctaaaaggccacaaaagagctcttacttaaattatttgcccaaacaaaggagaaattttaaagatcccaagaggatgtggcattaagacagacactgtgatactcttggtgtagtcagggaacatcagaagctcatacttcctgacatggaggcagtgagtattgtaagagaacgctactcaatgacatcattcatggtcttttcacagccttcacctcctttgcctcaatatccttattcttcaaagtgttggtaaattgggcttgctgtcattacgcattttattggaataagcatgaattatgcaattagctttctcgctttccagcagcatatgcaaagtgaaccagaaagataagagaaaatcttttcctcaggatctgtagattagttcagcttttggaattttgctggcaatttgtagtgatgttgtcattttgactactcaacagctaagtttcacattttgggctgaatctggctgggtagggtggttacttgctttgatgttcttggagattctctatgttgcttggtactactaggctaaaatgtaatactgttctgtctgtgctacctaaaaccagtatgtttggggcctcatctgccttcagtagggtattttcctttatccttcgtgaaaatcaatttttttttaaatgaatgaatgagagagatgaaatgagaaggagaaaaatggttagggtagattttttaagcagtgcctttggcttttgttattttatgctaagttatttatcagtaattatcattagacaagctatactggggtgaaaagctgctgctttttcttccgtagccatgtgaaccctggggcgtgccgagggaattaaaataagaacagagcacactgctgttttatctcagctactgcaacatctctgcttgacaccctgtgttgaacaagagactatttagtagatctcaacaattatgcatgtactttcctggcagagaactctttgctgctttgtttgtcaagattatgttgaatcagcataaaaatcaggcctgacttatttctggaaggaagcagcctctctcgtaccattggaaacaatatgatcataataaagttttgcatatagaacatttcttttgagtgtagacaacaacttattcttgtaaagaatttaacatttaagtctcatatttccatacttatttctattgggactgctgcctactgccccacccccatcccccaccagccagccttagtttttggtatatttctagctctgtccatcttggagcagctacgtgaggattttacagctgtctttgtttctgatggaatcctaacccttttgtgatgtggggccttcatataagtatgtgatgtggaaaatgaagcccatgtgtgaatacaaagttaattagtatgaaaagtcccattttccaccacatttcttgccagcagctatgattaggtgcacctaagctttccaggtctcctaatattttttaactaaatccaagcatagagattccaaaatatcccattctgtgataatatagatgcatgacagaaagggaatgaatattggaaggtaatgtttgtgtgtgtgtgttacaggcttgttggagttcatcactttactttctgtacataaaggtgatttgttctaaatgttttaagcagcagcagcagcaaactttctgaagtctttaatcattgggatgattacttagggcatgctttaatgaaggaccactttaaaaagtagctccagagtaaggctgaagtccaattgacattttctctatgtgttatctaatggaaatgatctccatggcagagatgaaaataagacctttgaattgtgttgagtaaaataagatgggtcagatggatttgggcaatttggggatgatccttagaaaggagatagttgcatctggatggagctagggagacccagtgacagagggagcctgggatcatcttatggtgcatgtcatgtttgtgtagaaacgtacagtttgagcagaatacaaagttatataggtctaagaaattacaaaagaaaaccaacagcttcccctttattcctgatgctatggctggcagacaaatggggtcttcgaaatatgtgtgtgcatgcagccatgcacaaatgcttattcgctgatgaggatgcagtgttgatgcccttaggaacagcatcacttgtggactgggtggtaacaaagaactagaaagatgtgcttctcatatcttgatatcaatgtctatcagagaagatggagaaagctgagagatactagtctagcttgctgtgcaacccccttcttctgtcccatcctccttcttatgaaagacttcctaaccctcctcctaaagcctctttttctctgtattttacacctggtccatgcccttaatatccagtccagtagagatgaatatgcctagttcctggtgtcctgcttttatggccttagaaagcctttctctaaacatctctactcttcatgcttgcattcaggcttcatgtgaaacttgcaaacattgagcataataagaaagaatacatagtaaaccatcttaaaagaaagactataaattattttggcactaaaactattaaaaagtatatttcactttagtagacagcagagaaaaatctcttttttaagtttaaaagaaaaatgcattttcttagcagaataaatgagttaacagagtgtggtatggattgatcaaagacataaaataatatattttattgcacacttctagctctttgctggaaatacttgactataaaaaccttttaaaaagtagtttgaaagacagggatatagcacattgtttgtcttactagcagaggaaacaaaatgatcaatgaaagcagggtaaggatgaaggaatccttaaactgttttccatgcatatgattccatttaatcagcgctggaacaaaggatagcatttttctttcctttttccgtgtgtgttatttcatattattaaatgagatttgagtgaactgaagtaaatcagccaaaacccagcttggattagatcccctaaacttccttatgcccagattttttccagatggtttctcatgtcgccagtttaatatcaacagtgtgtgacacgctagaagaatatttcttagaccagttcagtccttgaaagataattatactgtcagttgccatcactgttactgtgaaagtgaagataactggggtaagtatattaaaatccagccccaaaccagcctgactttcagacagtgcatctaggaaccttcgctcatttttgtcactatctgtctatgctacccgacgtaacactggtatctttttgacagcaaaatgtctgcaggtcactttttggttatatgctgaggaaaatatgaagaatttttgcatgatgaaaaagatggtgtgctcatgtctgcttaaaaactctgatttctctgctttccactttaatttacaagttgaaaatgtattttcatgctactacccactttggatcttttttattgtacctctgacattacttatagcacatttcgcagctgggtttaaaagcatgttagcaggcaattgtaggtaccgtgtcaacaaatgtgggaaatagaacaagactaacacataaggaatgcctgcaaaatcatgatatgaggtgaaaataaaatggtttcatgaaaatgctttttcttctttttattttaatataatcacaatcttacagaaaagttgcaagaatgctggagagaaggctggtaatatgtttaccagagttaccagttgtcaacattttgaacatttttcccatatgctttttgtcattatatatgtatttttcccttgaacaatgacaataagttatgaacatcttgccactttacttttaaataattgagtgtttcctatgtacaagaatattttcttacatgaccccagataaactaccatgctacaaaattatagtgagtaaaatactgttgtttaatccacaattcacctttaaattttgccagttttcctggcaaatgtactggatccattgcatttaattgccatctccagttagctctgggatatcatgaagctgctttcaaaaatacagtattttaaaagacaatatggagcagctaccccagcaagcctgccaccaagagctgttacgtgaccgctgtgtcactgctcaccaaactctgttgtgcttctgcttttctggtaactaacttgcatcttacagattaccaacaggaagcatttcaaatgcaaatgttcatctgaaaataaatccctagagatctctgagtatctaaagaggtaaacacgcaaggagtctaaagttgcttttaggttgaatatgcacatttatttataaacatggctgtaaccataaatgattttctgcaaacttcatgtttatatggtgattacttcacagaattttcttatctacatatttgtttggaatttctgagatgatgagtgagtaggtgcattcactgaaataattattttagcatattaaataaaataccaaatagtgtgagatcctttcaaactgtaagatacttgtgtatgtagtttcttgagatatagaaagtagacttgtcagctgagcaacaagtcatgggtacagttggtattctttttttgtttgtttgtttagagacaaggtctcactctgttacacaggctagagttcagcggcactatcgtagcttactgcagcctcaaattcctgggctcaagcaatcctcctgcctcagcctcccacgtggctaattttttaattttaatattttacagacgcggtctggctgtattgcccaggctggcctcaagtgaccctcctacaggcatgagccactgcactcagcctggtattcttttagtagtgctgtaaggggaaaacctggtctactttaccaagccacactgggtttgcagttaggactcagagtactaatccttttcctgccatttcttagccctgtgacctcatttgccttatctgtgaaataaaacgactcaggcacgtgatctctgagcttctttcagcactacagttctgtgaaaaagttggacatctgcttatggccacagtaaaagtagaggaaaaaaatcattaatttaaaaagctgttaccatacccaagcttgttcttaaaaataatatatgcagttgatatccatttactcattagtgaaaccccattagaaatacaatccccagaggctgggcacggtggctcatgcctgtaatccaagcactctgggaggctgaagccagtggattccttgaggccaagagttcaagaccagcctggccaacatggcgaaacccaccccccaccgtctctactaaaaaacaaaaataaaaattagccgggtgtggtgatgtgcgcctgtaatcccagctactcgggaggctgaggcatgagaatagcttgaacccgggaggaggaggttgcagtgaaccaagattgtgccactgcactccaacctgggcaacagagtgagactctgtctccaaaaaaaaaaaagggaacaattcccagtttgaaattgaaactgattttgcttactgtatgactgggacctctgtgttcaggactttttccagtctcatacgttcccttctaactccattctacctttgtatttcttgtcattaaaagaagaagaaaagctcttggcattcccagtagtttgccctgtcatcatttccatcttattgcttaggccaagaaaacatccttcagttaatcatttgtgtgaataagcatcactctgaaacttatctcaaaagcctcccctgtttatctgcaggtctcttctaatactccaagtagttcttttccaattatgcagtaatttaccatagttacactgtttcctttcgtagttcttactgtgtctgtctgcttacacttacctgatcagcaaaactaactataccctgtatctcaaatgattctcatactgaaataaacaaataaaaattcagaagtgagaaagtggaaaagccagatcttttttttaatgttttttgtattttactaagcagatttatgactgaaagaaaaacattttaagcattttatcctcctctgttttaaataactattgtggggttttttttttcagaaaattatttaaatacactggctctagttaaaataacttggttttgattcatatattaatagttaaagtaaatattttgaactttcccatgaataagtacaatttagttagtcaagactttattattttatgaattatataaaaatattgttctctttcattcatgaagggaaggagaatctggtcatctagttggccagtgcatataatccactcagctgatgtagatatctgagtgtttatgtcaggcaaatgtgctccaggaggctgggataaagccacggatgtggcctccatgtggctcagcacttgagatgccaggacgcgctgccaacacctgggaataatagagaatgcgaatacctcccagattatcatagtatataaaccactccctgggagtaaatcaggaaccttgttcatgtgctttcaccctttccagactcctgggtaccttttaatgatcacttctgtagtgtattgcaggatactctggcaacaacttgaaggccttaatgtgactgccacaactgcctcgtaagttttcagtattggaggattatatcttagagagtctgtttaaaagccagtcactcaaatacctacaaggtccaggtggtagcacatgagtgaaactcgcactgggtaccatagtgaaagggaaaacttggcctgcttaaagagggcagctgtttctctgctccagtgaatggtaccaggtcagaatgtgggctcagagttatcacttcttcttgcctttaagaagaagctggaaattcagattttttgttggtgaaatctcctgaatcttaaatactggcaaatttacttcaaattaagaaagactgtaccagctaaatacgtctgtgggtcatcagtttgtgaattctgaaggagaatccaaaaatatattaatgtgcttcaacaggtaaattttctgttgactttagttggttatgagccacagggcctggggttctggctctaaatttctacataggaaaagccctgtgtttcctgtggacttgctatctcctatcctaccatttctctatcatggcaaagatgtccatggacttcagaagttctattgagagtttcgaggaaatctcagacctctcatcctttgtgtttctttcctggtaaaatggagattgctggggtccaggccttcagggtagaggacacatctgtatacaacacattgttttcctttctagttgatgcattagtcagtgtaggctaggctgtgccatataacaaactcacgtggaatgttcagtgactagacacacagagactttatcccttgctcttaccctatgtctaacagtgtgtgtcaacaccgttggctgctcagtgacctacactaacaaatggcttatttctctgtgatgctgccaccctcaacatagggcctctagggacttcatggcttaggaagagagcagtagcagggcacatcagttttgttcagaagtgatgcatattactcatgcttatggccctttgatcagagctagtcatgtagttccaaatgaactgcaagagaggctgggaaacgcaaggtcacacataagataaatatctcacaggagatatgtgctcctacaatgatgttttcctgaccatcaaactcagacttggggctcctgttaataagcaactatagatggttttagccccagtctttcctagatgccaagatcagtctctatgggtatgatctgtaagttatcagaagaatcttctagcttaagtcttgtgaatacaggttggagcttgggaacaccaggattttagaatccaaaagattaaggggcctcctcatccacagctgctgttcctctttccctgccatgtcatgatcacagcctgagagaaaggagacaaaaaatcttactgaaggccttgaccagcacgtgacttcccccaataattctgaagttagagttcaaccaagaaattgtagagaaggatgagggagggtcttctggttaactcctgccctgaatggttctatccctcagtttcacattggttgatcagaagtgtaagtttccacggtgtatgggggctgtgtagaaaagtttgcattttgggggttttgtgaatctttgttttcctggaaaaatgttcacttttatttcttaattattttttaattgacagataaaattgtatatatttatcatgtgtaacaggatgttttgagttatatataaatgctgtggaaggactaaatctagctaattaacacaggtattatcgtttttgtggtaagaacacataactttaattctttagcattttttaagaatacaatctgttgttattaactatagtcaccatgttgtacgatagatgtttaacttattctttctatccaactgaaattttgtattctttgatcacccctctagtccctgttccccagccacccaagtccctggtaaccaccattctacgctctgctgcgatgagatcagattttttggatctgcatataagaagtgagatcatgcagcatttgttttttctgtgcctggcttattttgtttagcattacgtcctccagatttagctatattttgaagtggtagcttcacaaagatgtagaccatttgttagtctgggtcactgagtaagcaaccgtgccgacatacagtgttagacaggttcattctactgcaaatgacaggatttccttcttgtatggctgaatagtattccattgtatatatataccacattttatttattcgttcaactgttgatgggcacttaggttgattccatatcttgggtatagtgaatgatactgcaataaataggagactgcagatatctctttgacatattaattttatttcctttggatatctacttggtagtgggattgctggattatatggtagttttattttttgaggaacctcaaaaaatgtacatatgttttcaattcatattgaaatttgtataatatatgaaacaattcctattgttttccgtaatggctgtattaatgtacatttccacagatggtgtgcaagggtttccttttctctacagccttgccaacacttgttgtctttcatattttttataatagccattcaagcaaatgtgaggttttaatttggttttgtgtggttttaatttgcgttttcttgatgattagtgatgttgagcatttcttcatgtagctcttagaatgttggcactttgaaatagttttaaccagtctgagcaaagttctctaatatgtacactgtcacagatttataggcttggggatcagtcttgatgggggacggagaatagaatgactacaactcgtatgtacatcttttagttatgaacgactgagaacccaattcaaaccagctcaagcaagaaaagaaattgattggctctagcaactaaaagtccaggggaaggactggctccagttacacttggattcagcactcaaaacactgcattggcactcacactttttctttcactattgtgttgttctccatgctggctttatgttgagccactacatgttggccctagctttagaaattctcaggttcattcaagtttagcaaaagaagtattagaatcctttcttgcatcctcaaaaatcctcagattcactcgaattggaccaatttaggtcacatgcccggccctgaagcaatggctatggcttgtgatgtggtgattggtttcatagatcaaactaaaaagtagaggttgttgccagatccacagacaaaaaaaagaaaagaaaaggaaaaaaaggtagcaggggatcaacacatatccactaaagcactaaaggggaaaatagataattacctcagtatttcaattatttaaccttagtatgtttttctttctacccactattatcatcttttcttgtacccgctggcttgggatactatcttcagaatcccctagtagttaaaactctgctaaagaaatttaactcttaaggtatattttaatctacaattgtaggtcaatacagaaatactttttactgaagccactattttatttttaacatggtgctatttgtacatctggaagcctgcagatagctggaaacagtttggatgtccttgaaaggaaaaatggttataatctctggatttctatttagatttatgtaagtcaaagaggttgagacagaaatgattattttccaaatatcttcccccatactttattccttttctttggtttattttacagatgtatctctgtagatagatgtgttcctcttgaaaatgtttgcagtttccctgttttttctttttttttggaaatgttactttgttaggaaaatacaccctactaattgcattacaaatatctagttttatcttagttataaactttatattttaatatttttaagtttaaaaagaagaactaaaccagatattgagacatttagatcctcatactggtgaaaaattaaattttgcttcttgtgcctctgtatctgtagcagataatggaaggcatttgtttgagagggccccaaatgatcacatgaaatatatggaataacattggccatatgaggatgggagatggaacttgtgttatttgaacttggaaacatactgttttccaaagtatattcttagagaactaatctgcaaggattacttggtcagacagatagggggaaatacgatgctttacttttctcttgaagactaaaaataaacatgtcattaagttttctggcaagttctgtaatttttttaaaaagtgtttaacactaacatcacatttacgaaacttattttgaccacagtttttttcccaaacttattttgaccagttttttgtttgttagcatgagcagctattaacatcccctggaatcaaagggccaactttgagaaatgtgttcttcacagtattgaaaaaggaacccatcatgtatgttggtaaacacccctttcacaaaatttaaactcttttcagtttaatcaaaaggaaagggagcttttcactgtacaaatatgattgaaagccctgtatatattcactcagatttctcaggtaaggggaagggtatgtatcctggaaatgacagcatgaacacttgccaagccctcatatgaatcagtgttcactcttgtaaatcataaatccattagccaccaagagaatttctttgttttattctcaaatttgcaatgaaacctgttcttaaagtaattcctttagtaatatacttgtgcaaagtaaaatcatctttaaaattaaccatttctcatatgtaatttccaaagttaatttctgaaaagcagaatataaaaattaaaaacaaacttcagtgaagttcattgtaatctgtctaaggtttattcactctgataagaactgctggtaaatttagctaatttctcagaagagctgagtctgaaaatatttccttataaattagtttatttggtttgtttatactaacagtacagttattttgatatacctttaaattatattatctgtactatgattttatatgcttttagtttaaaataagtatttcgcatgaatgcatgagaacccacacttattttatatttgaatgtgaaaagcgattctgctaaagaaattcactgccaacttactgaaattgatggagtgtatgtttttagtcagcatattatcaaagtgacatgcaaagcctgagaaagatgtagccccaggaggaaacttcatctgaggaccctgtaaatgcaagtaaatcaatttttaactacagaaaaattcaaattataaagacatcttatccacattaccttattacaaaatagaaccaataatatttgtattaccaataaattgaaaagtgccagaatgaaaaccacaagagtacttttcaaaacaatatcattaaataataaagaaggctaattgcagaaaatttggaacaccgtaaggcacataaagaaataccccaccatcctaacaccaaaataactgcaatgtgttggcatagttcattccagtctcactcatgttatatttcactaagccataaactatggtgttttcccatgtcgttttaaaccaagtgaacatcactttttaatagcagcattatatgccttcacatgccaaaacaaaatagtatttttcttaatgaaaatataatgaaaataaacttttgtttctattgttttgctttttcccctgagaataaaagcaagttcattgtaagaagggctggcatcagctttttataggagtacgtgcacagatttcaaattactgtgttctgttaggaatatttcataggaaaatcagcaaaggtttttctctagtttcctttccttagttctctaatcaaggcatagaaagaagacagcctaggatgagagaggccaagaactcccttataagtagttgtttggaagaagagtagaggaattgtaaaactcagccagataaacaattctattgaagaagccttatctgctaggtaaatctgaaatgtgttaaagtgattttacctaagccatactcctaccctttggttccttaggcctcatcaagcaacccccttgtgagcctcccccttctgaatctccttccctattttcctgatactctccccaccacacacccttattcctctcctgcgcttagggaactctggcacttggaatggtgtagccaaactgtaatcatgccttcataacattgtattgacaggcatctgtgacaatttcactctcccacctgattcttagagtaatgtttaaaaatttttggaatatccactcatgtttctcttgaatctcaaccaatccaaaaggttcagctcagtgtgattttgtgtgtgacatttccaatagttacacaccttagaccttggtccagcatgaggggataattaataagtacactttttctgcgggtgcttttggcaatactactcttaccactaatctctgagcataattgactacaaaaaaaatcatgtgctatttcataaaattccaagcatgtgcagacaccaggtagtatccaccaactttgggccaatactgcatacttggcatgtcataatgatttttttttaccccaggaagccatgctgaattctggtgataaaacacagtgagagaaacatcagctcttaattattttcattaaaaaacataattccaagaacaactctgaaatcatctagagtttggaatatattccagagacacacattctttctctttcttcctctcatcttataagatagggttatatttagttggcttttttcataaacatgtattttacctgaatttgaagattaaatttcttaatatttatatgaagaatgtagacaagcactaatggtgttttgttcagtctgaggagaagaaagttaacacaccatgaaagcataggaatgttttagaagatttttagctctcgcaattgggaatctcctggtttaaatttctatcatttcagcctcagggcaatccaaatcatacagggcttggacttcattgcatcaattctaatagtttttgcttttcttccccatgaaaacccccgtactttccttgtattgaggtgtggcttcagccttcaagggtccattctcagtatgcttgaaatctgaagatgaaatgaatttcataactggaaaatccagttatcaggcatgagcaaatggctgcatttgtttcagattcttttgctagtcgcttcattttcttctaatttaacaaggtcatgtatgaaattagactcagctgttatttattttattactgagctccaaggtataaatgttcctctcctatctagaaatttgctttcgactttctttctctttatatgtacgtacctatatcatgttttgcagcctccatagatataagctcaaagttaattttaccacgtcttttactcatctagaaaagaaaggtagccattctctcccagtgaacaatcaaattctgctgccttgaggaacaagtgatcagagcatttcgttttaatagaaaagctgtttttgttttgttatatttttttcttgcaaggtttgctttcagagctcttaaataaggatccactttcatattttctgcttgtgatttggactctgcttccgaaatgcatttgaagctgtctgataacacaaggcacatgtattataacatcattaaaatagaaagttaaaagttgtgggtgaaggaaggcaaacatttaccagcagaatgaatgaataccatgaatgaatgaataccaagaatgaatgaataccatgcataaatgaataccatggatgaatgaataccagctctagtgaggacctagggctaagccagagatcttactgagagccctgggcagtggaggcagaaaggagaaatgatggattacttagttctggttggagtggtgctggagtagggaaacctactggatcatcaggagaggcaacttttctatagcactgatttatgaaaggcatttgtaatatgtgtttttaaagatagggtagactttgaaatgattttaatgatttttaaaacatttcatggaagcatatcatgccctgagaaaagagcacataagaatagggctgcataaattttcacagactgggcacatccatgtaaccagcacccagagcaaaaactggaatgtctaagcctctcaacagtcccccgtgtctctttccggccacgactccctcctccccaaaggtaccattattgttgacttcttagaagataaattggcttaaacttgtttactttatatattttaaaacacatttcaatcatttgctctatctttacttttaaaataataattttgttcacttatggtttcatccatctattcattcaacttattgattcaaacaaaaattcttaagcacctgccatacgagtaacaaccatgaggtttagaatattttaaacctttcaattgtttcctattttttttaatttgtatgcactaaaattcacttcttttctctttctttctttttctgtgaatgattacatgaattttgacacatgtaaattaatgtaaccaccaccttacaagagattcagaacaatctcatcaccccccaaaagcacctgttaataccctctgtagtcctacattctttgcagacccctaagttctggcaactcctgatggagctttatattttgagtttcaaggcagtaatgaggatacatttttcattcttcatttctcagctgcaaacattccatttcaccttcctctatctctgcatctccatcatgctaaagtcatttcattttctgactgcaaaaggccaaagtttttctatccatattaagaaagatatttttctggtcaaaaattgcagtgttccaccagactgactaactttgttttctgcacaaaatgttttttttttttcttcccagaggttgagtcacttatgctgctgagcacaggaattttgacctttgggtgaggctcactctgaatcttccactgtgaataaaacagatcccaagatagagtggaaaagaaatacccagagctgaattaggagcagctggcagatgggctctgaaatgcaaaaatacccttttgagtttctcaaaattctagttctctaagaaaatatttattttttcccaattaatccacactcaataatttccccaagttatcttttgattgggaagttctgtaccacattgtagtaacaccgataacagtgaagtaggtggtgctttggaaggaaatcaatcaacttacattgttttatgcataacggcagttggaaaactgttcctatgatttcggtggtattctgccttctccatctgaagggaaacacttcatacacttgcctgtgtaagaaaggtgagtctgaattgcaaaatgggctttgttgataacttccttagtcttttatttagtatgtcatattacgaatgcaaaatatattccgtagagaaaagcatgaaaatacaatcaagcaaaagaacattgaaaacaccctactcctttgtcttcagaagcaatcactctttttttttttaactttttataatggaaaatttcaaatgtataccaaagcagagaaaatagtacagtgcagtcaacacacctattgccagctccaccagttatcgactcacatctactcagagttcatatctaccccaaccccaccctgcgctgagtattttcaaacaaatccaagacatcgtatgatttcattcataatcccagtgcgtatgtacctctaaaaggtaatattttaaaaaatataactataatgccatcatcacagctaaaaaacattaataactcctgtttatcgttaaatattctgccagtacaagcttctctgattaactctttttggccatatttgggtataaatcgttggaaaaaccactatttgtaacatcttggtatatatcctttccaactcttgtctttcttctccgtgcgtgcgtactccctgcgtgcgtactccctgcgtgcgtacatatttatgtgggcatgtgttcccctctagatttcctgccatagataaacacatgtactcatattcataaattggcttatatctgcaatacttttctggaacatcttttcataagagtacatgtgcttccctcattgttttctcccgtgactatttagaatctcataggatggattactattattcattttgtcatttccttttcactgttgattgtgaaccatccttcactgaaagtaaataacatttaaattatcactgaatataaggtcagttacctttagatattagcaaaggtaatatattggtgagtgaagcaatgagcaacacagaatctgtctctgatgactatttttgggcaagtgtgttttactttcagttaatatgcttgaaccacatgctcctataactttgtatgtttttgtagtttgtctgacaccaagttacactgccaggaaagtggccactgttcatattaatctggaaagtctgagttgccatgataagttgggtgcatgatcacaggtaaatagacacaatatttgagtcacagtgttttcagaccctgatgagttctgatgattcaggaccacttggccttatttacatttgtgatattctgcatgggtgggacgtgtactttggagtcagataaacaaagcgtgaatcctgcctccagcattttttgccgggtgacttagaacatattaacatctttaagcttgaaatgtcttcacctgcttaaggaagatagtaatagtgcctactcatgaggtggttgtgaggattgaatgtggtaatgatgcagttatggggccttgcatagtgcctggcaagagctcagtaaatggtagcagctttcagttatagttaaaagaccaaactaaatgccatatgccagagactatgcacagagagattccatttatgtacagtataacaacaagaaaatgaatctaagccatgagaagtcacaatggaagttatcttccagagggcagtggctagaaggaggaacaaggggctcctagggtgtcgataatattattttcctgaatatgtgctggtgacttagttgtatgcagtttcagaaaatccgttgagctgtgacttcattacttacgactatgcatcttcaggtactttatgtttcagtgaaaagctaaaactgaaaaaatataaaacaaacagtataacattaatcttatttgtggtaataaggcacctggcatatagtaacatagaagatagacagataaacagatagatatagcgatatggggaatactaatcattgttagcaatttgaaccgttttttaaaattaaattttaggaaaattgagttgaaaataatattgattcaagtcaaacactacatatattttgaattggtcgttctaaactcttctccctcatattttcaagacaacattccatatttaagttggaagcagatacttgctttgctttctctggttttctctcgggagaaaatattaggggtgcaactgtggcatcaccagcctcatcttgcctgtctagagcagagcagagctgctgctttgaaatgagttattgggagcctcagaaaccctgaagaggtttggccatacccagtagcaagctctgcttatcaaattgtcccaaagagtaattcttttctcataatacctccaagaagcaacaatcaattcatgacctttttttgggtagtgacatttcaagtgctcagaagaacatctgaagtttgagaaaatagacccgagaaataggtatttaatttacttgttctccagcaatcacactcattttgtcaagcagaatgaaatgagctaggcacagcatttcatatggtgaagcttgctgtttggtacagctttaactgccaaactgaggggagccctcaggatgtgtttgtggaatttcctttgtggaaaaatttcagttctcactgttgttagtccttttgtctcacaatcatacatgtgtacttaaaaagcctaagaggtaaaatatttgataattctccttttgaaatgcaatgcatacagtgtagtcagatttcatggaagtcacctagtgtagagattttaacaattaaaaactagtttaagcagatgggtcataatcggtatttcctaatgtgaatatggatatggaaaatataattataaggatgttagaccctctcttttgctgtcacagcacacagctggaaattgcttattattagcttgcaaatcctacaggaaaacacagaattatttttagtactcagcaaatttatggtggtaattatgagtacttgcatcacttccggaatgcaagagtcctatatctttagtctccatgttgagaagataatttttatcacttgtatgccctgcatattgatttctgtggtcactgggaatcaaaagtacttttctggtaatacaatgggtgacagtagtcattttgcaatgtaaatggtttggaaggctctgcagccgtgggtttcttaaatcttgaaaatagataaagtaaaaaaagaattgccttattttcccatcaccaaatttgccaatctacctgcatctgaagtcacaccttctgcctccttcccgtgacaatttggagtcattcttctggctctgttaagagtcaaatccttccctggtgtccgggatcctatctgcctttagcattacttaagaactccactcccactcccacactccatctccctgggatcatctgtgtgcccccattagtctacatgccgtaactgtggcctcatttactgcaaaagtcctcagagaattagctatgttaatggtctccacttgctctcctccccttctctcctcagtctagtccactgggtttccaaacccataagtcttctttataagtgacacctccatctactatttcctcaggctgagaacactggagtttataagttttcttataaactcaatctccaaaatgtagtggccaatggaaaacttcctctttaccctctgaaggtttgctgaaaatcaactgacaaaaggcagattaataggtgaaaaggcattcacattggttaacattcctggggagaaccagagtgattaccccatcacatcataaccataacaaatggttatggctcttcttcttaggggaaaggggagggagaattttagatgatttgggggattagtaaatgatttttaggggaattcagtgaacttgaagaatacacaatggcataggataaagtctgtggggcctgcacaacagacaatggttgggcctgcagaacagacaaagtctgtgcaggtgtgttgacagacttccatttttcttcctgcaacatgagttcagtcaatacaaactcagggaagggaccagacatgactgttttcttctttggcaggtctggactttaggcagataaaggaacttcagagaacaatccatcatgtgctttgggagagacagaggattgagagagatggggaagggagatgtcagagagaccttgaggcttctttttcagttcggaaggtggaaacaccatattataagatactggtttctaagacctgacaagaatatatttgcaatccaaccatttttcactgtctctgttgatgtgttcccaactccatcatcagtacacagacgtccactggttgtcacccaagccctgcttcttgctgaatctaatgactgtcaattatttggtctttttaaatttgacctctcttgatgaaactttttttctctttgtgcctctgtgacctccagttatttcagtatggagaacttaacaaaagaatgttatctgggtaactgaaagggatatgtagaattgtgtatccttatatgatgaatgtgttaaccaggtaactgaaaggtgtgaaaagaggtctctaaggcgttatggaggcagtaattgcaggaaagagccaccagcttgagggaagaaatctaaatgacttaaatgtagattttcagaggagcgtccctgaggagctgaaactctggcctctgaggagggaacttgtgtatttgaggtcacaggaggggcctgtggagctgagatctggtccttgaagaagggtgtgctggctgttgccagctctgcagttgctgagctggggactatgttatgtgagtattggaaaaacagcaaaatgaaataaaccactggctgggcacagtggctcacacctataatcccagcactttgggaggccgaggcaggtggatcgcttgagcgtaggagtttaagaccagcctgggcaacatggggaaaccccgtctctactaaaaacacaaaaattacccaggcatgatggcgtggacctgtagtcccagctacctgggaggctgaggcacgagaatcccttgaacctgggaggccaaggttgcactgagccgagatcatgccactgcactccagcctgggcgacagtgccagactcggtctcaaaaaaaaaaaaaagttctgccactgccagggtggagaagggagactggaggaggctcacgggagtcttgcctgttccctccagcacctcctagggccagagcctaacagggagccactcaccaatcaagaatgccaggtcttagccccatcccacaaagcagagtgcagaagggtgaatatacatttattggataaattaactaggaattcacctagtgcttggtccatgactgtattcagctagaccctgggaggcatgtcatgagtgcctggtgtgcatatactttgccttccaagctcttggcattttccttgacctcacaactagaaaaaaacatcaatttggttgtatatctgtaactgagagtgcttgtttctaaaaatgcagattatataaacatacagaagcttatatatacttggcaagaaatgtgcaattagtcacgtggtggaaagtccctccgcacgactcatgtagtctacctgctagaattctacttcttttatgtcttttgaaggcaaatgccatgctgtcacctgaagaatccactggcattctgttcatgtaggtagtagccttcctgtctttttgcagtgtggagaagggattgggagaaaagacgtgtcctgcaaaccctgagacatcaccaaggtttgcaaactgtggttcaagttcttcacctcttcacatccacaggagaaatatctgttctgacattgtctttagtgctaaactattgtaatcaagttctgtcggggttgagagatattccttacttagtagaaaatatctcctggagttctggcaattgaaaatggcctcggctctcacctgacttcccctgcaattgcaaaaaattcatcagctgagtcgggatgttaaggcaaaaatatgatttcttgaagagagagggaggagaagagaaaaaaaaaataagtgcagtgtggtctaccggtttgtgtcgatgctattcaaaaacatctctcaatccatttatcctttccaaacccaggagggtaccagtgccatccccttcctaattcaaggcctgctctaccttcaatggcctgtgcaccttgcctacctctggaactagttctgtggtctctttccctctcagttatctctacaacttcttagcttagaagtcctcttaacaaaagactacataaagaaatgtgaaaaacggagaaagtatagggaacacatttaacgggcagattatgtatcaaagctaatgtccctgaagtctcgatattcatccagccttttagcatcgttgcaagattcatcagtggagaaattggggaatgcaatcctgcttcattttctgcggagtggctccgtttggagcaggaacccatgtagcttgtaatctcctacgtaatcttccaaaggctttctgttttcttgcagacaagcctttatgctcttcccagtgccacattcctgagaaccctagggctccaagaagtgttctgtttgcatccttcatgccatgtgttttttgtttttgtttttgtttttttttcttattgagatggactttcactctgtcacccaggttggagtgcagtggcatgatctcagctcactgcaacctccgcctcctgagttcaagtgattttcctgcctcagcctcccaagtaggtgagattacaggtgtgtgccaccacgcccggctttttatattttctggtagagacagggtttcaccatgttggccaggctggtctcaaactccagacctcaaggccaagtgttttggcctcccaaagtgccgggattacaggcgtaagccacaacacccggcctgctgtgggtattttgtgatcacactgtcccctccaaacacaccttgtggaagacacttgctctgccattctggatttaaaataactaaactttaaaagttaggagtaattttctatctgggtattaccctaaagagtcttccaaacgactccaaagattttaccccatagaagtattcctctaagtgtcccctgcaacttcattaaatttatccgggatatttgttaaaaatgcagccccctggatctcactggagacttctaaaacagtttcagagagtgggggccaggtttacatgtattttttaaaagttctacagtctattcttacagaagcaaaagttgaagaacctctggtttattgtgtagatttttggcgtcatagaaagaaagcaaattatagagctaggaaaggaaaatattgccagcttaacacttgagttatctgagataaaatggaatagcttttagaaataattaagcatctattttcatgtgttttgggaaaaaaatgagatgtaatctcaaaccagtgattccattgatattacagttgacaatgaaactgaaaaaaataaataaaataaagtgaatctttaaagaaaaaccctaagcaaataaaagtaaaagggatttaaattggtggaagagttctattgttgttttcaaatccctgttcagccactaatgaacagcgtcacatcagacacacacgtttcttcatgttcccttccttgcgtagtgtacccacagggggcactggtacccatgccggggctggttaccaccttcccgtgggccacagcagcttcccagcaatgctccaggagcatggggctggctgcttgtaaaatcatgacgttattgtcttctgtgtctacttccactttcctcctcacccctatttttccctacaatgtcccatctcccccctgacctgtccatgccagtgactataaccttcatagtcctctagcttgacagaaaggaatagccatctttatggatttctccaacagacgggctggttggcaccagtctttccaggatggagcttgctaatcagatacacataatgatgctgatgtgccagtctaggggactacactgctatggtccaacttgcagtgacacagtggatgcagcagacacggtcagtgggtcagtggtccccctaccccctttgatctctccgtgtgctccatctgacttccagccaccactatctgtgctggagggttcttttttcttcttcttttttttcttttttttttttttagatggagtctcgctctgtcgcccaggctggagtgcagtggtgtgatatcagctcactgcaacctccgcctcctgggttcaagcaattctctgcctcagcctcctgagtagctgggattacaggcatgcagcattgtgcctagataattttttgtatttttagtagagacaggattttaccatgctgcccaggctggtctcgagctcctgacctcgtgatccacccacctcggcctcccaaagtgctgggattagaggcgtgagccaccatgcccggcctggagcgtcctttttaccaagtgcagagagccttgaagcccacagtgctcaggaattaactcccctaggagcatcactcatccagtgactctctgaatatggcatataaatatccaagctctctcccccagggatgggatcattctgtggcctgtagttgcaccttttccaagagctttccagtaggattaagctccagttgctccctgaatcatccgtcttaatagcagacactttgttggttgccttcttttccctatttcactgcctcattttttttttttaattcacacttcctgggactacctcaaaaataaactactagccctgaatttgtatctcagggtgtgcttctgggaaaacccattaccaaaacccgtcacactatcaacagaaacctcatagtgctgcaatgcctttcctttactattaaccaaagtgagaatttaggattatgcatccaattcaagtaaagggctggagtatctttctgattggggaaggacaaagtttgtaacagacgaaagctcttagcaccctcctagccaccctccagctgtgccccatatggttgttaattgaatgtcagttatggcttttccctactaataccctaaaatgcccttgttcatcatctatttgatctgttaatccagctaagcccatggttcccaaacattaacacacgttgagatccactagaggaccttgttaaggccacacattactggaccactacttcacccccagtgactctgatacagtaggtctggtgtggggccttaggatttgcatttctagtgggttcccaagtgatgctaatactgctggcccagggaccacactgagaactgctggtgtgagcctgcattcaccataatctcttgaaacatgaagcttggtgtttgcatctgagataaagcattaattgatttttcttttaaaattttatctattggttttgattaggtaatttatttacctggcttaaaagtcagagcatataaaacaatagatggattctttcttaacatgataaaacacactgatctcaatataaaagccagcctcatgctgaccaggaaaacactggaacatttccacagaaggaatacaacaaagatgcttattatgtctacctaatttatcattattctggaggtattctttatgaataatatagagaaagaaagcccaggagaagcaaatgaaaaacaaactatttgtacaatagaaatgttcaataacttggctgtgtacaatattaatgtgaaaatatcagtaaattttctgtacaagcaataaacaaagagaatatatagtggaaacagaagccccatttttcaaaaatatataatataccaaagaatatagcatattttaaaaatttgtgagatctacataaaaaatcttaaaaatatcctgaagtttacaaagaaagacttgaaccaatgaaagagacaatgttcttgagtggcaagactcaacttcatacatgttgctttcctttaaataagaaataaattcaatataattccaataaaatactatattagtccgttttaacactgctgataaatcatacctgagactgtgaagaaaacgtttaattggacttacagttccacatggctgaggaggccccagaatcatggcaggagatgaaaggtacttcttacaaggtggcggcaagagaaaatgaggaggaagcaaaagtgcaaacccctgataaacccatcagatcttgtgagacttactccctatcatgagaataccatgggaaagaccagcccccatgattcaattacctctggctgggtccctcccacaacacgtgggaattctgagagatacaattcaagttgagatttgaatggggacacagccaaaccatatcattctgcccctggctcctccaaatctcatgtcctcacgtttcaaaaccaatcatgccttcaaaaccaacagtcccccaaagtcttaactcatttcagcattaacccaaaagtccacagtccaaagtctcatctgacggacaaggcaagtcccttccgcctatgagcctgtaaaatcaaaaacaagctaattacttcctagatgcaatggacgtacagttattgggtaaatacagccattccaaatgggagaaattggccaaaataaaggggatacagggcccatgcaagtctgaaatccagcagggcagtcacattttaaagctccaaaatgatatcctttgactccaggtctcacatccaggtaatgctgatgcaagaggtgggttcccatggtcttgggcagctctgtccctgtcgctttgcagggtacagtctccctcctggctgcttttgcaggctagtgttgagtgtctgcagcttttccaagcacatggtgaaagctgtcagtggatctaccattctggggtctggaggatggtggccctcttgtcaaagccccactaggcaatgccccagtaggaactctgtgtgggggcttcaaccccacattttccttccacattgcactagcagaggttctccatgagggccctgctcctgcagcaaacttctgtctgggcatccaggtgtttccatacatcttctgaaatctaggcagaggttcccaaacctcaattcttgacttctgtgcacccgcaggcttaataccatgtggaagctgccaagggttggggcttccacactctgaagccacagccagagctgtatattggcccctttcagccatggctggagtggctgggacacagggcaccaaatccctagactgcacacagaatggggatcctgggcccagcccacaaaaccactttttcctcccgggcctctgagcctgtgatgggaggggctgctgtgaaggtctctggcatggcctggagacattttcctcacggtcttagggattaacattaggctgcttgctacttatgcaaatttctgcaattggcttgaatttctcctcaaaaaaaatggggttttcttttctaccatatcatcaggctgcaaattttccaaacgtttatgctctgtttaccttttaaaatggaatgcttttaaccgtacccaagtcacctctttaatgcttttttgcctagaaatttcttctgccagataccctaaatcatctttctcaagttcaaagtaccacaaatttctagggcaagggcaaaatacctccagtctctttgctaaaacataacaagagtcacctttgctccggttcccaacaagttcctcatctccatctgagaccacctcagcctttatcttattgttcatatcactatcagaatttttgtcaaagccattcaacaaatctctaggaggttccaaactttcccacatttttgtgtcttcttctgagccctccaaactctcccagcctctgcctgttacccagttccaaagtcgcttccacattttcagttatcttttcagcaatgccccactctactagttccaatttactgtattagtccgttttcacactgctgataaagacatacctgagactgggaagaaaaagaggtttaattggacttacagccccacatggctggggaggcctcagaatcatggcaggaggcaaaaggcacttcttacatggcggcagcaagagaaaatgaggaggaagcaaaagcagaaacccctaataaaaccatcagatctcctgagacttattcactatcacgagaatagcataggaaagactggcccctatgattcaattacctactcctgggtccctcccacaacatgtgggaattctgggagatacaattcaagttgagatttgaatgagaacacagccaaaccatatcaaatatcaatataaattttataaaattttgttaataataaaaactttttagggcacttttattctcacatcaaaatcgagtgaaagagagagttctcatataccccctcctcccacacaagcacagcttccctcattatcaatatttccaccagagtggtacatttgttacaactgatgaacctacattgacatgtcattatcacccatagtccacagtttacattagggtgcagtcttggtgctgtacattctataggttggacaaacatctaatgacatgtatcctataatatcatacacagtagtttcactgccctaaaaatcctctgtgctctgcctactcatcccttccttccagcaatccctggcaaccactgatctttttgccatctccatagttttgccttttccagaatgtcatatagttggaaccacttagtctgttcagactggcttgttttattttgtgaatatgcattttaattttctccatgtcttttcatggcttgataactcatttatttgtaatccccacataaatttttgacctaaatttgtggtttctagagtacacaaggaaaagtaaaatagcaaggttagctagaaaaaaatctataagagtaatgagaaaggactaacatcaacagttattcaaacataatataaagtcataattatttaatcactgtgatatgagatcatgaatagagaatagaaaacccagaagtagccttaaatacataaaaatacttagtatattataaaattatcattttaattattgataaagggatggaatatgaaaggtgtggaaatttgtgttattaatattgttactttcagcactgctttggatttgtttacacctagtgttgtggagaactcactatacgccaggtagcatgctagacatttccataggtgttgacttgtttaatcttcataaaaatttgtgaggcaagagttcatatttccagtttaaagctgaagaaacaaaggcccagagggattaggtatctttcttacagttgcacagcagtgaatggctcagctggaattcagacccagcctttaactccctacttagagcgatttctatacatggagcttctagcctcactaagtagtttgctggccatttcttttaccatatgtgtactttctgctcatcattatttcatttgagtctttcttttctggtgcagtcaacatgaatttctagttagcaacttagatcatagaattgattttaagaaaagattcgtggccaggcacggtggctcacgcctgtaatcccagcactttgggaggccgaggcaggtggatcacttgaggccatgagtttgagaccagcctggccaacatggtgaaaacctatctctacaatacaacaattagccaggcgtagtgttgcatgcctgtaatcccagctactcgggaggcatgagaatcgcttgaacctgggaggcagaggttgcagtgaggtgagtccatgacactgtactccatcctggatgacaaagaaagactctgtcaaaaaaaaaagaaagaaagagagaaaagagagagagagaggaaggaaggaaagaaggaaggaaggaaagagagagaaagaaagaaagaaaaagaaagaaagaaagaaagaaaagaagagagagagagacagagagagaaaaagaaagaaagagaaagaaagaaaagatttgtaactattttcttttacaggaaattgactaatttgtttagttgagaccagccaggtagaggaggattgatggtcttcatggtctgaactagtagttcagcggatttgagcggtacctttctggtattctatccctgggcctcagacagagagaatgtgatcactagcttgggaaatagcatggccagttctgagcaagagctgggaaagtgatagtgtgagtcttgggttctcccattcctggggcttctcccttacctcaagaaaatgtggatgggtaatgaggctcctctgtccagggaatactggctttccagctactccagatacctcacaggtattccctctgctcaactggtaaccaaccggtcaacaccaacatgacaagaacctgacatgacacctaattcctctgcttccagggcctgtcactgcccctctgtcccaggaggaggtaatcatagacacgttgctgcttacaatgatgctgagttcattcacagccaacttacggtttaactcctagttctgaggaaagccagtactaaaaaaaaaaaaaaaaaaaaaaaaaaaaaagacaattacagttcacctgttgagtaaattcatgatttactagtgatttctgacttttattttttcatctttaaccggaatgcagaccttgtttcattaggtttattatgtttttaattactttaggacctatttggtggctaattatctgtatgacaggaaattaaactgagcttccatttgtctgtaggcactgtgaaacctgacttccttcctcccaccctggcccctttcttttttcaaacaatgataacatgaattgtaaatctggaccaaagtgatttgggtgcaacatgctcaggctatgcgttataaaacacttagtgaacatttgaaagatggccagatttttgtcaattgattatcaattgtcacctgttgatcgattcaatgtagttgacataggaggctcttccaccatctcggtcaagtgtaagacctctcacgtctgacttctgaggtttaaaacctggcatttgctactcggtagctgtgaaaccttgtccagtttctaaaacttccaatgttttagtgtccttacctataaaatggggataataataagacctcatggggtagctgaaaactaaatgagacaatatgtgtaaatacatgtcaagtatttcgatcctggtacatagtcactgctcaataaataatcacttctattgttaagacagagccaagagttgcagagatgggtcagcgattttgttgacagccatctgttgtctatttcagataagagaagagcattgagaagagctgcatgtttctgctgaccttgatagtagaggcagggtttgccccttagtctgaaattaggcaggaaggcctgcaacatatggactgtcacatgctgcaagctctgattatgtttgctcttgacttctcagactggccaggagatgctaatttaaagctcacagtcataaaagattcgtccttgccttactttccactgtctaactcttgcagaagctctcagtaatgacttctacaggtggtgtgattccctccccaggaaagtataaaagcaagagaacaaagtaaataaaaactccctaattcctttagattttatttatattcccatagcaaagctgaagacattctttatttagaatatttgtctcagttgtcttcattatttgcaatctcaggtataaaatatgctggaataactggagagtggtgaaaacatctaaagtgtatttacaggcctaggttcatttttcaaagctttctcttcttgtcagcctttgtcaaatgggttcaagcttttaccagtaagaagcaaatattacattggtgcacttcaatctcggtagttcagaaggaacccttatgcccccaagagctaaatttaccaatctgagtgacatatctgcatggaggaaatatagcagcaggaagagagacacacaagcacacacaaaccaacccgggctgcaatgataattgcagtgtggcggtccctggtatcctaggagtaattactctgacattctttatcattgtgtgttagatgtgatatgaagcaattatcaagttgttttttggaatattgatgcctggccgtctttgcacattatcctcatctcatgctgtgacccacaggacttaattctgacaccttgagtctctcatggcagattgataaggagccctggcttaatcttccctttcttaggatgagactctggtgtttacccttgttattaaggagaagtactgataacatgcgctactgccattttctttttccacttgcagaattcgatttgtatctcaaattctctagtgcctggtctcctactgaaaatattggcacaatggcatttattgctaattgtaaactaccctcataacaaaggcagacattattgtttttccttataattacttgcaatagtccccgtgttaaccctattttaatagtaatctaaggactatggaataaggtttattaagaccacatgcttcagatctgtgcagactttgttggaataatgcttgtgggtatagaaatttcactcttcaagaggtggtctattttcttaagttgaaattggcattgtgtcagtattttgctttcatctgaatagctgtttctctgctcctttatttcatttttttctgagagcagacttttatttggagcatggatcagcatgcccacatttagaatatttcatatcatatcagcttgtttgtaccacacacaataagaggcatctggcatctttcagaaaggctggaggaagccacttattgatgctgtgtatggctggccctccctcgccccatgtacaaggtctttggtgaggtatgggttggtaaacagaaaaagcagtggccaaaccatgcttatagctgtggcctgtggtgacacaggacacatatctatctgtgtgttcttctgtggtcagtgctgtcatccctgggaagagatttcagcatggtggtttggaataatcaagagtgtgggcattgaagacaggctgcccccatccctacatgcaataagacccacccatattttatgactataactataatttacacaaatatggttgcactaaatctcatccttttctctcttttttcctttccttttttcttttttccctttactttgcttagcatgatgtttgaaaggcctatttgtgttgctggatgagcccattgctgctctgtgctctatggaattccatggtgtggaatctgacttagccattactccatgacagccacttcaattggctccagatcgtactactgcaaacaacattcttgtgtatgttcctcacagacctgtggaagaatctctttgatgtacaccttgggtggggttactgggctgccctccagaaaggctgcaccaagcctcactcccattcataacatgtgcgggtttccatggcccccatcaccacattcccaccaacactaggcattactcagctctcattgctattttaatttctgcttctgtgagactaatgactcttatctctctgttgacttttttcccatgataccttttatggaatgttaactcctaactttaatgtaatcaaattaataaatgtttaacatattgatttgtgttttcaaatttttaagatgtcctttctcacatctaagtgacaaagaagttttcataccttttcttcttttaagtttataattttacttttacattagttctttaattcaccaagagttcacctctacagatgataacaggtagtggtccagtttatttttctctatattaggtaataatgtcactaaaaagtccttctttttcctattctgttatggtcacctctgttgatttcttagtgttttctttgtttcgtgtttccaaacattacttcattgtctttactcttcccagtgttgctttttgagcttgataccaatccagttcttactctgcactgtattctgcatttcttagtttttctttttacattttctttttaggagcttgggcaagagtgaaatgagagattattgttaaggggtacagagttttagttttgaaagatcagaaagttctggaggtccactgcacaacagtgtgactgtacataatactactgaactgtgcactaaaaatggttaagatggtaaatttatgttacgtatagttcacaattaaaaacttggatcttgcaattagtttaagaaataaatttaggaatcctcatacaaaaaatttatagcacaggaataaactttatggaaagtaattagcaatgtatgatgagccttaagaatgtccattccctcttctaggtgtgtcctaaagaaaaactgagaaaaatttggagagagaatcatttaagtttattcattgcaacattatttatgatataaaaaatacttaatctaaatgttcaacctgaggaatagttaaattaaggctggtacttccacaggaaggaaaatgcagctatcaagaacttgttttgaaatatatttaatgatatgaggaatattttaattataacattattttaaaaataagaggcataactgtgactttagtatgaatctaattctttaaaaattacacatatatacaaatagaagttaaagtgggagaaaatacactaaaatgtaaacagtaataatctgttggtggtgggactatctgtgatgtgtgtaaatgctttgtaaactgtaacttggcacactaatagaggcagtggttgtaagtcactcagaatgaaaaacttgagctatgccaacgtaatagcctaatttaatacttaaaaacccatatttagcatttagcatatagtaaaaattttcctatactatctacatatattatgttactcagttctgccaactacctgtaagataggtactattactgttctatttccttcatgaaaaaagtgaaactcagatgtcatacataggaagctgaagaaccatgatacatgtacccagaacttcctgacattaacccctactttttaccaattccaaaataatctaaacaaagaagaacaagaaaaggtagtcataattgcctaaatgttttagtatcttgttggcttgtggctcggtcaactctactgagagctcctgttgatggccagacccaagccctgtgttgaagatgactgagcaaagagctcaacagaagagtggctgctgggaatgccttcttatggtgggtgttgtaatgcttttattttgcagactctactggggccagtgaacaatgagggaatgaagtacatcattccacatgttagctggttaaagtcatggcacttggcagcctccttgagaaggtactcagaggtccgtggtcattccttagaggcatattgactcattgattaaaatgtgctggatttggtcaacttcctccataacaagtcatttataacacatattatttaggaaatccagaatgctctgagagctaatttaaattataagtactcttgaaagccatgactggaaatgactctcttagcccttcaggcccttgcagtgattggcagtgtacttccaaagaagggcttttaagtggtttggttcattatatgtgcattctacatccaaaagaacccatgccttgcatgggaggaattatgaggccggagcactcctctttattagaaatgtaaaaacacacagccttgccctggtcagacattcctacacccctggagagtcctaacacgggcttaaggtccacagaatcattgcaaattctgaatatgcatattctctcaatggcagtacatattttcccggcttaataggatgttaaaatgtggctcttgattttggctcaggcataagacaatgcctgctatattccatggagatcatcctacaaaacttttaaaaaggaaaggtatgatcccttaaagaactcaaaccccttcctcatactgttagtctgaaaggattgtggaaagttgtttttatgtttttatttgtttgttttgaggacaaactttttgaagataggtgctggtatatggtgaatctcattcttctcccacaaggaggagaggtggagaaagtgtttgcttctcaccttaagcctagtgagaaaagcttcagtaaggccattccaagaaagtcaaaaactttccttgaagttagggaatatattggcctgaggcgtgtctccacatgaaaaatgtaaaagattagaaatggtttatcagcttttacagtggtgcaaagggtaggtcattgctctgttaggattggatttattggggcaaaggatacaagagtggtacacacagaccagaaagttggaaaaatgctggtgtaggactatcttggattctgtccagtagggctatccagaagtgtaaacaggccttagcagttagaatctaaagggagtgccggattccttggtcaagtgagagaaagatgatgaaatagagtagacacgtcacctgtaaaaggctaccagaggtgggcagtatctgatgatggcatggggttgaggcctttgaagaatcaacaaaaatgcttcataaaaattaattaacttcaaagatcagcttggcccaaggaaacaaagccatcttttctgttctctgccctctgcttcctcccttctttttaacccagaaggcagtagaaacaaaagttaataggaaaagagttgaggtcagccgggcacggtggctcacgcctgtagtcccagcactctgggaggctgaggcaggtggatcacctgaggtcaggagtttgagaccagcctggccaacatggcaaaaacctgtctccactgaaaatacaaaaattagccaggcgtggtggtgggtgcctgtaatcccagctgctccagaggctgaggcaggagaattgcttgaacctgggaggcagaggttgcagtgagccaagattgtgcccactgcactccagcctgggcgacagtgtgagactctgtctcaaaaaaataaaagagttgaggtaaaggaggaaggatgaccacaccccactttcccaactttccacctatgaaaagcaccagctggcaaaggggaaaggctttaacttcaaaacaaacatgtttgaagtttaaattattatatagtaatcaacattctaaattttgtgaaatactgtatctagtgacttaaagtatctttaagacacttcatttcctaagcatgaccagtaaagtcatggactgctcagaacttttttaagaagcagggaagaatgcctttctctaaacgcttttcttcgggggatgatgggagacaaaattaagttgctttgttccatcccatgagttgtgtctgttgcatgtaggtgtaataccctcagatgcccgactgaggttatcctgccaacccaccagtctgcacttctgatcttgccagtctggtaactgctctcagagcgtggtgctaataagacctggaaggtgagatcccaggattctaaagactagtcagttatctgcaatgtacattttgcaatgtgaactgagcaggagaatagggttgggtcagggcattcagagggaagataagctcaaagtgggtgcccttcctattgccttggggcctgacaaaaattatttcccatgctcactggaaacaaagtttgaagttaatatcctttactagggtttccagatcaaccttgccatccaataaaaatacaggacactctgtatttaagtataagcatgttctaaatatcacatggaaattcatactacaaaattagtcattgtttacgtgaaattccaatttcactgggtgtcctgaattttaactggaagccctaagcgaatcctctccctcttctgcataataggatcacatttataccattatttctttaaaaatgcccagtgctggagccatcaatatctgcaatgatcccagtctccacatcaacatttggcatacgttgtctgatacccatcaagagaacagtttaaagtgtttaaattgaggccggccgtggtggctcatgcctgtaatctcagcactttgggaggccaaggcgggcggatcacgaggtcaggagatcgagaccatccctggccaacatggtgaaaccctgtctctactaaaatacaaaaaaaaaaaaagaaaattagccgggcatggtggagcacgcctgtagtcccagctacgcgggaggctgaggcaggggaatcgcttgaacccgggaggcagaggttgcagtgagccgagatcgcgccactgcactccagtctggcgacagagcaagactctgtctcaaaaaaaaaagtgtttaaactgaaaccatccgagaatttcaggcctgtgatccttttaccactgccctttacacgaaacagtggtcaaacaccaataactgttcttgagtaacttttctgccaagctggaaaacttccagccgtgtggtcttggacaagccacttcacctccctgagttctcatcacctgtaaattgataataataaactcctaatgagaaccaaataagctaatgaaggggaattagcatgcaacaccataaaagtccttacaaatgtcactacatagcaatagtgtaggaaccaatatgtctatattttaaattttttgctgttggtattcagtttacacacagaaacacgcaaatgcatgaaaattactttttaaggtaacatacaactccagaggacctgactccctgaggacagccatggctattagaaccaccacagaactccaattaatcagttcagatgccttctccatggaatgcttttccagaaccccctctaagtatccagaccttttaaatccccctgtcttttcctttggctgccaactctaggatggggcacacaacctgagaaagatctcaaagatgatgagaaaagaggaagaaagagtgggtgaagaaaagctgcagatcagagctcaatatgcagccctcaatggtgcaccttcccctcacctagaagcagtgcaagtggttaatagccactattcttggggagctggcaattctccacactcctcaggccagtacagactaagccactggagcaaggcaggcctgtctttctaggtgacactgctgctgtgcaccgagacccctgggatggcttccagaagttcattctcactggtttcagcactcattctacatttgcttcttccaagttcctggcagcctgtctttacttccttattaattcattcatttttgctgttgtttttgttgttccggctaacaagacttaagaaaagcccatttgatcttaatttcgtgttgctcattatcagttctcttttaatcgttttcttatgatcttcatcaaaaaagttacctgtaaaacccaggaagaaaagtccttcatatctccccgccctccccttcttctttctctatctcttttgatgacaaagtggcaagtgactttccagagagctttaggaaatctaaccaaatgacaaaatagttgtgtgatgtccaatatactgaataaatgtcttacagaaaaacctttagcaaaaagcctggggaggaaggtaacggcattttaaaaaatcagaagctcagaggagacaaacactgcttgatgagcacttgagatgaatactacaagctaatgcgagcaatcagcaggtttgtggagaatatgctgatatctgcagaaaaaaaatgcagtggcagagaagagcttacagataaacacaggagctcaaaaatatatatattattgctagaaaaaccttgacattttgaccatcttttatgttgcaactagaagggaaatacagagtccagttcttacaactgaatatccttctggtaatgaattcattctaaatgttgtttcagaactcctctacatcatgcttcatcacatagcaaattagccaggcaacccctcattaataagaatagttaaccataagaaccaacaagaaacatacattaataacatttaaaaatttaaatcagggattcaacacaggaaggtaactcaattcaggatccatatttgttaccttctgttgagcattctcactactgactccctcagcctcactggggttccagttgtcagccccccttattggcaaaggagctgtctattggactgtccaagtggtatagggctcatcttttcacgcctctcaggagctcctctgtggatgtttcttgtaaagcctgcatttctttctttccttctgcagaaagcctgaacagttcaaaacacctccacttaaatgtgtgcgcccattcacccatcccaaatggcatatagtcttttagtgaacctcagctgaaatgaacaaaaaagaaaatttaagttcacaccttcatgcaaaaaaaaagaaaaaatcatactttgtgcttatagagatggtaatgaaagatatgatttaatagatgtttattggatgttgacactcacccatcccaggataagagttcttcaaggcctgctatccagtgatcggtgatcaccttaccgttagtttattggctctgactcgccaggtatcaataataaagcaacaaatattctgaccctcaagcatgactcatttatacttttaattaaggtttaacatggtgaaacaggtaaatttgtttaaaagtgaacttgaggccaggtgtggtggctcacgcctgtaatctcagcactttgggaggccgaggcgggtggatcacaaggtcaggagatcgagaccatcctggctaacacagtgaaaccctgtctctactaaaaatacaaaaaactagccgggtgtgttggcatgcacctgtaatcccagctactcgggaggctgaggcaggagaattgcttaaatccgggaggtggaggttccagtgagccgagactgtgccactgcactccagcctggacaacagagcgagactcagtctcaaaaaaaaaaagaacttgaactgtttcgattcttcagtcattactgaatcactaaaaataacgtgatggatgccaggatacactgtctaaatccctcactgaagaatgtagaccccaacctcctgccgtgatgggagtgttaagctggagctaccagcctctatacggattgacttagctaaagaaagcccgaggttgtatccgcattctaggtggcccacatctgatgaccaatcaacccaggagaacaaaggcctggcccgctagtttcaactcagcacagctctgaaaggtcatgctagtttcagactttcatcaagttgagttctgtctcctttgagactgacatactttgacttcaatcctctgcccagttttactgccctcccttcccgtctaagggtgttgatctcaagagcgcttcctcattatctttctgcatgcatatcttcatttcagagtctgccttctggagaacccaaacttcagtagctacttcagtttgttttagactattggcttaacacacagagacctagtgagtttctttattagcccaggatctatgaagaatgtgctaaataatactctttccctccaaaaacatcatacaaattgttcgtagttttatccagaaaacagaagcctcttgaggagagagtagtggagaatgagtttggtaagagaagaggagtctagaataaaaatgcctgtgtaatgagggcagaagtgagactagtaggaaagtagacatatgcataagatatttccttcaactacctaaataattgttgataaccctgccattttacttcctgcaatggaatgaggtctctactaatggctaccctttgggagttcttatagtttttttttaatatgtcccagaaaatttaaccaatgcccattttcttaaaaaaaaaaatctatcctatttcttgcttgtgtttctgtctaaaaattacattggtgtaagtgtgggtgtgagtgagggcatgtgagggggaggctttatttatattgtgtctttcagagcctacagctacttctaattgaagcacaataataaatatgactagatcaaagaaatgttaatattatctgtggagcttccttatttagactttgaaacactcattaattttctttgattcatattcagaatatcaaatcaagatctaaaggaaataggctggagtggtggctcatgcttgtaatcccagcactttgggaggccgaagcaggtggatcctttgaggtcaggagttcgagaccagcctggccaactggtgaaaccccatctctactaaaaatatttaaaaaaaaaaaaattagccagacatggtggtacgcacctgtagtaccagctacttgggaagctgaggcaggagaatcgcttgaacccgggaggtggaggctgcagtgagccaagattgtgccacttcactctagcctgggtgacagagtgagacgtctcaaaaaaaaaaaaaaaaaagatataagggaaatagccataaatctattcatagataaattgcaatctggatggaggaaagaggagggaatgaaacttacccctaaaggcagttaaatatttcataagggatgcaggagccatgggctttttcaccttttaccatttgtgaaagccagtttttccagtattgcaggaaaaatcactacactagttagcataaaaggaaaacagaagagaatttcaccaagcctgtcaactgagagagtcactgaagccagcaaagattattcatgttcaacctgcagaccttttagaggacatcaaagatcaaaggtttacccaggaatgttttcctggaaagagtgtctttaattgttttaaaaaaatgtattgaacaatatgtgttctggaattgaactttggaataactcatcactattttaaattagtggtcattcctctattccttgttatttccaagcttagtatctgattcctaattccagtagagtccagaattaggcaactgctttttatgatgtcctgtttgtaggctagctttctgcatcccactgcttctactagattgacaagatgaggcaccttagatccactgtggaagtatatgtaccacatgggcttctattaaggcatgagtatagaaaggggaaatggcccaaaccagagagttgcacagagttttggcatccacaaactcagtgcagaggaggaaggattgatcaaatgagcttatttggttcccttcttttctccttcctccctctttccatcttttctccctctggcttttaaccctggttgtgaaacaaaattaccaattcagtttttttatttgcctttttaatgtttttaagaatgcctgtgcccaagcactgaaacaatttctgggaatggagcctgaacagctttatttgtaaaaagcaccacaggcaattctacagcagggccagatttgagaagcacagagctcctctatccaaaagtaaagcaccagtggacaagaggaccaaatgggacgtgcccagctgtaggctcaaccacaaattgtcatccatctccattaagtgataccacagaatttgtataccacctctcagagtcattattaacttcccaagaatgccacagtgttctgagggacgcagatacatgccaccaacatatgagaacattcttggtgaaatacgatttggggttcttggttcttctggggtttctgaagtctttatgacacagcaaagtctgtgctacggggacactattaactccttagtaactggttatcttagagttgcatatttctgttataaatctcaacaattatgatgaaataatttcataacacatttcaaaagtgtccacccttctttccctttagcagttcatgttaatttttaagtagtgaccctttacaatttctcacccaaatctggccttttggaaacagagctataaacggatacactgtggatggagttttactggcaaaaggcattttttaaaaattcccatatgttcctttaagtgattttttttgttctctgaaaccaaaaagcatatgttgaatgattttttcctcacactaatatgtcgtttcagacccttaccaggtctcttaaatcttttcactttcttcttttttcatctacctacaaggcaacttatgtgtagtccatgacttgatctcttttatttcctttgtatgaggagaaattgtgcctggatggaaaatcatgagtcttcctctctctgagcactcttgactctcctgtcttggggcatcattctttgtaatatagatttttttttcataatttcccacagttgccatagacagatgcaaaatgaaaagagggtattgattctctttcttttgtggggcatagactctttcagataacttcagttagaaaaaacaggatgtaagcgtgtgtgtgtgtgtgtgtgtgtgtgtgtgtgtgtgtatcagtgttggttctcaaccctgatttttcttttggagtaaatcagtgttggacccaaaaagcaaaaccaaatagaataaacaaaatgaataaactaacaattacctaatagctaagaacatgaactctgtaatcacatgaggtcacataacatgtataagtttgaaaatacctatttggaaaaatctggtgaaaacttggttctaatttagaagcagtagttctaatgagttttgtgtataagaaataggtgtgtcttagtccatattttatgacatagccattgttgtctagagcctcgtgaaactcactttccatcatgtccgctaaaaccattccctacttcttacaccatgtcagaccttccttgtgttgttcaagggatcttatatttctatttctaagttacaggtaaatcacgatgcttgctggtatctcttcacagatgttccactgccacatcaattcagcatataacacagtgaactgattacatactcccttaattttacttcctagatacttgtcaacctgtctctccccttctctacttttaatgcctttgtttggatttttataatgtctcatttgctctattgcaaatgcttctggcttagtttttctgtctctagtctcttaccctccaaatctattctccgcctgtgtgagccatctgaaaaaggcaaattcactatgatactttttcttgtcaatttttcagtgtctcagtcgcctttttagcagaacatataagaatttggatggccccactctcgactcgacttctctaggcaaatctaaccatccctgattcagacgctaggcttctgacttctcacacatctcaggctttttcctgcctctactcctggcttgcttctgcctccacctgggatgctgtttttttcttcttcagttgattagttggcgttcatttttcaggactgaacacaggtttcagccttcctgtgggtctgggcttgttacttctttaaccctccaaggcctcctgaagatttctctgtgcagcacttgccacattaaatcgtatggtatttgtgtcccaacgcactaattttaatgttgagaacagagccttgacaacttcatcttgccacccctatcatgaagctacaagtatatgctcaataaaaactttgcaaatgcttaatccagaaggaaacttacagattaactagtagaatgactttatttcaaaaattggggaactggctaggcgcagtggctcatgcttgtaatcccatcactttaggaggccgaggcaggcggatcacctgaggtcagaagttcaagaccagcctgaccaacatggagaaaccccgtctctattaaaaatgcaaaattagctgggtgtggtggcgcatgcctttaatcccagctactcgggaggctgaggcaggagaattgcttgaacccaggaggcagaggttgccatgagccaagatcgcaccattgcactccagcctgggcaacgagagcaaaactccatctcaaaaaaaaaaaaaaaaaaattgggaaactaagactgggcatggtggctcatgactattatcccggcactttgggaggccaaggagggagaactgcttgaggccaggagttcacgatcagcctaggcaacatagcaagacctaattgctaccaacaaaacaaaaacaatgggaaactaacatacaagaaactgaaataacatgtcagaggctaaatgtgaatttgtagctgagttgaaactagggcccagatatccccattgccttctgacacattttattttgagttgtataatttggcgtattcatgagaaacattgttaattggattatattaatttcccctaattaggtttgcttgggaaattgcagagatgctcagttctttcctgttcacagtgacccaagagcttgatacttttcagccattggccatttcatcctgcatctattctgctcttaatggtactctaaatagcttattttgcaatcttaaaaatctcatgcattatgtcagtagagatgtttgtttgtttatttatttattttttgagacgaagtctccttctgtcacccaggctggagtgcaatggcactatcttggctcactgcaacctctgcctcccgggttcaagcgattctcccacctcggcctcctgaatagctgggattacaggtgctcaccaccacacccggataatttttgtatttttattagagacggggtttcaccttgttggccaggctggtctcaaactcctgacctcaggtgatctacccgcctcggcctcccaaagtgctgggattacaggtgtaagttaccgcgcccggctgcaataaagatgtttctataagccaaactcattgtaattctgtgtgatacattaattcagatggtataaatgtttgctaactaaaatcaatatccagagatggaattcaagaagtgtcatctgagttgggaaaaaaatagtgcaactgatattttggtacaacttagccatggcttaacccatctcaatacagccacatgattcttctcctagcatagctactgagggaagaggaatataaagaattctctacttctcatactggttacagggcatgatattctttaactttgtagattgcgagatataagcttgtgtcttggttatatgttgcattattgtcacaaatttgtgataacgtcctgtatcttctccctgttttacctctgtgattaaaatatttttcaaacgtgcactctctccctgtcacctccatgggaagagcattttcttgcaccattaagccttgtgcttggccacaggacataacttggtcaatggaatgtcagcagatataatgtaaacacaggctttaaatgccttgatctcttatgctttaccattgccatggaaagacctttctctgcgtagctgttatttcctcacccttgttctaggaggagcacacgtgcaaagacctagaccaacctgcatcaaggagccgagcctaactaggcctcagattgaagcagtttcccagacaagcccaacccagatcaaccaaccactaagtgacccacagaggcaagaattgatacatttaagtcattgacttttgagtgatttgttttacagccagctgattcaactcctccctaataggctacttaattaaaaaaccttaagccttttgcataattgatcctaggacacttgcttctcctgctggtcttcacttccttctcttttgctgctgtcttaggctttttgaagtcctgtttaactttagatacctgtgcttgtgttcttttaagttgcttttcttcaatttctttttcttttcttgctcctttacctgatctgctacttctcctggaatctttttctttatgttatattttatttctgcttttatcttttgctgcccctctaaatgtctttaatttataatttctctccccttatgtgcctgatgctgctcattctgggctcttctttttgtttctgcctctacccaattcttgtgggatgatgtcccagctacatcctgctgttctttcacctgctctattcctccagaagcagaaaggcagacttaacaaatgatctgaaatcctccccttgaaaattccaatttgctttctggctccaatggcccacccacccccaggtgctctgggatggagcttattaattacactcccttcagactaccctgacttgaacagagggaaggaaagagagaaagtcgatagggaaggtgagagaaggaagaacttgggaatcttattaatggtatctttgttttctgaaatgagaattggagaaaacaaggcatacggtgcattcattgttttagaactgagaaacaagctcctattcgtcttgccaaaaattgcaaatgtgtgtgattcctctccattagctcacagcaatattggaaatgtatttgactaaactggaacacaccatcagcccaagatgcccagaggcagctcaatacagccatccatatgcttctctgagttaatttggaatacagagaattcagtttccaaactgtccccatgaacatttgtaaaatcctgcccatgtgagtggaaggtgatctgtaccaccacatgcaagctctcaataatgccggaggactgtgtcatgatagaatgcaaaggaacgacgggaggtattgagacctgcaactcttaactgctactgttttcattggtttaaacatattgctttatagaatttctgatttctcaatgctttattaaaggatcagcaggggttaggcagttgtagtgtaaattatataattgcagccaccacaaatgtatataatggccctcggtcgcttaccagccctctcaggggatacagattgaccatagttactcaactcacaggcaggaagtcccagaacatgctattacttccttctatagcatcatagtctgtgcattcttctacagattatcccaggcaatgaattgcatttaatattgctgtgggtaatatttcttcttctgtctcccttttgctagcactcctggaaatagctgaagcacagtacaaatacttacattgcaaaattatgttaagaatttcacttaacgtaaactgctccctagctcatatatcaaacatgaagtgggtagattgaacttccgtttgctgggcaacctcagtatgttacccatctacttctcccacaaccgttgccactttatctcttcccttcctggacacgatcttagttgcctagagcaccacaaactgcaaggcttaaaataacagaaatgtattctctcagtttaggaggccaaaagttgaaatcaaggtgttggcagggttgattccttgcagaggctctgagggagaattcattccttgcttctcttctagcttctgatggccgtcggcaaccctaggtgttcctggacttgtggctgtgtaactcccatctccgccttagacttcacatggccctctcctctgtctgtttcttctccttttctttctcttacaggggcacttaccactgggtctaggatccatccagagatgcatccaggatgatctatcttagcataataacatctgcaaaggccctttttccaaacacagcagcagtcacaggttccaggtgggcatattatgggagaccaccattcaacctactacaggcatcttgtgtaggcaccctgcctgcagctctcagtattctctgcatttaccgtgtgctttggatttggagttgaccagaaatatctcctcacctccactgcagcctgttctccaacctctaaatcggtgttggcagtggaaaaccactggaccagtaaaaataattgcgtttctggcctggctgtggcctcatgcagaaggcagaagagaagccagatgctctttctcatttcaggctattcagatgactgggactttcactgactcacttcatcttgtgcttttctttttatgtcttttagccaaaaatctttttttttttttttttttttttttgcccccagtgagcaaagtccactctgccctctcagtctgccaatacccatggatcatgattgctattttgcaatcctaagagactcatgtcagtctgtacagctaagagcacactgctcattcatggagagcctgctatatgtatgtaccagacactgcacatgatgtgaattgtgccttatttagtccttgtaacaaacctttagggtagatagcaatgcttcattttacaggtgaaataactgagtctcaaagaagttacctgcctcccccaaaaaatgcccaaagataacacaatggcagagtcacgattggaagcctgccctctgattctgccaccaagctgtgtccattggcatccagcttcctctgcacatcatttaatcacttgctaatttggcatatatgctctggccattttttatacctatggttttctgaccaaggttgttaataaacaccctgcatgcttgccaagcacctacctggtgcctagtctattcttctacttccagttggtgtgcatgaaggaccctatagttattttagtagagtaggtgctggtcacagtcccatgggagtgaatatgccagctagcatccctctgatgttctcttgtgattaattacctgtgactctgattattccctcactgtgaccccctcggcacttacatgctaaggttgtgcagtattcatttgttcttgtggaaatatggctctgtaattgcttctaaacaattttatttatgcatctgttgtaggcagagatctaaatctagcaatttaagccattactagatgatgtctataaggctccgagcaaattcccgggagctgggcacgtagtggggattgggcatcctagatcaacatgcatttgtgtgtatgtctgcataacaaagcaccttttaatgcaggtcagggcttttttcttgtatttattccctagttctccatcctcctaccaccacccggcaacacacatgttgcagtactgcccacagggagctaacataatggtgaccgactggtggagtcgattttcatacagattttgagaaagaagcagatatccaagccacagcacactatgggttcatttgctaccttagtaaataaaacccgtggctttaattccaagaggagttagtcttgtttcaaattatagaatacagccaatacagctatagcatgagccatgccggctcatgattgttacctcttggctgttgcccaaatctgaacattgtcttgtccccaagactttacttctggcctggttagaaaaatgttctaatctaattgtctgcctctattgcgtcgactcttctgggagataatggtccctgatgctgttccacatcctcacttttagctaactttgcataatgcacattacattatctctgtcttctcccattaaggcctgcaaaatcatgggcgattgattaaggctgagactaggctagaaatttcttttgcaatgaagctctttcaggagtaacattttttaaaaaacatattcataggacacgtagcaaaataaatgagactgcagacctccacgttctgcggaagaaatgctctgctgccactaaagctttagctattcatcaggggcaatggaattagagtcacagacgttccaatattgtaagagagaatgaatagaaacgatggctctgttgttttcttgtagtcgtttttaaaatggtctgtagaatgtgcctctgggcagaaaggaatgaatgcaaaaaagagaaaattttacacatttctgttaaacatcttaggcttctggctatagaaaataggacagcttcttttgagagaagtgtgtctagtgcattttcccatcacttactaataaaacaggacagacagactgacaggctgcctgaaaagcagcctcacagtggaaggacagcatgatcacacatttcagcctgggcacgggagccaagagactgtcatttaataagtggatgaagaaatcattttccctgtggcaaaaagggagagaaatattcagctgcatctctagacctctatcaggttaaaatgaatatgttaagagaattaagctgcacctcctttattagtgtgacagtaccctggctagttggctatattaaaatggcagacacagtgaccctgttgaactcttcatgttgataggcagtcagaaaataatggctttatagttctgcatctgctcagatctttccagatttgctaaaatttccaacgtctttgtctacttattatgacagcttgttctctcctgattggggtctttattggcatgtgagcatggcagcattatattttggcatgtctgtgtaatactgcagaaatcaccttacttcaaacttatttcggtgcctgtccttcctgccttgaaaaaggtggatagcagtataatgcttagacatcaaaccttcattttttctctccctatgaactctaaaatcattttaattgaaacaagaaggtttttgccccctgcattagcatgtggtgttttttctttgtatcaatcaccacattaagaattttaagatatcatcccattaaagctttacaataaccatgaaagctatttataatgacctattccactgataagaggacggaggcttccagaagttaatctggcataaggccacttggctgggattcgaatccagtcttttttgacttcgaaatgtttgtggttccacccactctaaggctgccttcacacagtggaacttgcctcttagtgaccctgttgaaaagaatgtaggagggtggaaagtctgaccgtgttatcttaaaattgataagttggctgaatacagaggcatagtgactgataatccaaatggcatggattgctgacctgctgctgtcatggctcaatagagccacttactatttttgactgcaccttacacctatgggagcaggtggtgtgaatgagagatgggaagaaggggtaaactttctttctaaagtaggattatatcaataacccagactcacaggtgtaacttgctgcttttcagttgtccgcaggaaaaccagtgtaagtcagttcattcctgctgtgtgatcttgaaaagtcaccttaattaccttaattacttccatattctgttggaagaaaagaaaatgaatgtaaagcacctaacgtcatgccaaacaaataggaaacactcaacaaatggtagatttagatgattctcttcttgtctgttatctattctattatccatttgttattcctagaagtgaaaataagtattacacctttgttgataattttctcccataaccagttcccctggttactcccattgcttgctgtgtttcctagcttctaaaacacatatttttttccacatttggaaaatcctggaattgcaattcattttataattggagtaaagggaagcatgccagctctccagaatggcatcacctgtgaaggtgtgctccaagccacatgttcaaggtatctcttcttctgattgtcaactcaggtgagctatttgcattggcaataccacatacatctaaattttaacgtaaattggaatcactacctattgctcagtataccacatgccctgttacaataaaaaagtattgtatacaaaaaggattgtcatgggagtgaaaatccaattaaagacagtagacataaagaattgcaaagctcgaggagattgatatatcttaaagaaccaggactcagatactcttggttttgataacatacagaataatgggtgttaacttttttattaagtttctaagatctctgccaaactaatatattcatgcctctattcaagagaaaaaaaaattcctgccagataattcttacttcttgctttaaaaataaaattctgcatacttctgtttttagcacattccctgttcctctgaggtaactttgtctctgctttgctgagatgctttctgatcccatttgtggtgtgtgcagggtatggggaatggcccctaaacatgccttccctgaattcctcatttgctactgactttcctctatcccgaaagggtagccaaggtgaaggcctcgtggttctgaggagacgacagcacccaatctgcaccaagttctactcaaaacacaggcatgctcatgtcatcagaatatcgaaatgcagaccaggatggaagagcttttgaagaaggagtgtaagatcgcatccccaacctgagtgaattcaccccctctccatgtgaagagagagagaaacttctgcacactgttaacctagatgtgaaagaggaattttcagagatgaaaaaccatttccaggttttcacagggtcaagttggtaaggtgggaatttctagtttttcaggaaaaatctagagtagtggtcacaaaaggtatgttgtcctctcgatgcctcagggtgagagggaggacaccttcatcagagctgagagagggactcccgtggggatgtgtccatggagatttctagatggcacccagagatcatctgtgattgagccggcactcgatactagcagcacaagaacccagaccagtgaaagtatgagcagaagaggccagccaagaagtgaccacaggccacacactaccacacccaccatggtccaagggcctgtgtcggactgaggagtgtcctgctctttcccaattccactttgaagccctcacacacaaaaacagacatttatccctccctgccactgccagatgacagttgcaaaattagaaatcggactcggggaagaaggcagggaggtacctgtgagaagcatgagggagccctgagatgcacattatgagctgcagtgtaaaagtataataatatattaattccagtgaaactcccaagagagactgtattaaaccaggagtgactgaaaacaaatttggttactaaatgaaataaataagctgttggttccaggcagatcgtaggccaaagtggaaagctggtatttgttatgagtaaaagtgagggcagcctcctaggtatacacccctggtgggtggagtttgtctctcactccatcagttccccattcttttttttttttttttttttttgagacagagtctcactctgtcacccgggcctggagtgcagtggtgtgatctcggcccactgcgccctctgtctcctgggttcaagtgattctcgtgcctcagcctccctagtagctgggattacaggtgtatgccacgacacccagctaatttttgtatttttagtagagacagggttttgccatgttggccaggctggtcttgaactcttgacctcaagtgatccacccgcctcggcctcccaaagtgctaggattataggcgtgagccaccgtgcccagccagttccccattctttatgataacgtacagtcatatcaaagaagaagttcaaagaagagttcctttacatttgggctgaaacctactcttggaccttcacctggtagctcattagtgttaacctaagaaccctgtttttcacctcagcaggcctgttactctggtaaacgccccaggacatgactgctctgtctgcccttccatacctctagacgctggcttggattgttcttcaccctgaattgcctggttctaactttaattccatctcaaattggatttcctctcttgcctctatacaatcttctctaccatccctcgtgctagtaaaactcttcttccagttctaactagtgttgataggcccatatggtattctgggctttgtcactgaaaatcctgaaattctttgcttcagtcatttgcagtgattcaggtttatggagcttctcatgttacacatggctactagagtggtgtacccatatggggttcaatttcctaactcccttctccctgactgctaatgcttttccttctgttcaggctgggcacttcagatctcaaacacaatttgttagtatccatctccttagctatggtagaacagtgacttctccagggatgtttctgagttcgagactaatgttccatttaccacatctcaagatcctgttcctgttttgcggaataatccctgctgcactgtttttattttgtttttttcaagttaccaggctttgtgctctttttccctgtagtttttctcccatgtttatctattgtttcctacgaatatatgctgagagtcagtgggcctagtgtgcataattcaaatgtggttcgacagcacagggacacaacagacatgattagatcattcatgtttagatcaggaaggatgggggaaaaatttgatttggggcttggggagcacagttaacgtttttccaggatagccaaggaggatttatagtaatttttaaaaattgtgtcaggccaataaagtttatgaactagatcccgtcacaaaacttagattgaaaactcatccaacaatggctaatagctggaaagaaaatggttgccctatgtttcaaaacaaaagtagagattcagttgaactgataaatatgaatgtgtttatacagacaggtgaacataagttttcagattgggggaaaatgcaaagtatacacatcccatatattcatggccagagaattctatcttgttcatcattcattcatttcataaatagtaggtataggcatatcaactacgtgccaggcactgtgataagccctggggctacagaaataggagacatggcttttggtctcttactaggaaacagaatagcttcaggctgtgtagtgcaaccatggtcttctgtgctggttgtgttaggtagggaaggtgggggtggagaggaagttcagggaaggctttctggaaataatgatagctgactgaatattgaagggtggggacagggttttaggaacaaagaacaattgatgcaggcatggaaaacaagcatggaacataccacatatggaacatgtgggtgtagaagggaggatgagtgaaacagggcaggtaggatgggcacagatcgagatggggggtttttgatgtgttaagagattcagattagttctctgatgtctctagaaggccatcattagtcttttttttttttttttttttttggtggggtgtatttcaaatactgaaaaagtcctttgggctcttggggctccccacactcatggttcctttccccacaactcactgccctcctcccaacagaaaatctatttcgaggacagtatgctttttaaatgaataactaacattgtgttctcagctaactgcagaaccagaggagctgtttgcatctgtctatgcagattgagtttctttaatctcacaccaggcctccagccacatggaaacaaggcagttatctgcaaagctgaactagatctcatctctagtggactccacttccccctctcatatttatcccacaccagcctcatggttaagaaggaccgtcaggaatgtttttatcaactccaagctctaattcatattcctccaagtctctcaccccaccctcccaaccctgcccccaagatttcattgagatttctcccaacagttatttggaaaaaaggtaaaacaaaacatgttcaaggtcttggtgcttagcccaaggggctccatgtgctgggacactgatgggcaggggcttctgcctctctaacccatgcccaagccacctcctgacccctggctgcaaaagatgggaggggcagaagccatcacaggacttgtaactgcccaatgggctcaccttacccggtgcctagacagagctgatttatcaagacaggggacttgcaacagagaaagagtaaaattctcagagccggctgtgcggagacaggagttttattattcaaatcagttttgcccaagcattccaggatcagagattttaaggataatttggcgggtggaggaaggccagtgagtcaagagtgctgattggttggctggagatgaaaccatagggaactgaagctgtcctcttgcactgagtcagtcagttccagggtgagccacaagatcacatgagccagcttatcaatctgagtggtgccagctgatccatcaagcaaactatctcaagcactgatcttagaagaagtttagggagggtgagaatcttgtagcctcaggccgcatgactcctaaaccgtaatttctcatcttgtggctaatctgttagtcctacaaaggcattccagtccctaagcaagaaggaggtttgttttgggaaagggctgctatcgtctttgttttaaactatcaactataaactacgttcttcccaaagttggttcagcctacacccagtaataaacaaagacagcttggaggttagaggcaagatggagttggttaagtcagatctctttcattgtctcagttacaattttgcaatggcgatttcagacccagaggatcagcatctcaggatctggcagagccccgggcaggatcattcagcttggccacccgctggcttgctggtgatgagtgaggattttctgggcagatcctgtgtggtggggatgtggtcaccagtcatcaggttcttgtctggttgtgcacttggcagctgcttattctcctatttggctttggccatgttgtagtctcctgaggcaaagtactttttcccttttcggagtcccttcataaggaagctgggcccccaggcctttgtcctaggcttggatatttggcctttagcttttccttctccactgtctcagggagagtacattctttctcccgcatgccctgcttcttcttgcctgtctcctccacggtgttctcgtttagtttctgggacattgtgggactgggacaatagagtataggaggtccaggaagtcaaccaactgagaggtggggaggggaaacgggacatcctgcgatgctgctttggtccctgtcaatagggttgctcctcatcagtcatcttaagcagggcgtggtctaaacgaatcttcattccagatagctgaggcagaggcagggaggctggtaggagactgccgttgtgatctaagcaggaaatgatgaaatgatggcaaggctgaatccaagcagttctccaggacagaaggacactcagaagatatgtgactgcatggagatgggggacaaggcagggcagtgctttggatatggcccagtttccaagcttgtgaaactaagtgggttatgtcccattcactgagttaagaaggaacgaatgagtgtggggtggaagagaatgaagttttttcctgaatgtgtttgtgttggggtttgttataatgagtctcagggtctggggccatcaaagaagggatgatcatgttgcttctggagcataagagagaaaaacccaggttggatatttagatcattggaggaaaaaaataaaagggcaattacaacatcttgttagttaacctctcttgccccttgcctcctggtctgcagactgaattgtaatggctcctacctcaggcagtaataggacaaactgagataacaatatgtcagctatgaagaacacacctgtgcaatgtgcaatgactgctgcttattattaatattgttattaatttgttgaaggtggaagaagcacttagactattcatgtaatttatttctaaatttaaatttaaatgacagttcctagagctacttacagagactccagagagaacccaccttctcagaggttcccctgtcatcacccaaccaagtggacaaaaagctgttagagtcaccaagctgtttttttgtttgtttgtttgtttgtttacatcattgccggttagatggcatctttaatgtcagggcagactcacacataactaaggcagtgctataaggagtagaaataataactgaaaatgtgttatcaagcagtagatgagtctcaggattctgggaacatatggttggtattggtttgactttagagaaggtcacagaaaaaaagttttgtggactccccggtgataactgggggcctgggggagagaggcagtgaacatcatctggcccagaagggaatgttctgggtcacaggcagttcctgaggatacttggggatgtcactttgttcatgctgttctaaaagtcaaggtggatgttgggctgaacttttaggctgcattcacgtgattggggtagaacattttaacacattgccgtttgctctcattgagtcatgtgcatttgttcattcttagtctcttctctctatttcaaattatttcttcccacctgtttggaacaacatcagcattgcatattggcctcaaatgagttaagattcctaagttcctaactagccatagcacaaggtttttcagcttgactggtctcaaggcttttctcagaatccatcgattcttccagaaaactttgctcaggacatgcagattgcaataatttgttttccccaaaatgtattaagaattatttatttaaaaatataaaaacttcctctaaacagtttgagaatctcattgctgaaaatatataaaatgggtacacaattaatttctctccagatgtgatactataactagtaacttatttaaagttgaaagagaataatttgcatctggaggaaggtgttgtaaatgcaagttctggtcctttcatgttcctgatgtctttggaatttgtctttgtctttagagtagtgctgttttggactcagctccaatacagatgacttccacgctccccttggactgattaagtgaaaatgagagaatgaaataatattatccaggagattcacataccccaccaagccacgcagaatgtacttttaatacataggggtagtttagacacctcaagtctgtatggatacctcagggtttaattgggttttgtggtgatgccccaagagcttcatgccatttttagatatatttgttcaaaaacagatcaataattgatttagatgtgggaggtaaagatagatgcgcactaactgtggatgggctctgcagtgagaaggcagtgctggggctgctaatggtggctcaggtggatgcacactgaaggggaaggaccaggggatggggcgaggcattgctgtcattcgtcttgaacggaacagttgtttcattctgaaagtgcttgagaatatactctttggtgctttgagtttggctaatggttcatagtctcattgttctgatgaaatgacttcaaactcattgttgtcattattgagaaacaagttctctccaaataagtttgaggagacattctccaaggaaacaatctcttaaatgtgagatatttgtgaactttttccataaaatacagcagtgcccccttatttgtggtttttcttttcacagtttcagttgcctgaagtcaacttgagtccaaaaaatggcattactactcttgcactttggagccatggtgaggtaaaatacgggtgacttgaacacaagcaccatgataccatggcagtggctctgataaccaagacagctcctgaatgactaacagggctggtagcgtctacagtgtggatacactggacacagggacgattcacatctcggggagcaggatggcatgagatttcatcacactactcagaacagtgtgcaatttaaagcttatgacatgtttatttctgcagtttcccatttatttcacaaggcctacgtcatccacctcacttcatctcctcacgttggcacatcacaggaaaaagggtgagcacagtacaataaggtattttgagagagagagaccacattcacataacttttcttacggtgtattgttataattgttctattttattattaattgttgttaatctcttactgtgcctaatttatataaattaaactttatcttaggtatgtatgtatgggaataagcatggtgtatgaagagttcagtactatccttagtttcagatatccactggggatcttggaacatatccttcacagataaaggaactactgtagtgatatcaatgcgttaattctggaaaaatattacatttcagtcttggtgtcaaattctagcaaagaataatttttaggactatgagtaaaccaaggaccaacaatgaagtagattccatgtcactaggaatagaagttttggggatgtgtgttcatgttttcatatgacttgcacctgtctggaaacaaaactgtttctaattatttttaaataactagagttcaatctaatgtaaactatatacaaaagccagatagcaatcactaactttgttacatcataggcatagataattttaatgaaacatatccaccaagtatgtccaatttctctgatgacagtgctaacttacatgcgcatcaaacatttgataaatgaatatgttaatgactgtaatgtcttttctgggaatgcctttgttggggctcaacacattgttaaggagaagaaagcagatgactgagaggaggtttgtaaagtggggatggggagagtagctggaagccatgaacaaattcattctcagaggcacagatccccctacatgagctaggacctatgctaggagctagattcacagatatggggacgctatgggctttgccattcccaagcttcttgtccagtaaaaccacaactcagaaatcttgcttaactaagtttagcaagttatctgcctatctatctatctatctatctatctatctatctatctatcgatgtgtctatgtatctatgtatctatcatctatctgcctatctatctatgtgtctatctatcatctatctactgtctatctctagataaatatatagatatatacacataatgcatagtattcaatagtactatgtgaaaattatgttaaaggagatgtattagtcagggttctctagagggacaaaactaatggatacatatctatatatgaaggggagattattaaggataattgactcactcgatcacaaagtgaagtcccacaataggcggtctggaagctgaggaacaaggaagccaggagtggatcagtctgagtctcaaaacctcaaaagtagggaagccaacagtgcagccttcagtctatggccaaaggctcgagagcccctggcaaaccactggtataagtccaagggtccaacagccaaagaacttggagtctgatgtttgagggcaggaagcatgcagcagaggagaaaggtgagtgccagaagactcagcaagcctgctcattccactttctgcctgccttttctagccatgctggcaggcaattggatggtgcccacccacattgaaggtgggtcttcccctcccagtccactgactcaaatgttaaactcctctagcaacaccctcacagacacacccagaaataatactttgcatcctttaatccaatcaagttgacacttaatattaaccatcacaggagataaatccctggacttcaagagaacctattgtcaccaatcattttaggcatcatttcatatggtgagtagaactgtgctatatattatattatgtgcagaccggggttagaaagctatggcccacagactgaattaggcccactgactgtttttataagtaaagttttattgaaacacagccatgcccatttttaaaatataatgtctccagccgctttctgacaaatagtggcaaacaatgacagagttgagttgttacggtggaaacaacattctccaaagcctacaacattttctctctggccctttacagaaaaagtttgctgatttctggtataggacaatattatataatatgctttcattttaaacattgggcaccactggttaagtcttattttcttccaaacataacaactatatgaaatctaaccctacagagcccaggagcctacacaccactatttagttcttacacctcattgatataagtaatttttaatatcttgttattatttctagaagtctttttggtatggttctttccatatctagcagtttgtgatttttttactttaactgcaatatgtagcagtttgtgagggataaaataaaacccccttttccttctgtttaaatatatggaatgtcagcaaaagcctcctgttagcagtagctgaatctaagaaatgaaccttttatacattggcttacactattttgtccaaagccaaaaatggataatgaaggaggaaaatgacaaacgttctttcctaaagagaagcatccaagtgtagagaagaccacaagtgactataaaacgaggaagccccgtagctaagggattcacaggtaagcccaggacatgtggactgtggaaggccattaatgtgacatgctctgtggtattcagataccttgctgcatgctgggttcggctctagggaattaagaaaagaggaagatggatatggaaaggtcaatggcaatgggtaaagacatggaaaactatttctataaccgtaaaggagactgagttaatttatcttgaaaaataaaaaaggtaagaaatggcttgccgtaatttttctaccatttatatccattatgatacaaaaagtaaacacttgctggttgattgattaaaacatatgtaagatagagagtggcttagtaaaaggtattttagttgcaaagacagaaatacaagaactagtaagtctaacaatgtatctttatgactcttgaactccaacaaagactttaacagcaaggagttagaaaacttaggctgcacatgggtcttgggaatgattggaacaacgttcctagattctgtctggattctctttccagcaatacatgcaaactttcttctctctcctttcagtctgcccctctccttaccgctttgagcatggcagatgatagcttttgaaatttgtatcagttatccttggccacaaaaaaaaaaaaaaaaaaaaaaaaagacatatctcaaactctttttatgatcccagggaacagaaaatcctggggaaaagatgcccaacttgggtcaggcatctgctcttgggcgagtcaccttagtccagtgagtgaggccgtgtggtgatagtgataatatgctgcacctgcattaaccatacagatgaaggaaggaaaacttaatagccaagggaaaactggcagaaatttctaagtgaacactgcattatttctttttggaagaaatcttcactggaaaaaatccagaagaaatagctcagtctgcaacatgaaggatttaggttagaaaaaaatgagattattctgacattagagcttattacacactgggatatgttactgaaagaagcagtaaaatgtcttttcttagaggtttttaaaaatagaattcatttctcatcagttgagatgcaaatagttttcaaaatggattagacacacagaaattttgtttgacgtgcaaactcttgacaaggtcctgcctctttttgccagtaaattcagctcattctagccttttggtacaattcaacaaatatttattaaatgtccactaggtgcaaagcattaggctagagctaaaaggtttatattatgttatggagatttagaaaactgcaaatggggtgggcacgctggctcatgcctgtaatgccagcactttgggatgctgaggtgggcagatcacttgaggtcaggagtttgagaccagcttggccaatatggtgaaaccctgtttctactaaaaatacaaaaattagccaggcatggtggtgcatgcctgtagtcccagctactcaggaggctgaggcaggagaatctcttgaacccaggagatggaggttgcagtgagctgagattgtgccactgcactccagcctgggcaacagaacaagactccataccccacccccccaaaaaaaaattgcaaatgactgtaatatgtggatagttgaggccattgtcacaaaggagatttagatttattgctgtggaattctaaagcatgagagagagtcatgaaagagagaagaagagagagagatgctaacagagaaacaaggaaacacagaattagcaaagtgttagttgatagactgagatttgaaatgctctttggggtaaataggatttcagtaggtagagatgtgtgaaaaggcatttgggacagttacaagtttgtgaacagtgatttggatcatgttcagggaagcagagagtcattcttttaaatggaaacctatggtaccagcagggaagagataacagaaaagattaccaaaaaaaaaaaaaaaaaaaactgggaccatcctctagaaggccttaaatatgctgagtattaagttttgtttgttttgttttaggaagattagtatggtaatgtgaccacccaacaagttcttcctgccccactgcacaaataaagaccacggcattgcggtaaagaaagagtttaattgacgtgaggctggccatgccatacaggagaccaagttactactcatatcaatctcctggaagacttgtaggttaggggtttttcaaaggcagtttggggaagggggtgggtgtggctaaaatggatgcttgctgctgattggctggggcagagatgaaatcatagtgggttgaagctgtcctcttgagctgacttacttctgggtggggcaacagaagcaagagcaaggttggtgggggccaggtggagtcatgggtatcagacctgcaaaaaacctgggaaaatgtctcaaaaggccagtctacaatagtgatgttatctgtaggacagatcttgtgaccagtctatgccttagcagaattcctgcccttctcctagcctgatggcctttcattagctttacaaaggtgattgaattttggggaaagcctattatcatgtaaactataaactaaagttagcttagcctaagaccaggaatgattaagggaaaggcaagatggggggttaaatcagacttgcactgccgtaattttctcactgttataattcttgcaaagtcagttttagtacctctgtgagacatgtcatgccaaggaaagagcagaagttgggaagaagaatttgaaggtcattgcagaaacttatcctgagtcatttaactaggtggtggtagcagaaatggaaagaagaaactatatgggagggagatggtagggaaataacctacagggctgatggattaatgggttttatgtattgtgtactttcaaaacactaagcattaatcaaaaaatagaattctttaatttcctaattccttaaatactagacctttatttacatatacatttaagcctcatatcaaccaaataaataggtcagcctttatccccattttcatataagcaaacagatttagagctcttgaataattagctgaggccatattgctagcaatctgctaagtgggactctgaacccaggatgtctggctctattgctcatgttcttaactacacgcagctcttctctaattgaagtatagagggaaaaggatgagtgtgagaaaacaaggaagtttcaaccctggtggattgagaggtgttccagttatgcattggtacataatagactacccaagacctagtggcttaatacaacaaccattttgttgcagtccgtgattttgtctattagaaacttggacaggcttggctggagaagtctattatacaagacatggacaaaggacactcagtgccattcagctggcagatgggctagtctagaaggagcaagatagcttcattcccaggtctggcaccttggtggggatgactgaaagtctgggttcagctggaatgaaaaccagagccctgcatgtggcatcttcagcaactgggtctcaggcagtcagtggattatttttgcctgttttgggactttatgtaaatgaaatcatatggtgtgtattggtttctttgactcaatattatggttgtgaaagtcatccatgttgttacatgcagttgtacttcattttcattgcagtattctatcacattatgtaaatatactacattttaattattcattctactactaatggacatttgggtcattcccagtttgagctttaatgaatagggctggtatgaatactcttgtattcatactcttgtatattgggtgaaatatattcgcatttctgtggagttatattcctagcagtagaattgctgagttgcaggatatgcttctgttagctttaactattttctatactgtttttacaaatttgcactcttgccagcagtgtatgagaatttcagttgttccacatccactgttaatatcagaccttgttaattttagccattttagcttttctgacgcgactgttttgatgtagattgaccccaaatcagagtgagggcgtctctctcccactgcatcattctctgcttaactaactctctatgccttcccaagagattatgaaagacgcctgtctgattcttccatttaagtattttcttatcttatagaaatacgtgggatatttctcttaaaattctactgaagctttgaaagaaatggttcaaatggaccttacattcaaataacctctcctgatatttaatcagtgctctttccacatctttcagccaaataacattcacttgcctttgctgtatatgttcttatgtagaaataatagtctcaacatccatcacagtgcattacatgtgggaaatatacttccaggtgaaaacttgttgaattttggatattttgaggattttcagatttagttcaacctcatccaatatgtttcctttctaagtaacagacttaagagtaaatttgggctcagctgccaggaagtgaaagagaaaatgatctgtacatgcagatatggatgtagcagaagatgttttcctaaatcgcaaaatcaaaagaacgatgtctacacaggactcagaggaatgaatgctttgaagtaatttagcaatgtgggaatggtcaaacattttcttctgtaaaatctcctgctctctgccctttcattttttttccgttctcattctttttcttcccaggtctgtgataaggctagataacataaggaagtcacttggcaccgtgtccagcccatagtgcttccggtcctgcttttgatgatgacgatagaggagatagtagtatctccttctttaagatattttcaagtatgaaagtaactgagttagtgtatatgaagtatcttctagaaagtttgacatatagtgatcttcagagcagatgcagaggaagccagacaagagggataaataaagcaggcaagatgatatcgcaagagataagacaaaacttctgtgctctctgcatttgcctttccaagaagctggtagtttaactttccttgggctttctgcaaaaatgttgtgcatctgaacttgagcaattttgagtgtttctcttccttgcaaacaaatgagccttgacttgagcagtccctttagtaggcatgtcatacattatagtagtttttgtgaccctctcatctctccaactggattataaaatcctcaagggcagagatgtctctaatatgtctttgtattctgcctcgtacttagcacaggacgggagaaatgtcatgttatcctgctgattaagtccattaaggattcaggttgcataactctcctaatggggaatggagaataaattctgcaagtgagtttaatgttcacgaaaatcatcaacagcaaatgtagatgcatgccctttggccgtgcacaaaatgcaagggagagggtggtcttttcctaactctttgtgaattaccctcgctaagttctcacctcaggggcagaatgcaatttgttttttctcttatagattttttctcagccttggtgtgaagcctccaactgagttggaagatccaaactgggacagggaatttaaagaggggaccacaaaatcgattccaacagaactttaagtttaccccaggttagcttcatctgttgcacacagaggcatctgcttaacagatcattgtagatatgattgcaaattccacataaagggaatatttataggaaggtctgcctttctgaatacgtaactaaaaattagtttgttttgtaaaactgtactttaggccaaactctgattcactgtattaagagtcccaaactaaccaaatgagagggacatactagcaaagacatcttcatccacatgcgggagggaagagggatactgccaagttcttgcagaaggacagcacggtctctttcagctccttaaatatgttctgatgaggcacttcagtaaaacatgcccatctgcgtgttccactggactaatgaatatgaagtgtatgttcagctattgatctgaattaagtcctaggaccagaatttagtgtcattaatgatctctttaatgaacgcaggcagaaaccattatcaaatgatgattttttttttcatcttggaaagattattttaaatccaaacacattctttcaactctgttttaaccccccagagatatattttaaaagccattgtgagaaagtaaatgagaacattgtccaaagcctgggagtgaagcatttggtaggaactggaggtggggagaaggaatgttaaattcctctttcttgaaccattacagtactttttccttatttggtgcatgtctggagggacagggcttgggcaggggaatgccccttctactctgctgacaaaaagcaccaagagtggctggaaaaggctgtagagcactggtttccagattttgttgcaccttggaaccacttggagagctttaaaaaacactgatgtccagctcttacctgcagacattttgatttcactggtctagagggtgatctggacatggggattttgaaaacagtcagctgggcatggtggctcacgcctgtaatcccagcactttgggaggctgaggcaggtggattgcctgaagtcaggagttcgagaccagcctggccaacatagtgaaaccccgtctctactaaaaatacaaaaagttagctgggtgtagtgacgggtgcctgtaatcctagctactagggaggccgaggcaggagaatcacttgagcctgggaggtggaggttgcactgagctgagatcgtgccattgcactccagcctgggcaacaaaatgaaatttgagcttgagcgagtttgagcgaaactcttactcaaaaaaaaaataaataaataaaaataaaaataaagaataaaaataaaataaataaaaagagtcttggcttattctgaagacagtcttttaaagtggccaaatgaaaaataaatgactgtgtcaattcagtttattgtaaacatttactgagcacatactctgtataaagccatatgctatgctttagtaatgcaaacaaaatgtaaaatatatacctacccctgaggagctcacaagtttagcggcgaggggggccagttacatggacagataaatgcaatgaaattacaactcagttaaatacaaaacattgtgatatatacaaaatcaaaaattgtcccaaagtagtgcaaagtacagaaaaagagacaggaccaggaaataccttacagtgtaatttccagatataaaataacaaatgatcagtatttctgaaactttgagggccagaggaagaatgggttgtagcaaagaactctatcataagggattttctatgttgtaataacatgaggtttcataggaataaccagcatcttagaatggggtctgtcttagtaatagtctaatgtaaaacaacacgattatttatttatcttgcctgcctactttccgttctccttccttccctcctcccctgctgtcctcctttcctccctccttccctcctctccttcttccctctctcttttcctccttccttttctactctcttcctcccttccatccttctttcgttcccttctttctcccttcctccccttctttcttccttcctcccctccttccctctttccttccttctatctgttcatctccccatgttatacctacctacctacttcctacagaggcacctacaactttgcctttcattgtttaactgagttatagattgtgaagactagagtgacttaaccacccaccctcctttcaactgtgtggtttattacacatatgtatctcattgatgttttttgtggacattgcacttgtgtaatttattcttttctcatttgggtaaatatgaatgcattgaaataaagaggactagttttttttttatttcaaaattatatttaaaaggaaaaaataatgagacaacagcaagagtcactatttaactcaatttgctgtattcttaaaactggaccttacagtaagcactataagtaagaaaacagctactttccaatggagatataaataacaatgccagatgagctgttgctcttaaatcttacagtgggacttcattagtgtgacaagtgagaagtaacaaatttattcccagaaccagaaaatgccattcaggataagtgttttgattaattcatttttagagaggtagggctgttttaatcatgacaactcttatttgccataatagaagcatccgtgaattttttttttttctgaacacttcatgtgtatttaccattccactgtcatgatctggttattactaggactgggttgctattaataatcaacacattattttaaaattgaacaagctaatatcaccagcctgtaattttctgggtttacacattgaatctattaccataattaagttaatagtattttaaatgaatgtttattttttatggctttgtgtagcaaactacaattagatgtttgtctgcatacacatgttttaggagtgttcactctgtaaatggttttgtatgaatctattgtaagaaaaagttcaacctcttttgcatctccgatgagttagaattaagtgatactgctcctgtcaattcatttttttaaactcaaaagtttcactttatctgtttatgcctctttagtttgtctgtataccatgaacacatatccttcatctttccccaccttagtatccactaggttttttcctctctggttgcctatcattagtcaattgtttttcatgctaatcaaagagcagagaaaacaaacgatgagcatacaggtaaaatgacattcatgggtttcttagttctttggacactcagagaagagaataaaatagcagtttgaatcatttgtggttctgctgtatctgtaatccacccatttgacataatgtattattggagtggctaattggaagttcatagggtgtgtttccatatgcttattataaagaacagatgtaagagtcaatttcctgtttgaatggtgatttgagcactgagcaatttatttaatcagaaatgtctttattattcataaaactgttccagtctgatcccatgtgtttgtttcaattctgaatgtgactctctacccagggctgataaactctgttgttcacattaggatgttaaacagaaaaggtcacgcatctgatcccatgtggcctaattagtgtcaaacaaagaaaatgtctgtaaattgttataggctgcagtaccagaaacccacgttacttaccttatggggattaaaattgccacaaactctgtgccagaccatccccatggctgtggcaatggtactaaagccacattccattggtggtagagatggcagccaggagtaatgtgtcggatattgtcagttatcgctcagcatccattttcacctttttcaatgtgtcgtactgtgccacaggggcttgagggttaaaaatcaactttcctgactcctttgcagctagggttctagatgtaaatgatgttctgacaattagatgcacttgaatgagatttgaataaagttaaggcaaaggccatcttcttgctgctatttttgttggtgaagatggctgcagaaatgagtattttcaggtgtctgtggctgtcagacttggccttgtaagtgtctagaagcagttgtggcagcaacagcaatgccttcctgacctctgcttgcagcagctatagttttatgtccctgtactaatttgttcagagtgaggctcctgactcctgatctaccatgctgtctaggaattttgcagccagctaagctactgcattcaatcccattctacatgaaataccaggtttctgtttcctgcagtcaactttgactgatatgaaaatagtcataaccacataaatgaagagttatagtttactgagtatctattaaatgccagacaaattgaggatcagtgagataacttgtacaagttcataaagctaacgaatggcaaaaccagtgtttgagtttcggtccatctgtttgcaaagctagtacacaaagggcagaaactgtaatatgtccatttctattttcaatttttaaaaagaatgaaatcatgtcctctgcagcaacatggatgcagtcagaagccattattctaggcaaattagaacaggaatagaaagccaaatactgtatgttctctcctataagtgggagctaaacattgggtactcttggacataaagatgcaacaatagacattgaggctactagagggtgggtggagggagggaggggagcgagggttaaaaaactattgggtactgtgctcacaattgatgggaccactcataccctaagcctcagcatcctgcaatatacacatgtaacaaacctgtgcctgtgcctcctgattctaaaatagaagttgaaattattttttaaaaccccacattttagaaatccccaagggcagctgggcacggtggctcacacctgtaatcccagcgctttgggaggccgaggcaggcggatcacctgaagtcaggagtttgagaccagcctggccaacatggcaaaaccccatctcttctaaaaatacaaaaattagctgggcgtggtggtgcatgcttgtaatcccagctggtcagcaggctgaggcaggagaactgttcgagcccaaaaggcggaggttgcagtgagctgagattgtgccactgcactccatccagcctgggcgacagagcgaggctccctctcaaaagaaaaaaaaaaaaaaaagaaagaaaagaaaagaaaaaagaaaaggaaaaagaggaaaaaaaaaagaaatcccctagggctagggatatttggaaatccccaagggtttgtggttttctaaatttctattcaacattttagaaatccctaagggaaggagacttttgtatcctcaagtgcttgaggtctataacatcactgacaaaagaacacattctagaagaaccagatagaatatgtgcacccttgagactggaatagctgcatcattgaagcaagtccatatcagcttccacctccatggtaatacttgggatgcatagatgtagaatctagtctcagaagacaatgtgattctttagcccattcaatttgttcatccattattttttgtatgcatcatctcaaccctatagggggcagttaatgggttcggtttcatgtttcagatccccttgaccttgtttgtatgtatatcacagtgtttatatagtcagatctttcagggactgaagcaagccccgaaaagacaaagtgcatcattagctgggtttttcaggatttcgtggccagtgtaaaacaaaagtgggagagtgatagggcagaaagtgctctattatttctgttgtcaacaaagactcagttacctggactgagagcactgcccttcccagcctgcaggaagactcaacgccggggtcctatgatgcacaagtgagagaagggggatgttttgcctgagaaggtatgactctgggggccaagcaggaggggatgagctgtcacatgggagagatgcaggctaagaactaaaactaatgaatggaagttacagagaggtaagaaatttttttccaagaactgcctgggacaaacacagctactccaggaagccacttcactgctgaaggtgttttgtgcaaaggtgtgctggcagttaaagaggaatgctgcagataagattcagctccataaaagagtgtgaagatgtctctcatccctgaagtttataggatgctccccacaaagaactgcagatttcctttctaactcattgactggagctcagggacaccatgggttgaagctatggctctggagggaactagcctagacttacatcctggtcctgatatttacttgctgtattaattctgcacttcagtttctccgtctgtaaaacaggggaaagaacagtgtctctctcataggggtaagtgtgaaatcaaatcattcaacccatgtaaagtgaattgagcttcttattcctattggctatgtggtgattgacatcggagctcccaaacagttcaatgggagaaggttgcaaatgaattctgcactcagatgctcactcaaatgtcttgagaactaggagaacccaggggaccctgtgacaaattttcaacaccatttggtccagccaaagggttgtttcagactggctttctcagtgcttgagagagaatctaaatatttctcaaggcatgcattacaaaatgttcaagtagctgctctatttttgagaacatgcacataagacaggcccacaacattgggggatgttcgagaaaagaagggagaccgtgagcccaggtccaattagggatcagcaccttctgtgtccccgatctttacatggataatgaaggactggggagccgcggttgtgggctgataccatggcaacccctcttccatgattgtcacatacagatgagtgagtttttaatctcaacatcagtcctgaatctcattcattatttttaagccctaaaccagaaaataaatattgcttgtctttctgcctttgcctaataagtaactaaagtttacataaagacttggcttactttggttgtttctctgttgggtgtgtgatgtccaaatttaattaaaggccatgctgtcggctataaactcctttagtgagagaaaatgacaggaaggcccagaatttttttttacgaggcttgtgttgattgagttaaagcatgtgttctaactgagctcccttggaatgagccgtgcattgttccatgccacctggctgcaaaacaaacacaaggaatttggctctgacatgaagaaaccctcagtattagggaaatggagctgcattccacatggaagcatggcaacctcgggctctgttcctccccctttgccctctcaccagacccctgtgcatctctgttctttccaggagagggagaaataaaaaatatctcaatagaaatggaaaccagtgttgggtttttttgttttgttttgtttttctagcagggtacaccactcactcaaccataccaaatataagtgtgcgaggcttggaatgaagaaagaaatggttactttttaaaagctagcaatattaacaggtgaatgtcataggccatgagtctgaatgtgtcagaaaagaactgcaagtcattagacaagaccaatagtcctcctggagggaggcagtgaacctcaggactgtgggcactggcctgcctttgtcttgggtattgacttgctgagtggcctctaggaacttaattaagttcctggattcctcttttgacaaatccagattacaaacaataaccaccatggccagtgctcttgaattcatatgatagtagagcattataaaatcagaattctacttaagagctgataattatgtaggagagaagagcatgctgactggggcaaaggggccaggtggttaacttttcacggttcaagagttgataaaaagcatatgaattacaggccagtgagaaggacatttttatgattatttggaaatttttgactccatccggaacagagttgaaatattcaggtccgcagggtgtgagtagacagttggcttatgatctcagcagtcaggatgtgtcatttctgtttcctaaaaggctcccgataaatgctttctggaaggtgccagtgaaagacatttggaatttaacagagacagcaacagcaggttcggggcttatctcgggctgcattgtagatcaatcctgggcacagtggaaggaacactgttacaaaagagccatttctaagaaggcttcacttcaaaggagatcacccacagcagaggagctgatgcagagctgaataaataatgaaaaatacaataaagatcaaatctgatagggatttgaattatatgccaggaaaatatttttgatgaaaatgaaatggtagggagggttagagacagattgaagaattcataatcagaactgctcacgacctgcatcgcttagtcctgtacaattttgaggctccatgagaaggcagttagtgaaaaatatatcagtcttttctctgaaattcgaggtcatccttatcttgagactgcccgggagttcctactccctactctcctcagcccccactgtagtgcaggaaaactctggccctgatggagccatttgcaaagatgttacggaagaagctgctgtggccacccctgcagagccaggcacagatctaggacttcaaggcagatagttcctgttcatagtagaccagccagagccagcttttgggtatctctccagccctgaagtatctctccatcaccaatgatgggtatctctccatcagcagtgatccccaagaggtgatgtccttcctggccttcagccatgtttgttcagtgggacctcaagcctctttcctaccactgatgggtttgggatatagaccatgagaaaagagagtggggggaaagagaaaaggaaagaaacaaagagaagaagagaaggaggaaggggagaggaaagagagaggagagagatgtaggagaaaggagagaaaaaggacagggagagaaggagagaaagagagagaggcagaaaaggagagagaggggatgagagaaagaaggagaaagaaagagggggtgagagagaaggagagagaaaggggatgatagagagaaggagagagaaaaggggtgagagaagaagagagaaagggggcgtgagagaaggtgagagaaaaaaggagataaaaggatagagggagagagaaaaggggatagagagggagaaatgataaaagagagaaaaagagatgtgaggaagggagagagaaaaacaggaaaagagaaaaagatggtgagggagaacacatgctagaataaggcagatacagatgaaatgagaaatagtgaaagagtgagacagtgagggggaaataaaggaaaaggagagaggatagagagagaagtggatagcgagagagagagagatggtgatggagactgagacaaagacggtgagacccaggtacagacgcagagtgacaagagttgggaagaggccagagggggccaaacgtgatgcttgggtggcctctctgctcttgagaggatattggcagtgtctccagccctgtgcacatgtcccactgccatagcaaatccagaggctccgctctgctgtggttctatctgccgttacacaaactatgaggcagccctgcccatgcagagaacatagtcatgtggcctttcttgttttatcatcccttcactctttcttacaggctctcccccatcctcagcttctgtttgaaggacctgcaaattattcttgaaggacagatgtgatgctgtgctgggaactgctcttctcctcaaactctggcctgtttccttttcatgaagcctgggagcctctattctccctttttatgatggttctttttcaggaggtttctgagtcccaccagcaaacagacccgggtgggctatcctgccaggctgacagtgagacagagatggacccacaagggcccctgctgcctcgtctgccatcccacagcttacccgccagctgggcttattggaagctttcctttaaatttcactgtctcacattccagaccttcctcatttccttgggccagtgggctcaatgccctggtagctgggctgtctccctcttacatatgcacattattttacaaagaagcaatctagccagagcaggtatattgaaaatagagtttattggagttgctgattgtggatgcttgcagagggctctttcttatttttctaaaagttgcattgcttcagttgcgaatcaaggtcccttgatcaccatgcctcctcttgcctcatgctcagtttttcttattcttttcttctctttcatccaactgctttctccagacttcaactcttatatctaagcactttgggcctttggtgctgttttgaggcagactaactagagtagaattcactggcattaaaacagtagatccagcaaagtctggtggaaataaatagtgtagattagtggaaggaatatgaggaattggtaaaagattcatgcctctatggaggacatgctttgctgaatttctggagaatccgtggtcttctctagaattgtgtgtctttcatcatcacccagagagacaagcttttttgctcttcatggaatctggtatataatgcaacagagctccattattagtggagaagatgtacagacaaaaataaaaacaggggcagcgtgcattttggtagggtcttctatttcatcctaacacacaagcgtcttacacctctttgccttttcccaaaaggcatatatgttttagaggcaattccagtgagtaaattattcatctgaagacaaggaagatatagaatagttagagttttattataatttttttatactgcaagggagatttttctttgtctcctaaccaaaaatagcccagctattgccaaatgaaaatttcttccacatatccttctcttgccaaaacccttaataaaattttgtttaaaaaatcagtgtgaaccatgaaacagtaaaactcattctaatgtatgaaaacatgtatatactgcaaagtcttcttcttttccaagtggcctgaaggtggctttgctgcaaacagtgccttttgggcataagaagccctaagaatccagagacagttgagaaaacctattttctttcctgtctactcagtatttggggaagacaaaaaatgagaacataaagaaaggcaagctccccaagcttacaaaagattccatctctggtgatcctgtgagccacaaaataatagaagttttgaaatcagtgtagctcatttctagacaatggaggggattgtggcaatagttcagcatctgtcctcggttatttctgaaaggatagatagtatcgtagaaaaacaatccatacaggaacgcttgaacaaacaattacaagcatcataaagcaagcaggtctggaatcgatcccagcaaccatttcccattctcactcttctttaactttgcctgttaggtggttttcgaattcaaccttctgtgagtgtttttaatggtacactatcaattaccccaggtaaggaatgtctatgcccggttctctctcaataaagcaaaatatcacatcattaagtagttttcctctctgatttgtggttagagtaacctaaagagggagggaagtagggaactgtgtacctgtcatgaacacacacacacacacacacacacacacacacacacacacacacgtgtgcatgcaagaaaaacaaacaaaaataatacataaataaaaataatcttttctttgctagaacatttctccctggagtaactgctgaggagaatctctatcctgtcttctgtgtgtgtttgtgtgtgtgtatgtgtgtgtgtatgtgtgcacactctgctctgccttcacgttcctctctgagcacactgtacgtctcctgccacatgcatacacacgggacattctgtctggactcatgggacaagattacttgcatgccaactcactgcctcaggagacttcctgtttatattcaaccacgcatgggcccttataaagtcataattcttgccaccaattgaacatcttgttggaatatttatccactttgctttagctggaaaacaagtttttccatattgcaagaaataagtgcagtaacttgatggtgtttaattgcactaattttggatttgggggtgacctggattatacagatcctacttccatgatgtatatttatgggtacctcttccaccagctgttcaacgttctctacaacctgacctgcttacatgttaatctcaccttctaccctcaaccttgttccccatgctgtagcctggaaggcttatttggataccatactaatcatcttcccacttcagcatcctccaacttaccctcttcgtcacctggactgttcttccttcaaaatctgtatctgactcatttcttatcattctgatgtcattgaaatgtcatttccttaaagagactttctttgaccactataatgtcctctccttcattctactttcaacagcataaccccatttaattttcttctatcagatttcagtctctgtcagattgacttatgtcattgcacgtttgtcatcagtctcttttatggaatatggtttgtttgtggtctgagccttatagtcttattcacctgtgtgttctcaatgccaaggagaaggtttgaaacagagtagatatgataaatatttaatgaatgaatgaatttataaatacacaaaaccaaatcgtgtgctaaccactttatcaagctaaacttgataaatcactacaaaaatcttattggggaggtaccattattatatttgccttgttagaacttaggtttggctgcatgtgacagaaaatctcaaagtagaggcttaaaattagatggacatttatgtttcattcatataaaagcattttgggtgttccagatgtcatctgctctaccatcctcacggtcttaagatggccactaggggtccagccatcacttctgtttctagacaagaggatggaggtgggaataaaaaaggataatgcctctctccctttaagttccatgatagtcctcgcaatgtgtctcattggccattatttagacatataccatacctacttataagctggaaaacataactcagggcaggaatgtgcttacccaaaacaaaaacaagatcttgttcctaagaaggaaaggaaccagccctctacactgcatccccattgactctcacagagagaaagtgactctggcaaagtcacacagctaatatagcatacagtgctgagatagaaaccctaacatcgttacatccccaccacctccagcatctaaacctcccccacttacccagtaatatagtacacagagaatcatccctctctgcagggatctttggtagactgtggagccaaggttgaagcttctttcttcatagtccccaaatccagggagaatcctagtaattgtcagatgggcctgcatagagtctgcattcacccttcccctcctcagcctcactcagcaacctctttccttctgttttcttacataaattctcttttgtcttaacagtactaatgacaataatacttctttctatcgagaatttacttctattcactatgcactctatggttttatttttataagaattagtttatacagttctcacaagcagctaaatgaggttaagtaattatttaactcatttgaaagatgggtgatctatcagacctaaagaggttaagtaattttttatttttttgacatgaagtttcactcatgttgcctaggctggagtacaatggcacggtctcggctcagtgcaacctccgcctcccaggctcaagtgattctcttgcctcagcctcccaagtagctgggattacagttgcccaccactatgcctggctaatttttgtatttttagtagagacggagtttcaccatgttggtgaggctggtctcgaacccctgacctaggtgatccacctgcctcagcctcccaaagtgttgggattacaggcgtgagctaccacgcccagcctaagtaatttttttcaagtaaatccagaatttgactccaaagttcaccttacaagccttctccaattcaaacaccaccttgcctttaatgtcttcatcaccatgtttaaagcacattctcgtgactcaaaataaatgattgtctctgagctgaaggggaatgatgtcttattttacctgaaccacagatcagttgctgcaccggaatggtggacagttgcctcctcctagcgtgaaattacagtcaatgacccagaggcaagagggtccccatatcatcacagagccctgagactctcaatctctgtagggatgaatgtggaatttttctgttgcttctgtgtttccgtaactgtttacatactgtgtcatgttaatgcattctgccataccatttttctccaattatctgagcttttgcaggaactctgaggtagtgagacatacattgaagatgttccaaagaaatgaatggaggagttttctctgcaaatcctttttctctgaaaaactcggaaaagctcactgcctcatcttgcatgtgagcactccactctgaattctgaaaagcagcaaaagagaaaacagaatctggcagaggagagatgaatattacagaaattgtattttaaaagatattgttatcggggtaaaataggtgggaagaaacctcatgagttccctaagaaaatatctttcaaaagttaaaaagatactcttacttatagtaagtaagctggaaccaatacagcaaggctgtgtaaatatataatatgtggtattaaggacaggctgaatgcatggctaggcctttatttttaagaaatgtgtatttaatgcattgcacttgctccttcagctttgttacactctgttggattaagaggtaacttagcaggcaagctaatttgaaatcacatacacatgcgatataaatggtagacatggctttcagaagtattatttgctgttcacaaatccatattatgcaaatatcaaaagaatgactggtattctcttgtagtcaacattttttaaattgtactggttccacactgcctcaacagctcctgcttctttttctcggggtttcttttgtgattcacagtggactgtctcactgttctgagctgataggatcctattattatttacttcttcctttcaacacacccctgaggcagttcaaaggtgaattcaccattattaggtattaattcacagcaaaaacacaggcttatcatttttaaaatctgttgtcaggactcacactggttttacaatatcaccttgtcacaacaagaactaaaccttctgatgagccccaagcctgaatttctcaccatcataaatagtatggggacatatttaacatttattgatagagaatggctaaaatgtattaaggtggaaatttgtgctgaaaagtcttcgtattttagttcctttaatccttaaaacaatcttgggagctacgtgttattttatgactcctattttacaaaaagtcaactgaggcttggagaaattctctggttaaggttacatagtgatatggttaggctttgtgtctccacccaaatctcatcttgaattgtaatccccataatccatatagtccgcacgtatcgagggagagaccaggtggaggtaattggatcatgggggcagttcccccatgcttttatgatagtgagtgtgttctcatgagatctgatggttttagaaggggctcttctcccttcgattggcacttctctttcctgcagccttgtgaaaaaggtgccttgcttctccttcgccgtccaccatgattgttaagtttcatgaggcctccccagccatgctgaactgtgagtcagttaaacctctttcctttgtaaattactcagtgtcaggcagttctttacagtagcgtgaaaacggactaatacacacagcacagacatagtgcagccttatttggaacccagactgtttggctccagaatccatactgtgtgtccttcacctgaccatattgcatctcattctgtggtatcgtttacttaatcatttattcattcacccattactttttccaccataaaagttctaaatgaatgcgtactctttgccaaatgcaatacagaacagtcggtgagaatataggaaaagggaagtagcagcgatgctatggaatcttagagttctcctctcccagcctgggagtacaaatgtcatagaattatttatggaagagttgtcagctaagtagacaccaaaaggttaaggagaaattacctagatagactgggaagaagaaatgacaggtggaagaaacagcctgggcaaaagcacaggggcaggaaacaaagatggtatgtatgaagagttacaaacagcttggttctattacggcataaacatgagacaagagaggaagtcatagagttagcaaagggctgaaggatctgccatgctaaggagtcagcaatccccacattaggatgcacaaaatgatccactgagacacaagaagaaaatattaaagtttgtctttatatttctctttgatactgttttttctttccgtttttggtaaagctttaaaatatgtatagcatacaaatgcaataacagaggaaatataattcttgtgggaaaagtatgtgctaaaattattttactgatagggtctggatgaatataagtttgcaggtcactaccgtaagtaatggagagacaatagatgatttttttttttttttgagatggagtcttgctctgtcacccaggcgagagtgcagtggtgcaatcttggctcactgcaacctcagcctcccaggttcaagtgattctcctgcctcagtctcccaagtagctggaactacaggcgtgcaccaccgcatcggctaatttttgtatttttagtagagatggggtctcaccatgttggccaggctgttctcaaactcctgacctcaagtaatctgcccgccttggcctcctaacccaaagtgctgggattacaggcatgagccactgtgcccagaggacaacagacaattttaactgaaggctttcttggcgtatgcatgtgtctatagattgttctcaaaacactgtaatggatgacggcagaggtgtaacactcagggagggaagtgcactgaggagattgctgccaccagggaatttaatgttgatgaagatagaagccaaggctgtggaaataagagaaagtaatagattaaaataatttttaggtggttaacttaatagggctggtgatagattggccatgatatttaagaagcatcatctcactctacatgagctccagccacaagccttcttgctatcacttgaataagtccaatacaggactccacaggaccttgggcctcctttttctgctcctggaatgctttccttcatctttgcctggctggcctcctcatttatttctcatctctgtggcaatgtccattcttatcattgtggccttccctgaccatgttatacaattcctcaatacttcctatcaaccttagtgagctccatggcatacacatctgagaaattctgaaatcacttctttgttgtataatagtgtaacattagggactttgtcatttgtgttcattgctctttctcacgcgacagtgtttgacacataaaatgtgctcattaaataaaggagcaaatagatacatagatgaacaggtagatggatgggtggatggatggtggatggatggatggatggatggatggatgggtgaaagagtgactcttattaaacttatcccttaatgagaccattagagagatggaatgtttccactgagagatgagaaaaaggatgtcctaaacagattagaaacttgtctaaatttatcctatctgttaaaactctttacttagtctataaagaggaaaccaaataaaaatggcttatgtaatagaggaaatttattgactcaggtcactggatagtccagaagtagaacagcctcagaatagcttgttttagaagctgaagaatgtatctggaactggatctgtttctttctttctttgcttttttcttttctcctcccctccccttccctccccttccctcccctcccctccccttccctcccctcccctcccttcccttcccttcctctttctttcttttctttctttctctctttctctttctccttctttttcctttcttctttctttccttctttctttctttctttctttctttctttctttctttcttctttttcagtgttcaaacattttattaaatcggatagcattgttatttccacattgttgcacatactgacttgtattcaattataagagtatagcacatgtttacaaaggtatggctgagcagtcagttggtaagtttaaaatttcaagagcgctccaagagcaaacacagtaaagaccatgcaagttccagagtcgtgaattatgacagagctcactcattttattccttgcctgcagttgttccaaatctcatagcctcaactctcactgtccagacacagagaaaacatctgtttccaaaatcccattgaaagtcctaagctttgccttacttggggccacttctgagtgactcacagaagtcattaggttgctatgtggcaattagtttaggcctgcgatttcttaaccaatctctgtgtcaagaaagatagtaccactctgattggcttagacaaattagggtctactttttgaggaggggatctttggggaggaagccacaatgtcctttataggcttggaaaaaaatctgggtgtgtattattgcaaagccatttaagactgtgtgtttctttatcaagaatgctttccataacccaaagatgtcacatatacaaaatttgagcagaagatttgcttctaaaatagtttcatatcttttgtaattcttaattatggtatacataaatagacttacttcttccccattggatgctatgaaacatacccatgactatttaaaaataataattcactattaaatttagataacaaatgttaatattgtaagacaatagcttcccttaaattctagttctctctgcttacttgatgtgactatcagtagataaagggtcatgatttggatctggggaaggacttgctgcttctggtttgtataaaggaattaagtagggaatgtgtaggaaatctggctgggctcagcaatgccagctttaatggaatccaaacaggttttcttaaaaataaatggtcatgagaaagctgaacgtcaacctcctttcctgttgataaatgacaatgtataccagattgtatcaacagttccgtggagcaggacacccctctgcttttgagtctctgaaaaaaaattatgctgctttccagcaactgatctcctttttctccatactaccgcctttctttgtcatttctctcacacttttgttatcttctttaattgcagtatattctttcgcttggcaaacacacatacagcaaagtcaatccaaagtgcttctgatttgagcaagttccttgctctaggctcacctgaaaatgaccatctgtgttcaggtcatagaacttataaatatacatttaattttttttctgttttccactcactttttataaaataaaggaaaacaaatttcacagtgttgtctaaagactgttcagcagttctgttcatgatactgcctatctgcaccactgatgttggatagcacaatttttttttgtttttcaatgaattaaaatacaacctagtatgcaaaagatgctaaaataggagaaacaaggcatataacatgtgaaacctgagaaccccttgcgcttgccattccacaccttttcagaagactgaaaactctacattattgaccatgttggtgtcatcagcacacctgacaatgatcttcttatccttatggaactggacatcctagcctttctatctgctcttggcataatctcttctcttagagggtactgtttattactttttgaaattgaagtgaatacaaattatttttgcttggagaatatctttgagaacttcatgacaccctttgaaaatttgaaaatggttgggtttttggtttgttccagaggccatatttggtaaacaccaacttctgaggcaaacaacatttctgcacagctggccccagaggcggtccttgtgccaaatccacccatgcaatggttgatgccaaagagttcagaaacacaaatccaatttaattctggctcaaaaaagcaataagtgtttaaattggatttctgtggagtttgttcttattaagcacagcacgcaaactgctttataggcatttattatttagttatttctaacaaaggatcttatagatccagcatctataattaatcgggaatgagagtagatgctagccaacatatgctctgtgacccagaacttgcactaggaaagctatcaggtttgtaccaaacaccagggtcgttggcaaaagtttgcttcattaaattcggctttgtgggttttatgcttttaatccaggctctcagctctgtctgtcagccttacctgtatcatattaaacttaacagggtcaatatgatgcaaagaggtggcacctggaaagtggtgtatcagtgactccgctttcaatccaatcatcctcccattatgtcttgtcatctttcaactccagtggtcctgaggcttcttccaggcacctccactcgagattattcctggatatgtgctcacccccatgtggcccatgctccataatgatgggtcccatctcgatctctataaatttccttttctgttgaagcactaatgaaaagataatttcataaatggttatgggaatggcttacttggttctcggttgctttttatcttttcctaattactttgcattttagtaagagccttccagaaacagagcctaaataaaccagggttgtaatggtggagatggcagccccatgaagctaatgagatagttggagtcagacttattgcgtggccatgggaggtctggctctgcttacctacattttatacttggcccagaaccttgctcacagcatttgataagcaacccattgttctgattcctagacactgatgtcagaaacaagcactcacctgctagtgttgatcacatactccatgattatttatcaaaaaaggccttttctttatgagactgttgttcagtaggccctttatagtcacaaaggataattctcataagctttaataaattccaaatatgagtttagaaatgttagtgctagttctggcttttcttggtttctatttccaatgagagtcatgtgctttcaatgcatatattcacattacaagttaattcttttcatctttcacactaagcttttgtattttgtttagtgtattttttttatttcacaggagaacagaaaagtttactttgccacagtcagtaatatagaaaagatcgaaaagagaataaagaaagtgttctaagaagtggctgctgtgtggatgactaggttcactaactagctgggtgacttatttctatgtcagccttgcagtggacactattaacatttgggcatctgcaaaattataccttactacatcatggattttcagattaataatcaagatgtaaactcataagtgctaaaagtgtgaatgccacaagtctattttattgactttgacttttgtggtttcctagctctttttttttttacatagttgccttgagtaattcatctactccctttctgccctagttttctcattcataaaataagtataacagtacatacaaatgctgtcttccacagggttggttgttatgggaattaaatatgttaatatgagtaaaatgcatagaaaaatgcacagaagtcttactgttgtaacactaaagctacaactaatattactgctataattattgcattattgttaattggcctgataattgcattatctcattttgtataatgttgggcgaggaattcattcaagtaggaaagatctaaaagataatacattagaaaagacaaaagtaaaacaagtacaaatttctaatttctcctctaggccctacacactcttcaaatcctaaacttttggacttctatctcttacacctaaagtgaaccttctagaggtaattgccatctgcatagttagacatgtccaaaacagattagcactctctttatttgtgcacataaattgctatgtcttttattcaataaataatttttggtcacttattcatgacatcgtggatgatacaaagatgagaagcacatgatttctattatcagagagaaagaagaaaaatatatggacatgtgactaaagtcaaacgtgccatgtcaacaagtatgggcagaatcagctgtcgtgcagtagatgaatattttggctatatgcaagatcagtggagcatcaatcactcagtctgaatgtgcagcaattagattcagttaggttaatctgttactggattccaccattccaacatctggttggctcagtcataaaagtgtttattatctccgtaagtcagtctaaactcatagtaggctgccacttggagcttctgcagtgataggacaccagcattctttccctcagtggcctatgactgctgttggtcaggtgtctacagtgacttcaagatgattccacatccttgaatcatttctcaacacttaccagtgcactgggttgttgggatataaacacaggaacccacaaacaagacatcctctttctgggactgactataaatccctatcccgtattcatactggaaaactggtaagaccttgtaaccctcagcattcttttgctatctgagaattaggggctggaatttaggccagctcttttctaggctttcttgatttttccactccaatggaagaaaagcagaggaggaagcaagcaggaagacatggaaaagaggacaagatctatgtccctccgactagggcagagtttggataagcatcccattccagccctattctctggttaccttgcgcttttcatggttgacaggatgggaaccctcccaaacagcaggctgcgccggccctaacttatgtgaccggttgtaaaggagaaaaggctaaatcaatagggttataaaagcacataccatgcagaagttcagagaaagcaacaaggaagaacctgaaaagtcaagagcatcaccattatcagagaagtttcacttctaaccccatttacttagcatactgagctccacctttaccatagtgacctcctggtaagtgggtgccaggagctccccctagagtttaaaatgtgccattgtcaatacctcttaacagcctgggggaaaatgcttgtctggcaggcataaggcccagaggagatgggagttcagaagtctacgtattaggttggtgcaaaagtaattgcggcttttgccattcattttgcaccaagctaatacacaattacaagccaaagtagatatctctccctcttccctaagcacccctccacttgaagtgattttgcccacaccacatttgaacaaactcaaactgcccccttcaaaatgatgggatgggggagtggggaaatggttaagtctgtcagctaagctgtcccagagttctcagagtcagaatggagacgattgctttggtatctgtttgatggcacacaaggaagaaaaggcagctacacatctttctcttgccctttggcagcagatcacaaatgtcacagcttgggagggtgccaattagtgccccttgtatcctaaataacctgccacagaaataaaataccaagcagtccttgctttgtccttgtgagttggggcccatgctttcccccatatagagtatctaattttgaaaatgtcactgtagatatcggcacacagtgattctacagctggagagatgaaggtggaggccgcatatgatttgagtcaccatgcttctccacggactgcactaagtctcgtctataggactcaagttaggtagcagttcatagaaatggcatgaggtcagataaagtaaacgatttcaatcacacttgaaaaatacaatgtgtgtgtgtgtatgtgtgtgcgtgtgtgtgttgtgtgtatgtatgtgtgtgtgtgtaaaacacattctcaaaaagggggtgatagtataatacttagatgtgaaaaaggacaactctgataattgtagaaaattaccttggtatgtgcatatataccttttgaaaatagagatgtttaggcattttatattcattttttagagttccacttttttttttttttttttaacattctcttctctttctctgttgatttaccgatagaatatgtgtgtgtcaggacacttggcaagatagagacagctggaagtaatagagccaagctctgtttgaaaagctgaattttcacaagtggtttggggtttaggtgtggggagcagaaatcctgggcttcggaataacttttgaaaagttgctcccttgacgtaaagatttgaaagaagtaattcacagcctgccttgcactttttaaaagttgtgtaacattacgccacctaccacaaaagaaaaaatgtatataggaaaagacacgtcaacattatttcgaatgatgtatttttaatgtcataactttctattattatttaatctgtcaaggaaaacatatactggaaacatttgagaatcctccctccctgccacctttgcaacacacacatgtccacacgcacttttctttgccaaaagtaagaagctggggtctggaaggcttgctcctgaatatggtgtatatcttatgtaaataaaacagagcatgcagctcaaaaagaggaaagtagtttgtttttccatctttgatttctgctgttgtggctcctctttgttacgaattaagtctttaccatcatttagtgaaatgttatcctcgtaatggtaacctggattgttaccaagttacttttacagacaccatctccatttctccagtgatctagtaactccgtggtggatttaactcccctattgtttttggcttatacacatgagtctgtctaatgcaagctgtgtttttctgggggccgaataaaaagtcttcatgagtgatagtgctggggttgcagtattgaaacatactattgggatccgttttctgattttgactcagtagcctgtcagaggcagaatgcttctccttttgataacagggctaactagtttctgaaggaatgcataaaagagtcaggctgtatgaattccagagtcttaaattcctttagctatgccctgcaatctttaagcaggaaatataaacatgtaccagctataaaatgtgtgagaacaataataggaatggctatctttcttgcatctctcaagtgtgacatacagaggagagctgtatcttattactaaccttgtccatcaagctaatatttgtatattgcttttctagggcctaatggctgagccctatctctgaatattggataaaggagcaattagaatcgtttgtgccaaaccccagagttggaactgcaggcccttttaatatgagtccaataaggaaaggtttagtgtaaatgaaggtcagctgtcttgaggtccctgaccaaagctctgtgtgaaagctaaacagagccggagggagtttttttcacctggctataggctaaatgcaacacagccctatagcatgcagatgctcccaaataactaacttattttcacaaggaattataaagcataggaaaattaataaattaaacatagctccagtcctgcccccaagaatagattgcactactaagttttggcaaaagtaagaagagaccataaaagtattagaaaaaaaaagaaggaataatttattaaaagtttctattttttaagtaagtatatgataaaaataaagatgtttccaatttgatttctaaatctttgactcttcaattgcttggtttccatgcttggcatggaaagaagaaaggaaaggagaaagaaggaaggaaagaagaattgcaggcaagtaagaatgaaaaaaggtaaggacaggaagaaggaagaaagaaggcagaaggaataaatgaatgaatatgcctgaatggccacatggaaaatttaaaaattatccaatgctgagtaaaaatcaatgacagccagtaaacaagcacataagcacactcccctaataatccgtcaaataggatgtttttaaatcacagcaatatttgttatttcttctgatgctttctatttgttccaagccttagagcataaggctagctactaaagagcagaaagagaaatcgaattcggctacctgttgttgctggtatggggagggagatgaataaaagcagttccaagctccagtggctggttttcatgaaaatgtattttcttaaatcaataccatttcagactggttagtttttggacatcctttaccaaagatagatagataaataaataaatgagaggtcattttatatttcctttatgaaataaatatgcttaaactctaatggtaaaaatgtatgtgaagatcaaaatttatattgtgcttaatgattaaatgggctacagaaaaatatttttacctagtagacagcatcttagtctcaaactcaggctctatttaacagtcttaataattagcttcaggctgggcgtggtggctcacgcctgtaatcccagcactttgggaggccaaggcaggcagatcagctgaggtcaggagtttgagaccagcctggccaacatggtgaaaccccatgtctactaaaaatacaaaattagctgtgcgtggtggcacatgcctgtaataccccgctacttgtgaggctgaggcaggagaatcgcttgaacccaggaggcagatgttaccgtgagccgagactgagccattgcactccagcctgggcaacaagagctaaactccatttcaaaaaataataataataattagttttgtaccctcagatagtcaagagcaatcagatttttcttaacctttattttctcctttgtcaaagggagctaatagcagagcttgttgccttgagattaataattaaataataattcattaataattaaaaacagtaaaataatacttgaaaacgcttttttaaaaaatatagacaaaacaaaagcttttttcttttctctctctctctttttttttttttttaacttgaatatcaagctcgctatgcaatttgacttatggagtgctgcgggaaacctgttggatattttcatgtatgtccttaaacacatgactgctttccttgtatgtgcttgattcttgtcagtccttctcctcgttattgaaagcatagattgctggctgtgagttggaatcatccactggataacaaaggcagtatctgttttctgggcctcattgtttgcaggtctgtgtgtggtccagcctagaggtttctcttcagagatctatgattggcggtaagagagaagtgaggttggtcaggagggtcaaaacaatgaggaattgcatggatgacccatagacagaccagtggtcatcgtgtcagaatctccctgcagcagcttcctccatcaccgactgagcagggctacccaacccactagccccctacgggcttatttacatgatctgatttccaaagaaactttcttttccagatgttgtgtgctttgcaaggctcagctctgtgggagctctgcttgacaaactctaatatagtctacatgctcacaaggatggtttttgctaaagagaccccagtgatatgttggtgcaattcaggatttctcagggtagcacatcaccaaagtgcctgcaacaatactgtcaagatcttactgattcttctagccagaagagactaaaacaggtgatccaagactcactcaagcatgcttcgtttcttaagacatatagtaacatagttgcttttaatttttaaattttaaggattaaatccaaatttgatcttaggtaaatatgtaaaatctagtctaataggttttgggaggatggaatatagtgagatataatgttcattggataccaataccatatttatttcccactgtatatgatgtcagaaaccgttttaaaatgcagctggtctaagtggaatgttcaggtcttggtttgtaggtatatgataccttggttatttccatttatttttaagatcttattgtctgtgtgcatgcctgccttctgcagacacaaatcaaaagcttgcaagatagcacagctttttttttttttttttttttttttttttgtctcttgatagaattaggacaaagatctgtacatggaatagacctgaggctgggcaaggtcttcctccgcctatctcaccatctttgtctttgctctgtgccctacccaaacccaccttcttttagttcttcaaatactccatacctgcatcaaccagaagttttttgttgcttcccatgtcgtcttgaccacctagaatgcttgtcacctggttgcctcctgcttctcctgcagttattatctggtaatgtctggagatatttttgtttttcacattagggggtaagacactactcaaatcttgtgggtagaggccaggtgtcttagtccattttgtgttgctacaaagaatacctgaggctgggtaatttataaagaaaagaggtttgtatggctcacagtttggcaggctctacaagaggcagggcaccagcaaatgctcagcctcagatgagggcttttgtgctgaatcaaaatgtgatggagaaggttacaggggaaacagacatatgagggaggccttccttaactttctgatgagataaaagtcctctgttataggctcttactgcaacagttcctgtctgtcactgctgtcattagaattgcagttttactttgctcgagtaatatattgattactgtctaccacccccaccagattgaaagtttcatgaaggtagagtctgtatctagtttgggtcttcattgtatccccagaacttcatacagtcacataaaagtgatcacttggtaaatatttattaagtgaatgatggaatgagtgaataattgaagaaataaaggcataatgggaggagagaacaaaaaagaagtcaggcaagctaccaaagtgatgtgcttattgattgactaattttcaaaccagttcacatccatcacaagtttgttcatctatttacttggaaagaatagatggaaactgaagcttgaaaaaaagtaatcatcgagactgttttcatttgacatgtgttaatttcagcaacccctttttcttcaataattcctctgttgagaaagtttggtgatggtatccatgcacatcatttttttttcactgaagctcactgacacctggaaagccacgtagtttttcagatttatttagaaaatagaaagcatctttaaaagtccttcaaaagcacaacagcaggattttggtgtcagtaatcatatgccatatttcaggcttttaatttcctcggaatggtatttcttatgatctgaaagcttttttccctcccctgcatcagatcttattttaacatactgattgagcctctttatcttacacttcctgctgggaaaatagatgctaaaatgtgtgtaatgtcacatttactttaaggcatcaccagataaaattgcaggacccacaggcatgaactgtggtgtgcatgtgtgggatttcttttcctacaactccagatctccatcagcagctcaagccaaacattcagacccttcaacgttatgtttaattggatttcattctttttctttttattaaaagcctttagtttgtaaatttttttcactttgtactgaagcttttagaaaagagcaacctcttttttcaaaacaaagttttgatctaatcatttgcatctgttttgtactaattttctttgcagatgtttcggagtttgagctatgcagttaatagaatgacaccagattccaactggtctcttactatttgtgagacctcactgttttcaagggtttaaaccagtgattcttaactaggagtgattttacctttcaggggacatctagtaatgtctggagatatttttgtttgtcacattagggggtaaggcaactactcaaatcttgtgggtagaggccaggtgtcttagtccagtttgtgttgctacaaagaatacctgaagctgggtaatttataaagaaaagaggtttgtatggctcacagcttggcaggctctacaagaggcagggcaccagcaaatgctcagcctctgatgaaggcttttgtgctgaatcaaaacatgatggagaaggttacaggggaagcaggcatatgaaaagaagggaaaacctgaaggtgccctgactttccaacaacccactctcaagggaatgaattcattaccaccaaaactcatccaatctctcgagagtgaaaagtcattcactactgtagaacactgtcaagccattcacgagggaacagtcctaaaagcccaaacacatcccagtaggacccacttttctacactgcggtactgggggtaaaatttcaatatgaactttactgggaacaaacaaaccatatcaaaactatagcaccagggatgcttctaagcatcctacaatttacagggcagtacccacatcaaaaaattgtctgccctggaatggcaatagtgtcaaggatgaaaaactctggcttaaactcaaccttaggcttccactctgtaaaattaaggtgtaatcacgtgcatcatagcaatgttgtaaagatgaggtaaaataatgcatcccacattcgtagtgtagtcagtaactcatgagccattgttatgaatatggttgcattattaagccctttacgatctggtccttaatcacctttctagatttaccttttccaattttctcttatatcctcagggacctcttaaaatttaccacttgttacccattcttatctggctaacttcccactctttacccacgctgaagttggatgtctccctgaaaccaatagactaatctgaaactaacccaaagactcatctaattttctggtttaccccatttcagagcccagttcccactgcactgaaattgtctgtttattatttttcagagtgtgatcaccacaccttgtgttaaaattaccaatactaaaatgccctttcctggactttattcaagatctactgtatcagtatccccgggcacggggtctggaaatatgggcatttagctcctgaattcattggtagctatactaaagtcatcactgtagatcctgagtttcaggctgggattaggtctttttttttctttgcatccttggtgcttagcattgtgactggcacatagtaggcacttcataagtaatagcactatttgaaaggataaatgaataataaacaaaaacttttattctactcttgtctcttattttgaaaagataaagacccattggtattagcattcagaggggagaaaatgctacttcttctgctctgttcttatatattcttatatacaagcatgctaaggacaagatatgcctttgtttagcaaagtttgaaagtgagaatcattagactgatcaaagaccaaagtcatgttttgtttggcttgtacaagctcagagagggttttttttttttctgtctgttgtggttgttttttcaagcttttaattgttttaagttttgaattagtggccaatattttcatataaaaatatgaaaatattgcagttggtatgttgatgagtggggccttatggggaagaaaaaggcacattggtattagcattcagagtgggaaaatgctacttgttctcttttgttcttgtaattcttttatacaagtgacttctgtcgcttaaataagtcctcgaatgtttacatgatcaaaaataacttatttttgcctattaatgtatggtttataaatacagatgcttaaaggggttatagaaagaaaggtaaaggaatagaagtcagctggctgtaagacaaaccagccaaactggtgagctcatgttctcttatagaaaggatgctgcttctctgatcagtaaatggttgctggttgaatggggaaatggatgaatgagatctcagcaatgccagatgtttctgtttctcaagagaagtcagaatttgatttttttttttttttttttttgagacagagtcttgctctgtcacccgcgctgtactgcagtggtgtgatctcagctcactgtgacctccgactctggggtcaagcgattcttgtgcctcagcctcctgagtagctgggactacaggcatgcaccaccatgcttggctaattttttgtatttttagtagagaaagggtttcaccatgttgcctaggctggtcttgaactcctgatttaaagtgatctgcccacctcggcctcccaaagtactgggaatataggcatgagccatcgtgcctcgcctgaatttgaattttttatgtgaaaatattggccactatttcaaaacttaaaacaattaaaaacttggaaaaaaaccacaacagacagaaaaaaaaaaccgtgtctgggcttgtactagccaaacaaaatatgactgtggtcttttatcagtctaatgatgcctactttcaaaattgctaaacaaaggcatatcttatccatagcatgcttgtaaatgagaatatataggaacagaacagaacgagtagcattttctcccctctgaatgctaataccaatgggcctttttcttccccacataaggccccactcatcaacataccaactgcaaaaacagaagtcgggcaaaagcagtgcgtgttgcttctatgtgagctgaagtttaatcacagtggtgtgtataatgatagctccacaggtgtccttgtctctggaaatcttggctgtgaccctgtaagatgtaactcacagtctgcaatgagaaacggggaataaatcagttggtcagtctctctgtatgataaatcatgagtgtgatgctttggcaatttagatcagcattaaactctgggactaaattaaagaaatcaccttcagcttgagtctgcacctagattaagtagttgtaactttctaataaatgtggcaagagttctgtgaagattcagacaagtctcactttgttaagaaaataggggggatggaaagcaaaggaggaactgaaatatttgggaagaattgaaccaccaagggtttagattaaatgatcaaagacagaagagcaagtgtgatatcctgagtgagcagagtacatatattttctttaatgggatgtagtttaagcagcataaaatatttatttcttgtagtaggtaattgagatccctaaattggggcaattactttgaatttagtcagtgtatcaatcagctatttttgcgtaacacccccctaatcatcagaggcttaaagctccaatcatttattttgacttacatgtctggggctggctggggttggctgacctagtctggccttgcctcaatagctccacctcaaaacgtgtgtccatctgggtttggctcctcactgcgagttgtgctcaggtctgatcctcatatgcttggtctggaacctcaggctgaggagcaacagctggccagaagttgctcttttttcatggtgttgacagaagtacaagagacacgcacagtggcacaagtgcagacccagcctctgcttggatcatgtcagctatcatcccagtgggttcagctaacctcagggtcaaacccaaagtcagggtgtggggaggtatactccaccttcagtgggaggaaccacaaagccacaaggtaaagatacagaatacatgaaagtggtgaataattgctgggcagtaattcaacttattgcactgttatgatagggcatccgtggatgattgtatgggttctgtggagatggcattatctagttggattgcataatgataaaaggtaattaggcagtgctaggcagatgccaaaggttcacacagagactttctccttgatataatttgaagtcttgattgagaagtgaaaagggagatggctaggtttgctggcctagtgctgtctgttttgcttctaaatgattgttgaacatttgaattaatgttaatttggtcaagcttcatcaaatgtctgtatgccagttgtgagtcttcttctaaaggaattattgtgccccctactttcatttgttttaaaagcctcatcactaaacttatggtcggcagtatattgtagtcggtaccttggttgacgtgcgtggattcctatcttcaacaaataatatggtaataagaggatataactcaccccttacatgtaaactacctatatccacacaaaattgtctttcattctctgagaaaccacaggactggccatgtcaatctgaggagcatcctagggaatttgcaagaggacctggagaagcagggctgcaatgtgagggtcacaatagaaactaatcaattgagtttcactccatctgcagaggatggtcagcaaggagtcagaatttgtctgtgcttcttcaaccccatcctaaatcaagcagaacatatatttcagtctccagagaggagaaaagaggccatgggaaggaagatggtgcatcaagccatacttgaagcttgaagtgtcccattcccttatcctgctttcatgtgcatgaagcaaccttggtgttcttgtttatacatatgagacttattctctaagcatccccacttctgggtgccccaagaaactgacaatccacagtccagcctgtggtgaccctcctaaaatcatgccgcctggtgaagctctgcctgttttatgatctgacgtcccagatcttcatctttattttgtttctcttggagatatgcttgatatttcatgctgtagagaaaatagtaaaaaaaaaaagtgttagttaaattaaaagagtataaagataaatggaaaattaaatgagtagccttgtaattaacaaggtagttaaattatgttttaaatgaattcttatctgctgccatctgatttcttaagaccttcataaaattggtccatagcaataacattacttgactggaagtttcagaacacagagtggcatatatcccaaaaacgcaaataatgtgaaactgagtgttagacatctcttatttaaagaaaaacatctcccaaccctccggcaactctagagaggaggagatatctaaatgactaatcaatcaattaagttatctcttccatcttctattcaatgtgatccaatcttccccctttagctcagctttacccttcagcagcctgccctagggtcttttttttgcacacatgattattgtcaggatacttttctaaacaaagactcattttctccctgtggaggaattctgatgccaaatgttaagaaaattgtttgaccctaataaaaatttatgtattttttttctaaccctgttcattattgatttcagtttattctgaacactgaattttttaatgtatcaaaagtgtgttgttacctaggtcagcctgtgtggtcactcagtcaatacatgagttttaattcaattcaataaatattttccatgtgcaaggcactgagatcaagcactgggcatattaactgtaaattagatttagtgcttgccctcaagaagattacagtctagtggaggaccagcacccctgcacaaccacagagtgccacgagccatgtcagaagaaccccctgcattggtaaagaagcacgcccacctttacagttgagtatttctcatgggggaagggatattttccccaatttattataaaaaatttcaaacattaagaaaaattgaagaaatagtgcagtgaacagatatgttccccacctggattcaataattgaaatttgctgtatttttgttttctttttctatctatctatcaatttactgatctatcaatctatctatcatctatctgtctgatatagtttggatatttgtccccacccaaatctcatgttggattgtaatccccaaagctggaggtggggcctggtgggaggtgttttggccatcagggtggatccctcatggcctggtgctgttttaatgatagtgagttcttgtgagatctggtcatttaaaagtgtgtggcacttcttccccactttctctcttgcttgctcctgctttctccatatgatgtgcacgctcccgcttcaccttccgctgtgagtaaaatctccctgaggcctccccagaggccaagtgatgtcgctgctaggcttcctatacagcctgcagaaccacgagccaattaaaccccttctctttagaaagtacccagtctcaggtatttctttatttcaatgcaagaatgacctaatacactatctatgtatctatgtatctatgtatctatctatgtatctatctatctatctatctatctatgaaagcaaattggagaaattatgacaattcatcccaaatgcttcaacttgcatctccaaagaatatagacattctgctgcacaaccatagtatcattattatacccccaaaatggacaaaaattacatatcatctaatacccagccatatttgaattccctcaattaatcctcccacctgttacggctctttactgttgttactgttgttgaaaccaatcatagattaagcactaaatttgtttttatgtcccttcagtttctttcaatatagaacagtgtcctgctttggtaaagtactatattttgaatttttctgattattttcttaaagagctgtataacatttttctttaagtcttctatttcttgtaaactacaagttccatcttgaggtgtgattagattcaggttgaatatttttggctagaaaaattcataagtgaggcaggcacggtggctcacaccgtgagtgtgtaatctcagcagtttgggaggctgaggtgggtaggtcacctgaggtcaggagttcaagaccagcctggccaacttggtgaaatcctctctctactgaaagtacaaaaattagctgggcatggtggcaggtgtctgtaatcccagctactcgggaggctgaggcaggagaatcacttgaacccaggaggccgaggttgcagtcagccaagattgtgccattgcactccagcatgggcgacagagcgagactctgtctaaaaaaaatataaaataaaaaaatgctgggcacggtggctcatacctgtaatcaatcccagcattttgggaggccaaggcaggcagatcacctgaggtcgggggttcaagaccagcctgaccaacatggagaaactccatctctactaaaaatacaaaaattagccaggcgtgatggcacatgcctgtaatcccagctacttgggaggctgagacaggagaatggcttgaacctgggaggcggagcttgcagtgagccgaggtcatgccactgcactccagcctgggcgacagagtgagactctgtctgaaaaataaaataaaaaataaaaatcataggtgatgctgcgcatttcattcacatcaagaggttcccattgttatttgtggtgccatgtttggtcacctggttttgatgtttgtcgcaaaattatctcgattatgaagatacattttctccctcgttttcaattagtaagtgatctgtgagttgacactggcgtcattgcctagcttgcttacccaaacctgaagcttgtattatccattgatgagccttttctaaatcactccagtagggttagcaaaatggtgattctctaattctatcattccttctacatagattaactagtaggctcctgtaaataactttcattttttaatatgcttacagaaagaaggtgtatttgagtggagcatgacctagaaatagcaaatatctagctacacataaacgttaaaaacccaagaacaggaaagaaatttagagaaactagagcatttagagctagaagggacctaaaacaatatatactccaaccttttaacaagtgaaaaaagtgaagtccaactatgttgtttatttttatctcataactaactagcttgatgtaacagatctttgaataaaaggaaacacattgtacacgggtgcaatgaggtcaaagtacgaatataattaccactgatttgttgacaacattgtttgctgcattataattttataggataataggagattgcttattccagcctcagtaagcattattgcacacatgaaatgtgcagggtataagtttttatatttttccttcattatgtgattgccaaggctttatttctaatgctaagatattttcactgggtttaaactgagccgacttatgtaccctggttctttcctactcttgaaactgtcagtaatgtcacagtgtctcatagctggaaatgtagtaaccacatcactccccccaactcctgctccctgatttttcattaggatgcagtttattaatccaagtaaaaatatgaaagcctcctatgattaggtttaagcctaatatatgatcctccttcctggaagggcactttgagctggtcattagggaatggagagaacgggtatcattagggaatttgcctggcaagagcaaggccaagactggaaggaaaattggattttatttgccaaagccgaggtaatgtcctaaataaaaatttccccaaccaggaagacctaagaaaattgtcaagaggtagagtttagaaccaggggcacaaagggcaggtgggagaataggctgggggaagactggagtgctaccaacaactagctttatgttttcctttataaacacgtattgagcacctactatgtgacaggcatggtgctgtgtgttttgtgtgcattacctaatgtaatcctcacaacagcctagaagtcagtacttttattaccctcattttagagatgcaaaactgaggcaacttacctatggtcaccctgttaataagtgttggggtgtccctgacccctgcacttttaatcagtaggtaatatgtagtacctttctctggcttgtaaatgttttcttgcagagaaaatgggaagcaactatctagattggaaaggttaaaacgaaggaatcggaaagcaacagttaaatagagttaaatggctacttttccctctcagagttttggaatacctatgagctttcagccataaagccaagaaggttctggctggcacgacattgtccccgactaatgctaggatggtgttgtcaaacagaggcagaaacagagccctatcctgtttctgctcagttgcccatttcagtctccgtcctgatgcaacacgaacttctacagacagactcagggtctccagaaagcaaagcctttaggaattaaagtcatctttgcttttaaatacttgtttctcccatgttaaggacacttttctaggcaaaaacctcctgattgcctgttgctgtggcatatcttcacaaattcatttttcataaatgtcccaaatacatctgagacattttttataacttgtgtaagcttccagagacaaatgttaaagatgacagtttggaaatgaagacacataaaacatgccttgggaaatagaaatcctagggcagcgacctcaaattcagtcctctgttcctttttagtcaatatattgaatatcatattcatatatatcatatcaacatcatatgtatcgaatatcattgtatgctgcaagtctaaagaaagagagactagaagtgaagaggtcaaggtttcagccatccatggacctgtgaaggcttgactttgaaatagtcacatgatcactttggctattagttttatcacttctcttatcttggtctgaagatctgagctgtgttttatgataaagaaaaatgtataagctagtttttgctgtataacaaaacaacttaatcacttaaaacagtaacaatttaatgtagctcatgatctggtatgggctggctcagctgatctctgcctgggctctatcatgcaatggttgtcagccagtcccttagctggctgctgggtaatccaggatagcatcagctctacattatggatttggctgagcacgttgtttctcctctgtttggcctcttctctccagcagtgctcagacttattcatgtggtacctcagttcctaaaacagcaagatggcaagccccaatcctctttgcaagcttttactttcatcacgtttgctaatgagccattgactcaggaaagacatggccagatttaagagatgagggaatatatcccacctgttggtggaaagatctctgacaccacatggcaaagataagaatgtaaggggtggggggattatggccgtttttatcgtctcccatggaaaggaaattcactggctctgaacagtgctaatcaaaattgttactgaacatcataaagaacgtgaggagaggcctctactatgcattatgttcatagaatccttaatggaaaaaagtttgaaaatactgactacttggtgtctagagccccctccagctttagtatcctgtgactaagaaatatcacttgtccaccaagtgacatctagagactcttcatcaataatatgagatggaatcatgggaacatgtgtttgaacacaacaccttgtggatcaggttctctgcttcacagcggaatgcttatgcttagaatttttgagtgctaacaagtgaggttgagtctgtgagctgcttgtctcaaaactagattctgaaaatttgcagccactgctacagtcttggcttgtagttttacattgaattattggactgaattatttcattttgtcctggcgtgccttatcaactgaaaatattgtcccagagagggagcacaacaatattttgtaaagaaatcattcctgcagagatgtaaagactggttagtaacctgagtctctgacccactgtagcaaacagacacacaggatgctgagaaggatccaggactcactaagctgcttaactcaaaaggaaatagtaaggtttacactggcgacatgaagctgagtctcctttgggtctggagtagattttggtctgtgcttatgaatcgtctctgcacagatgaaataatagacattttaatgactgttcatatttataattatattagctttggatccaggttagaaattcttcattcctcctgtcaagaacttgcataaccctgaatggtgattagtaatgctagttaagcatgctagttcattttcaaaatctgttctattttacacacacacacacacacacacacacacacacacacacgtagagtcattcattcactcattcattcatttgataggaagttaagtggcatgtagtagacatctgttgtttgtttttgtcaccccaaatctgtttgcttttctcctgacaacaccattctgactttcttttggggaacatacccttgctcccattctcactccaggttcttcagatggggtgagttcatgggtgggcatgtgactcagcctcggccaattcacacgacatattctcctggccatggtggtgcatcagaggtggcaaactctcaagccaaagccagtgacatgcgaaagaactttcactgagactgttgagacagaggccgtctgccctttcctgctgattataacttggaagaagaaagccctggagatcttggccactgatatggtttagctgtgtccccacccaaatctcatcttgaattgtagctcccacaattctcacatgtcgtgggaggggcccggtggtaggtaattgaatgatgggtctttgccatgctgttcttgtgacagtgaataggtctcatgagatctgatgattttataaaggtgagttccctgcacaagttctctttttgcctgtcaccatgtaagacatgccttttaccttctgccatgattgtgaggcctccccagccacgtggaaccatgagtccattaaacctctttcttttatgaattacccagtcttgtgtatgtctttattaacagtgtgtaaacagactaatagagccaccatctctctaccacatggagctccagaatgaacctgatgtataggaaattaagaaagaggggaagatatgggatccttctgacatttgattctaacccccaccctgaccttttcagatacaggagtctatatattgtcttttattttcttaagacagcttaagttttctggaacttgcttctgaacattctgttacgtcatttttaaatacttgccaattatttttattagttactcatcagggagggaaatcaaaccagctcctgtaaaaagaatggaatttcaactatccagagtctcaaatctaaaaataggtggctaactcatgtcagaagtatgaaccctcagttccactaaatcccaatcttcataagtggaagcccaagaatctctattaaaaaattttaaaagcttgctagtttatgatgtatcctgcttagcacctgttcatggtctatgtcccagagatattttgaatatcacatgtaaaggggaaaggaaataggatatatttttcactttctgtaggccagatattttttgaagtacttcagcatattttcatgtaagatatttaagaaaaacttttgcatgcatttcctcagtgttctaggtataatactttagattactggttgctcagtagggaggaaaaaaaaaaaaaacagccctgatctcaaggagcttatagtctatcgcatccaatagaaatttctgcccttaaatgttccacgtctgccctgtccagtacattaaccatggctattgggtatgagaaatgtggctagtgagaaatggatttttaaattgtattaatttgagtagccatatgtggcttgtggctaccgtattgaaatgtaaaggagtgtacatctaggttatttcttcttaaacttgcatgtgcgtatgaatcatctatagatcctgtgaacctatagatctgatttagtaggatttggtgttggggtggtggttctgcgtttctaacaatctcagaagtggctgatccatggaccacaccgagtagcaaaaataatcatcaaagtaaaaaagttaattacaaaatatggtaagaccatagtggggacaagatgctataagggagaacggaaggggaagaggggaagggtttgcgactcaatttaaactaggaggggaattatagaaggcctcactggagagggggccctggagttgcagcctgcaggatgcagatgagctagttaggatacagaggtgaggggaggcagtgcgacagggagcagcagtgggtgcgaaggcatctcaaccacttttatgaaagaatctgtgaaataggcgagtcatcaataatagaattatcattacatttagaagccccttactaagccattcttctccttgacctccctgacaggttcaggtaggtgcccttctcagtccccataactcaaggcatattttcccataatcattaacaccttgagttgaaatgtgccctctatcagtctctgctgcccactgaactgtgaacccttaatgtcattttattctctgcatcctcgcatggtaggcattttacacatatttgtcaaactgtagccaaaaagtgtgtttgtgtgtgtgtgtctatgtgtgtgtgtgttgtgtgtgtgtgtgtgtgtgtgtgtttatgaggtatcagggataaaagaagtagatatactgcatatatagatgtatgcattatttttctcctaaagagatgagaaatatttttggagttgagccaagccattcatggcctctccattacttttagttttatggcagaggattgctctggttttgacaagcactaattaattccatctctggggaataatgggaaatgcaggcttatgctgtttgcaccaaggttatcagttatattggttttaatgttctgccctgctctagatataaaacatgcagcaaaatgcacagccacctcctcattagctgtaaacagtgtatttcagatttgtcaagcatacatatttatttttacatccaagcatttttatttatcttccttgcaagtccatgaagtttttgccaataaattaggaatgcagtaactagttctgaaaactatggcacacaggaaattttattgatctcataatttactggatcttttggttaattacaagttctgtctagcttagtacactttttgagccagctgcgcatcataaatatgtaacctcagtactcaccctccctacattgctgacagcctcccatgaggtcaaaggtgtaatagctacaatacccagagcctctaacatgtttaattaaactattaatctacttttatctgtgacactagaaagccagctacattgaattttcagagttcttcaatgcatttgcttacggtaaatttttccaagccatatctttaacagtttagcgctggcaacccttttaaaggcattttgaaaaattgtgaatgttggaggaattaccatatcagctaataagaaaatgtatcatttataatgattcatgaatttgagtctaaatgcagtatatgactaaggcactttattaaaaaaagagaagacaggtttgctaaaggtttgaaaattgtagtagatcaatcagcagcagcctcagaagtaccattattttaaaattgtgtggatgatcattagaagagaagtcatctttgttacataaccttcaggaacttgctgaggacaagtgtaacctcttgtggcagtgatgacattttcagtgatcaggccagcttttgtgttcattaacacaacagagcctcaaaactttagttttgagaaacctgtgtatccatgaagctttaattaggttaacaaggtacccattagtctatctcctttcttgtgtatcaaatggcagtaatctactacagatgttatacaatgaaggaagcaatttgctgcttttcattttatttcctgtactcactcatgagcttgtggatatagaattatgtgaaaaattcaagattctatttttattcatgttaagctcatcttacctgtttgtacaattttttgctctttctttattaaaggaatctgcatcttatgtgcctccataaaagctgtaaaaatatgacaccacgaccttctaactaaagtacctggctttaattttaacaatgattaacagtgatttgagtcatgcatttgaacattccacttaaaagtcaatttagacaggcaatgcccatgcaaatattgattataaacccactgtgtttctagcaagctagattaatatcatgggctaaaattcaaaaatctatttttcttttctacttcattaaagagtataaccaaaaaccacatctatttgcagattggtcatatattttgcaaatgcctgtgggactgaaatttaatttactcaacatatcttccctcccaccctacctccagtcaaaatcatcaaaaccagaactcttgttacatttatggggcagttgaaactgtatatttcactttgttttattgcactttaactttttgcactgtattagctgtgagtattccatggatcttgttaaatgtgagcagcttccttgaaaacaagtcatttcaatggacatgttttggcttatgttcagtattttacagccaatgtatcagagccataagtttataattttaaatgccgcagatcttacttattcatcatgattagatgtttctatctgctattctattgaatggcaagctctaatactgataaataaagagagccagttcctgatttggcaacaacaacaacacgtactgaagaaaataaatgcgttgggttcatctccttgatggggatgcaatctaagtcaaatttttgaatgaccactaactatttgcataatataacatataaattgatgactttgggatatttatatcatcctggtgcctcaaggttaaaattagtagtgtgaaaagataattactagctatgttaaataaaatgagtttctagaatgcatttttatgcaatttgtgagtacagagctattaaaggctgtagttttgttttggagaataagttgtctctttggactattgtagtaatctctttgtaaatgtttaatttttatcctagataagcaagatcttttgggctctctttcctactgttctgggatgaaagcatctaggaaatttagagggcaactccaatgagactgtctggctcacagaaatgaatcaacgatagaaactcgggcatgcggtggtggggggaagtggggtggaggtttgtgttaggggagtggcctatcagctttgacatgtgtggccatcacttatgcagtctccccatgaaggcaggtccaggtagctctgcagcagagctggggcaccgtgcctgctctcccaggcagagcctttggtgactactgctactaccaggaatagctgtggatagagaagagaacactggccactgtgtgggtgaccagaatcccagcccatacctcagtttcattgtcttctatggcacttcaaacccaaccctcaggaaaaccaaccaaccaaccaaccaaccaaccaaccaaccaaccaaccaaatacatccttaggagaaggatcagaactaacaatactgaaactttgagattttcgtttttaccttataaaaatgtattttggccaggcgcggtggctcacacctgtaatcccagcacttggggaggccgaggcaggtggatcatgaggtcaagagattgaggccatcctggccaacatggtaaaccccatctctactaaaaatacaaaattagccaagcatggtggtgggcacctgtaatcccagctactcgggaggctgaagcaggagaatgacttgaacccaggaggtggaggttgcagtgagccaagatcacgccactgcactccagcctggcaacagaaccagactccatctgaaaaaaaaaatgtatttcaagttactgcatactcatagctatatatttcacctgagatttacctggttaaataacttgcctgagaacacacaagtagtaaattatagacttaagatttgaaattgaattagtgtgtaaaccaaagtccatatctaagctgggtgcagtggctcacatttgtaatcccaacaactcaggaggctgaagcaggaggatcctttgagcctaggagtttgaggctacagtgagcaatgatggtgccactgcactccagcctggacaacagagcaaggccccatcttttttttttttttgagacggagtctcgctctgtagcccaggctggagtgcagtggcatgatctcggctcactgcaagctctgcctcccgggttcacgccattctcctgcctcagcctcccgagtagctgggactacaggcgcccgccaccatgcctggctaattttttgtatttttagtagagacgaggtttcgttatgttagccaggatggtctcaatctcctgacctcgtgatccgcctggcaaggccctatctttaaaaaaataaataaataaaatgtaaaaagcctatgcctagttcactatataatgatcctatccatggtaaggaaacacctttcatgattatcagggcatcctttatgagcctaactgagagagagaaaggaaggtatggcaggatgggagtgtagtgggcacagtggtgtgttgggaaactgataatctaaaataagcaataaagcaaacagcataatgagctctgatttggagtgttttcctattttctatgacaggaatattcccatcatggccaatttcaagcttccaaagtgaggtcattgaatgtggagttgaaaagagattgcacaggctgggtgcggtggctcacgcctgtaatcccagcactttgggaggctgaggcaggcagatcacctgaggtcaggaattcgagaccagcctagtcagcatggtgaaaccccatctctactaaaaatacaaaaattagctgggtgtagtggcacatgtctatagtcctggctgcttgggaggctaaggcaggagaatcgctggaacctgggaggtggaggttgcagtgagctgagatcatgtcactgcactccagcctgggtgacagagtaagactccatctcaaaaaaaaaaaaaaaaagagatgcacagaatcagctcagacgaactggcttccacatgccactgagcagggagcacacatgtggccaagggaaagaagggtgaggggtggtcagggaaggagtgcattgctcatagcaggtgcaccaggcaaaggacactcaaggaccccaactcccttgcctttactgtggcagctagctgccttggtggcccccatgaactgcaccccccaaggttcatgccctatgcagttttatccccttgggctgagcctgtgacttgcttaaaccaacagaatgtggcagaagtgatgctgtgcaggttctggagctcagccttaaggtggtgtagcagcttctgatttagcactctcagagctttgagctgccctgtgagaagcctatctaccctgctgcaacagaccatgtggaaagaccacacagagggaccatgcaaagaagcagaggccctgacatcacatagaggagagtcaaggagtccatccattggaggaaaattggggctccagacagatgaccctcggagagccatcccagcagaggcaccacacttgggagcaaagagcccaccttgaggattcctgctgtgcatcatctgaattccagacctgcagaaatgtgagaaaataaaatgttgttttaagccactgcattttgggacaatttattaagcagatattgacaactgaaattattcttttttaaccaatgcaggaatcttatttttacttaacctatgatgttttatggtcagagtggaaagggaagccctgcccctgaagtcatggatgcaccatggaacccgtggggacagtcaaggtcaagtcctccaagtaactggcatgctattccctgcttcctgtgccttcctcctggtctcataaaaaaagtgcatgagaatatcatgggtgatggctttagcattggatatcaccatttccctttgcagtgacggtgtttccaattgaccaaaagggaaaaattaggtagagagcaaagagttctctacatgattgttcaagaaacagaaataaagtatcaagtctgtaagcccagggttctttggagtagtatcattcttaccttggtgacagtttggtgaggattttactgctgcttccttctcctctcatcaactaaacaagaaactatgaagtccctttcctcaaggaaagggactgtcctgatagaatacccgacctatatcatgacttgttggaatattgtgaaagcacaaaattgagagaaaaataaagttatccaatgtttagatgctgaattacactgttgtgtaaccttgattggccactacctgtgaggtgagacactggagttagccattgtgaattcaggagtcagtaaacatccagaggtgtgaagcctgctgcaggcctccagttcccccagaaaacagtatctggttttaatgattttatcagagttgttttcaaggtcagtaagtttgttgatattttggtcatgagattagtgcgaaccaaccacatattggcatttaaatgactagggagataagatgagtgatgatatcataacaatagaacatattgatgatttcagagcagtaaaaaggctgaaaatggggcaatgatacttatattaaagacaaaataggaggaaactttcagcctttgaaaaattttcatttgaataaaactcatcacatgatactccccagtgtaccacaaaggagcatgtacattctgctgtccatttttaggagaaagaaaagtcataaactcaggctgccacctcagttcaatacagttgcaatgtaatgtttgaagacgctctcaagtctttgggaatgaagtgaaaacgtccactccaatcttcttaccaaggtacaggcaagtgtacacttgggtcttgtactctacgtttaaagctcaaatttacttgggtcttgtactcttggtttaaagtttgacttcaagatggctcatgtaaactcttctagccaagtcttcatatgtaatttgtggataattttatctctcttactacctacctgagggcattgttttaatgctcagaaacatacagaagggattgacaaagtataaattgctattcaaaaacaggggggcctagtgacaggtgagaaaacagtgctcctcagaaaagatcacccccatcctgctgaagtctttgaataggcaacccagacaatttaggcctgacattgtagctctttggtgaagaccaaataaaatgggattggaggagaagataacatattttcaattcattttagatcatttgcatcatctgcattaggtgtggcctaatttgtttggggcttcaggtgtatgaaccagtgctcattttcatattggacatagagctggggagatagaatggccagtagtttgcaggtgttatatcattttcctgtgatgataaggacattgcctttcttatggccattcaattacattttttgttctcatttaaagtaatcagagtttcatcgtgacgacttctatgtaaatttgaatgttacatgaggtgtgtaatggaataaaaatggagttacaaggactcctgttcaattgccaacatgcttcttttctattactagagatcgtagagtggctttggggactaagaagcttagacattattttgtaccttatcattggccatttttgtgattcccaaggtgatagattggtggccattcttctgaatagcccttccaaaagtcttggtatttttggctcagagtctttgcagaattgcatcatcatgaatttttacttttaagatagcacctgttttgtcaatcctgtgagaatatgtatttcataacatgtagccacctatgggattaagtaagtactgaggtccttgagccatttccaaatgaaaagagggtatgatttatcagggcagatccagtagttcaggggcagagctaagttctgaggtacaataaagagaaacgtaaaagtaggaacccacatttcaaccatttcttcttgtttttgaggatttaataggaaagatttttagactttagttgaacaaaacagtaagataacataaaatcagactccacttaaatgcttagtttggttttgtggaactggagcagctcatggggaaatgctaattggtcaaaatagataaataggaattccacagagtctgtgagaatgattagattttaatataaggcattactcaatagtagagtaaggattagtggagtggtacaagaattatagccattgtctaaatgcaaagatttttcttcatttttacaagaagaaacttgtgagctgactaaagttcaagtttagtatttcaaaccagtgagaggaccatgtttcattccacatgaagcttggttggccatgcaggtggaattttatcaaacaacacatttaaaattttactttcttatcatatttgactattgaaaacatgacccctccctgcaactctgtttgtgttaaagcatctgcggttaatggctttctgcttcttgtattgcaaagaactttaaaaagagatcattctctgaaaataagtaccttgctggtaaaatgagtttaacttggcaagctctgtcattttttgttgttattgccatcttatgttctggaagtaattcacattagtcatcttttagaaactctaagtcatgtcttccctgtcagatatcatgctctggtagcaatttattaaatatttcctgctaaaaatgaccccaggagatagtagttaacctactcttgagtgtaataatagaatcagagattgatgaacaattttcgccaaatattttaagtaatggcataaaactaaaaggccatgcattgcttgtcttagaaaaacagtacggaacatgttagaatattacgaataaatgaacactttcatttatgagctgtatatagaaatcattgagtttctctgccagagttgcagcctgtatggtagttaatcttctcgtggcacttactgtataatgcaatgcctctttgggcaatcttttgtgttaaaatacagcatttaagctccttctctccacaaagcattgcaagaatgaattgttcaatctctcttttttttgacatcatcctagaaattatttcagaaataaccaagatggtaattcccatttaatatctttctttattgctcattggaaaatagaaaatactttcaaagcatataaaattattggaaaattaacataaccctgtattgggagcaaaattattcctatctcagcattgccacccatctgagggacccagagcaagtcatttaccatccctcaggttgtttttttgtttgtttgttttttgagacaaagtctcactctgtcgctgaggctggagtgtagtggcacaatctctgctcactgcaacctccacctcctgggttcaaatgattctcctgccttagcctcctgagtagctgggactacaggcatgtaccaccacgcccagctaatttttgtatttttagtagaaatgggggtttcaccatgtcggccatgctggtctcgaactcctgacctcaagtgatccacccgcctcggcctcccaaggtgctgagattataggtgtgagccatcgcgcctggctgcttagcttgctgttatcattattattttaatcattaaaatgaaaatattaattttgtttcaaaatgaatggtgcatgaatgaaggaggtagtccatcttcttcctaccacccaaatgacagatgatttcttttcaaaatgaaggaaatattaatttgatgacctcaggattacttccattttaaactatccttctgtgtgtttaaatcgctttcctcatttttattttcttctatcccattccttcctattatattctaatgacctcttattttaaactccaaggaatgatggtccaccccagattggcttgtgatttcttcctatacagaggctttgtcatcctcattgtggccatatgccattcctcagtatgtaaagaaggttgaatggcagggatcagccgggtctagagaaaatctcagaccccatgacagtcaatagataggaaagacataggttgaatcagatagtgcaaaatgccatacctaaaagaaaatccccagaggctctttcaaattgtgagggagatatcttttgattagaggcaaatagcactgtcagcttgaagtgagcagactaggacggctaccacaatcatctgtgaaaattgtttaatacaagtgctaccttctcataaatcacaagggtaagctcatttaaaatggacatttattctgatttttgatccatattggcttaataaaagaccaactcataaggtttaacagttcaattaaggatttttcaagataaaggattatagataggaaatttccttgtgagctgggttagaatccatgggttgttaagtttcttttccgtgtggtaagtgggaaaacatatgctgtaggaggagatatagtatgcacttgaaagtaaagtgtaactattttttaaattaagatatgaccatttttaaaatttcttggcttaggaaaaaaattgaacatgcatgtttatatagaaatgttagaccatacatagcgttattattttgatgcgaaaggatgaaaattatctgcttttggtcaaaagagaggaaatcactcaaatcctttgggacactcatttataagctctatgaaatctttggtaaaatgaactccagaatttatgcgacttcctcaagaaaaagtagcttatttttaaaataaatcataataagtaacattattattattctcactggtggtataaggatcattaataaaatagagtctctgtgatatgtgcattctaatataaaatatacatatattataaatgttctgcatcgagtgaaatacccatatttatgaaaggggttgcatgggatccatcagcaccttgtaccatgaaagttaagaaactctaaatctataccacgagcatttgaattttctggcatttaagggagaagggaaggaaggtatcgtgatggagatggggtgggaaggaattgtaatgatctgctttttatttcttttatttgtgtgcaactagcacttcgaaagaacataagatagctgtaaccttctctgctaaaccaggaggtgaacacagatgtctgaaggaggctttataaggaagtgcataaagctttagaaggttcagaggagaattgagaggtcattgagagctgagatggagagggcttcatggagaagtctttacttgaatgattcccaagaacctagattgaatctagacaagggggaagactcatctctcatcacaccatactgacccactcctgcagctgtactgaatcttgtttcttctagtaaaccatgaccttctaacctccaggctttcacctggaactctttcccttccactactgcctgggtaatgactttgccatcacagttctgtcaagttaggactttcttcagaaagtttcctgtgaccttttccagccctctgacaatttcagtttgttgctcttttttgaggggctgagaaatctgcatgcaccgacctcatcactttgatggggtcagtttgctactcgatattgaaatggactgtttaggccttgatttcctcctatagactgttggctcttccatggcagagtatgtgtgttatttaccactttatccattgcacagtgcctggcacttattagttatcaataaatgtctgtatatttatgaaggaaggaagtaatgaaggatgaaatgaatagggcatgacctacaagggaaaagtcacacaggtggaaatgatgagttggcccaaagacaatgagatgattgatggacttaaactttaactctgatgtcattttctcctaaatgtgcaatatgccataatttttttcagtaaactaggggttgagacatttttgctacttaaatagagacagaaaaataggataaattgaaaatattttccagtggtaatttattagatgcctgtaaaagaaggaacatgaggttttcagggttcaagtggatgtctcattcttcaacacaaaaacacttggagagttgtataaaagatttgaaaatcactttagaaaacaggggctacttggggaagggagttgccaggaaaatgccattattgcaaaaagttcatttaaataggcttaatatatctacctatctagtgcccactatatatataaagcagtagaagggccagctgaaactagaataggtagtagaaaggggctttcaaccaaaagccacaattattagtcaaataaaatacaatttgttggccgggcatggtggctcatgcctgtaatcccagcactttgggaggccaaggtgggcagatcacatgagaccaggagttcgagaccagcctggccaacatggtaaaaccccgtctctactaaaaatacaaaaattagccaggcgtggtggcgcacgcctatagtcccagctacttgggagactgaagcaggagaaccacttgagcccaggaggcagagattgcagtgagccaagatcacgccactgcgctccagcctgtgtgacagagtgagactccatctcaaaaaaaaaaaaaaaaaaaaatacagtttgttgtatatatcataattgacaggacaagaccctgtctcaaaaaaaaaaaatcaccaaggaactttctttcttttatatttctaaagctagtttcttttttttttcttttttttttgcatttttttccattctgtgatggcaaaagaaaatctaaccaaccccaggattttcttagtcacttcaagtttgaatgcagccccttcagaattgctcctcttagtcttctctctgggactccagcccagggagcagctctatcacttaataatagtgtgtcttgagcaacttgttttatatatttgtgcctccatatctcattgatgaaatagatttaataatacctttctcaaaagatcactgtgagtattgaattacatgaaattgtatatatatatattttatatatatatatatcgcatagtgctgacaacataataagcacgtgataaatgatagcagctgctgctgcttctcttcctcttcctgttactatcacggtgatcaacaacatcatcatcataagttccaaaatggaagggcacagtgccttggagcatctggacaccggtcattgactttctattctgacattggttgtcctttggtcattgtcctacattcccatttgcatctgctgaggtttctgtcatgccatactctgaatcttcctcaaacagaacagatgaagcctcctcaggttggccagtgctccctgggaccacaggaagcttggggtgcaggaaggctgacttagactttgtattcttgacatactctggttttcaagtttcaggctacaaatttctgttcctctgcaattgccctggactcactgggaatttctaatgctcccgccacatgcaacatttgctaggtggtggcagcaggaggtgcaagtgtggggagcagggtggaaaaggactatactaaactcctgagctctcttcttcagctttcctctttttttggttaagtttaggaaagctggttgctcatctgttggttatacactcaggtttttgaaactcaaatgtcctttctctcaacttactgtctctctgtggaatttcaaaagtgaatgtagaaatttcagcaagaatttcccatcatttgctttctgtcctgctataattgtcatgcccattgcctgaggccatggtctctgccatgagtttagttttaacaagcaaaaagtaatgaattatcaggcaggaaaataatttaggttaatagtaaaatatttccttgctacatgacaaggtgaacagctgattgccataagagatctaagaaacactaaaaagtacaaaaaaataggacattagttgtcctttggacattgtcatatattcccatttgcattttctgaggtttctgtcgtaccatactctgaatcttcctcaaacagaacagatgaagtctcctcaggtcagccagttctccctgggatagaggaaccagggaagaatcaatgcatagaagcgtcagtattggaaatgggtcttgaaggagcaatctgatattgacagcagatgtatcagggagggaacacataagcaaactcatagataagtgaacatgctttgagatgtttaggaaaaagtgaagaatgtggtgtgttcagaatgtagattcccagggctgcttgattggcttcaatatgtgaagaatattgaatgccatagatttgtgattccatattcttctaaatataagttttaaaaataccttgatatacggaagaaaatgaaaatggcctctacacttattttgatgcatacaatgtgcgtgaactttctgaaagtgaatttgacatatatattctcaaataaattgccttttctttttcagtgggtcctatgccatatgaatgtgaagaggcaagggcaaggaattcacacaaaaaagatagagggggtgtttatggtcattaaaatatgaaaaacgtaaggtgaaatcttaacaacggttagtaatgctttttaataagcagctaatgccaatcactgacatttatcatatgatgtgttgtcgtggataacaagtatttattgctcacttaacatgtgccagtcatttcgctggatactaggaggacattgttcaaaaaggtagattgggccgggcgtgatggctcacgcctgtaatcccagcactttcggaggccaaggcaggcagatcaccggaggtcaggagttcgagaccagcctggccaacatggcgaaaacttgtctctactaaaaatacaaaaattagctgggcatggtggtgggcacctgtagtcccagctactcaggaggctgaggcaagagaattgcttgaacctggggggtggaggttgcagtgagccgagatattgccactacagtctagcctgggtgacaagattgagattccgtctcaaaaaaaaaaaaagatagattgggccctgctccttggaccttagcttttagagtgtggagtcacacaataaatctggacaaacataaattaaaaagataacagattttcataagatctgtggggggaaaaacagcattgtgattgtaatagagaacaactggggagcttcatgtagacaaggtgatcagcaaagatctgaaggagaaggttatatttgaattacaatctaaagaagaaggatttagccctatgaaaaatcagagggaagcattcaggcaaagaaaacatctagtaaaatttctaagattggaataagcttatacattcaaagactacatgggaggcagcaggcgagtgagccctgggggaggagtggtctggaaggacattggagaggcaggcagggtacagaccccaagggtctcaggtggaagtatatctgggagcaggggacaccttgcctcctctaaacactttctccaaaaggagaactctctaatggttggtgacgattatgaaaagatatggtggagaaagccctgtgagattcacagtgttgacatcagaagtcagtccatggggccagcaaaaggtgttgtcctctgtgataatcagttctatcccaaccaaaggcacagcccctccattcaccattgctgatcacaatcaggctgtgagaatcagctcgagcttagcctgcaagtcatggtcaggaactctagttgtgagtgcaatgaaaaaccatctaatggttttaggtagaggagcgcatgaccagacttacatttatgaaacatctgtgtctgctgtgcgcagaatgcttttggagacagggagaatggatataatcagggcagccaggaaggagacaattgcagcaacaccacaggtgaaggcagatgaatggtgctctaggatattgacaattagtatgacatgtggcagatagttttgtaggtagcatagacagtttttgcaggataatctgggatggcaagggacaaaaggaagggaaaaatcaaggatgattcttaggaatttgatttaggaaaatgatgcactgtggtggtgtgatttactgagatagagataagaaacaagttaaagttccattttagtcatgccaagtatgggatatctctaatctgactagagtagagaccaagttggcatttggatatagggtgagggcagcaccataaggatctgaatgtcgagggaccagactgggctggaaaaatacatttggaagacataggcacatggatgatatttaaagccatgggctgaataaaagcacatagagaatcctttctttttaataataactgtgagtatgaatttttgaacaccatgaacccacccctttccctagtataatgtctccctgaataagtggaatgttctgtatacactaaattaaacaactgtggtcttgcctctaaaaactcaaaatctaaaatagaccatgatgacatgaccaaccaagactccatctctcctcttttccctgagcctttgtagtaataactcatcctagtattacagtctgcagggacctttatatttattatgtcatttttcttttttgtccttgcagccatccttgaagtgggaaggttgtgtataatctcttatttgatggactgagcaagtctctaagcaggtatttttattcctactttaggtatatgagaatgcaggccccaaaagattaagcaacttctctggtcaaggttacaaaagtagtgagtgggattgacagagggaaagttgctctgacttcagagttctaaggggtctagttttagatgaaaacctcctggatatgtcaatcttcccaaagaaatagagcagcaattaagagcaactagactcaataagaattgagtcatttccctgctcttcatttgttagttggctgaccttggatgtaacacaagcatcatagccttgatttttcaatctgctgaacaggatgctattatctacctctcaggttatttgtaaattaatacatccatctatttactcaactatccacccactaatttattttttcatgtatcaaacgtattatatactaaactcctactatgtgccaggtaccattttaggcattgggctacatctatgtagaaaataaagcgctgcccttctgggacctgtatcctttggaggaagccatcaatgactagtcaacaaattaatacaaactagaacattagatggtgacaagagaaaatatagcagtcctgtggctcatgagaaattggggaaagcttctctaagtagggacatagacaaggattaaatgagataatgcatggaatgtgcttagcatggtgcctggcgctcactagggagccacacagtcctggaaagagaagagttgaaaagcaaacatggatgttgcccagtacttcttgcttgctgcccagcctagagagagcctctgcttttggggttctttcctcccactggctaagttatgagataatttctgaccgctttatcctatgtcattgagcatgtaatgactccaactgctgtttttctgaatctgttctcaccaaacaccttctaatcatgatttaatttctcatgtcaacctgctcacctgcagagaatattctgatcatatagttttcaagtaccggacctcggttcttagatacttttcattatatgatcatatagagacactctaattataattgggtttcctgtgtagtttggccacatggagagaatatgctgatcggatggactttgattattctagttcctgtgacagcttttgctcattgtacgttaagcagctgccatcctgattgaacacactcacctcctgaacttaggtaatgtcagggcctgccatgcggtaggcactcagtgaatgtctactgattgatggattgagacttctctcaggcccatggcaaaatcaaacttccaagggtaaattcaccagggggatgatgaacataaccctcctaggcctcccaagagccagcatgcctgtctttcccaggcatccacccactgtcacttcatagactgagcacaggggccattttttctatatcagcaatagctttgaactcttgcttcaacctattccagggttgagggggaaaattagaaagtcaagcagggtgacagcagaactgtgaagaactgtgcttctcactccaagtaagcccagctgccaggcaaattcaagagcagaggtcccaaatgcagttatatttctgggagcaatgcttccctttatcttcagagccctggaagcgcagagaaaagaaggtgagggcaggggtagggtggtgggacccacttggctcctgttgatggtaaagaagtacaggacctcaagtcctaatgacaaaagtaatagtaatatgattcacttatgactcagcagacattacacttcatacttgatcctatcatttcccttaattttacccacccaaaggccattgcatatattagctggtgatagggtttggctttgtgtctccactcaaatctcattttgaattgcaaccacatgggtagggaggagcctggtgggaggtcattggattatgagagcagtttcccccatgctgttctcatgatggtgaatgagttctcatgagatttgatggtttaaaagtgtggcacttcccactcttctctctctctcctgctccaccatgctaaagacgtgtttgcttcccctttgccctccgccatgattgtaagtttcctgaggccttccaatcatgcttcctgttaagcctgcagaaatgtgagtccattaaaactcttttcttcatagattacccagtctgaggtagttctttatagcagtgtgaaaatggactaatagagcttgaaaccctcttctctttgattcaaactgacaattttcagaaatacataatgacaatttctggctttggggctaaacaaacactacgcatgaactcattggtttctctgtgaaacagagcccagtcactttatctctctgcgcttcacaccaagagatagtgtcttgtatcctattaggtatgtagtagtattttgctgtttgctacctgtggattcattcctcctgtggttcactttctataactattcttgagggcaggacttgatgattggcaactgatagagatttccattcctctactttcccagctcactctcttctcacatttactgctggctacttgccctgtgaagccgagcagaatctggaaacttcatcttcactaagccatcaataaatggagaaaactgagtaaatataactgagacccagttgttaaaaacaagagaccatcactgatcatcactgatttctttcctacaggtcatgttgtcactcgtttcttttatttcttttttaaaaattattattattattttcataagttattggggtacagtggtatttggttacatgaataacttctgtagtggtgatttttgagattttggtgcacatatcgcctgagcagtacacactctaccatatttgtagtcttttaatcccttgcccccctctctctcttccccccgagtccccaaagtccactgcatcattcttatgcctttgcatccttgtaacttagctcccacctatcagtgagaacatacaatgtttggttttccattgctgagttacttcacttagaataatagtctccaatctcatctaagtcactgcaaatgctgttaattcattcctttttatggctgcatagtattccatcatatatatatctcacagtttctttagccacttgttgattgatgggcattttggttggttgcacggttttgctgttgtgaattgtgctgctataaacatgcatgtgcaagtatctttttcaaataatgacttattttcctctgggtagatacccagcagtggaatttctggatcaaatggtagttctacttttagttctttaaggaatctccacactgttttccatagtggctgtgctagtttacattctcaccagcaatgtagaagtgttccctgttcaccgcatctacaccaacatctactggtttttgatttttttattatggccattcttgcaggagtaaggtggtatcacattgtggttttgatttgcatttctctgatcattagtgatgttgagcattttttcatatatttgttggccatttgtatatcttcttttgagaattgtctattcatattcttagcccacttttggatgtgatgtttgtttttttttcttattgatctgtttgagttcattgtagattctggatattagtcctttgccagatgtatagactgtgaagtttttctcccactctgtggattgtctgtttactctgctgactgttccttttgccatgcaaaagctctttagtataattaggtcccagctatttatctttgtttttattgcatttgcttttgggttcttggtcatgaaatccttgcctaagctaatgtctagaagagtttttccaatgttaccttctagaatttttatagtttcaggtcttaggtttaagttcttaatccatcttgagttgatttttgtataaggtgagagatgaggatccagtttcattcttttacaagtggctagccaattatcccagcacaatttgttgaaaagggtgtcctttccccactttatgtttttgtttgctttgttgaagttcagttgtctgtaactacttaggtttatttatgggttctctattccgttccattggtctatgtgcccatttttataccaataccatgctgttttggtgactatggccttatagtgtagtttgaaatcaggtagtgtgatgtctccagatttgttcttttttcttagtcttactttggctatgcaggctcatttttggttccatatgaattttagaattttttttctaattctgtgaagaataacagtggtattctgatggggattgcattgaatttgtacattgcttttggcagtatggtcatttttacaatattaattctacccatccacgagcatgggatgtttttccatttgtttgtgtagtctttgatttctttctttttttcttcttcttctttttttttttttggagacagagtcttgctctgtcacccaggctggagtgcagtggagcaatctcaggctcactgcaactcctccatctcctgggttcaagcaattctcttgcctcagcctcctgagtagctgggactacaggcatgtgctaccacactcggctaatttttgtatttttagtagagttggggtttcaccatgttggtcaggctggtcttaaactcctgacctcgtgatccacccgcctcggcctctcaaagtgctgggattacaggcatgagccaccaagcccaaaagtctttgatttctttcagcagtgttttgtagttttccttgtagaggtcttttgactcctttgttaggcatattcctgcgtatttttttttcagctattataataggggttgagttcttgatttgattctccacttgatcactgtttgtgtgtagaagagctactgatttgtgtacattaatcttgtatctggaaactttgctgaattcttttatcagttctaggagctttctggaggagtccttagggttttcaaggtaaacaatcttatcatcagcaaacagtgacagtttgacttcctctttaccgatttggatgccccttatttctttctcttgtctgattgctccctctaggacttccagtactatgttgaagagaagtggtgagagtgggcatccttgtcttgttccagttctcagagggaatgctttcaacttttccccattcagtattacattggttgtgggtttgtcatagatggcttttattacatgaaggtatgtcccttgtatgccaattttgctgagagttttaatcataaagagatgctggattttgtggaatgcttgttctgcatctattgagatgatcatgtgattttttgtttttaattctgtttatgtggtgtatctcatttattgacttgcatatcttaaaccttccctgcattcctggtatgaaacccatttgatcaaggtggattatccctttcagatgctgttggattcagttagcttgtattttgttaaggattttagcgtctatgttcatcaaggatattggtctgtagttttcttttttggttatgccctttccttgttttggtattagggtgatgctggcttcatagaatgaattagggaggattccttctttctctatcttgtggaattgtgtcaaaaggattggtaccaattcttttttgaatgtctggtagaattctgctgtgaatctgtctagtcctggagtttttttttttttttttttggtaattttttagttaccatttcaatcttgctgcttgttattggtctattcagggtatctaattcttcatgatttaagctaggagggttgtatttttccaagaatttatccatctcttctaggttttctagtttatgtgcataaaggtgtccatagtagcctcgaataatctttttttatttcagtggtgtaggttgtaatatctcttgtttcatttgttggtaaggttatttggattttctctcttcttttcttggttaatcttgctaatggtctatcaattttatttatcttctcaaagaaccagcttttgttttatttatcttttgtattgtcttttttgttccaatttcatttagttctgctctgatcttgggtatttcctttcgtctgcgggtttgggtttggtttgttctagtttctctagttccttgaggtgtgaccttagattgtctgtttgtgctctttcaaactttttgatgaaggcatttagggctatgaactttcctcttagcactccctttgctgtatcccagagattttgataggtggtgtcattattgtcattcagttcgaagaattttttaatttccatattgatttcatttttgacccaatgctcatttaggagcaggttatttaatttccatgtatttgcatggttttgaaggttccttttagagttgagttccaaatttattccactgtggtctgagagagtgcttgctataatttcaattttcttaaatttattgaggccccttttatgtcctatctaatggtctatcttggagaaagttccatgcactgttgaatacaatgtgtattctgtgcttgttggatgaaatgttctgtatatatctgctaagtccatttgttctaaggtatagtttaaatccattgcttctttgtggactttctgtcttgatgatctgtctagtgctgtcagtggagtacagaagtcccccactattattgtgttgctgtccatctcatttcttaggtctattagtaatcgttttataaatttgggagctccagtgtcaggtgcatatatgtttaggatagtgatattttcctgttagacaaggccttttgccattatataaagtccctctttgtctcttttaaccactgttgctttaaagtttcttttgtctgatataagaatagctacccctgcttgcttttggtgtccatttgcatgaaatgcctgtttccacccctttactttaagtttatgtgagtccttatgtgttaggtgagtctcctaaaggcagcagatggtttgttgatgagttcttattcattctgcagttctctgtctttcaagtggagcatttaggacatttacattcaatgttagtattgaaatgtgaggtaccattgcattcatcatgctctttgttgccagtgtactttggttttgttttttgtttttgcttgtaacttgtatttttgttttataggtcctgtgtgatttatgctttaaagagttctgttttgatatggttccaggatttgtttcaagatctagaactccttttagcagttcttgtagtggtggcttgataatggcgaattctctcagcatttgtttgtctgaaaacgactgtacctttccttcatatatgatggttagtttccctggatacaaaattcttgactgataattgttttgtttaaagaggctgaagatatggccccaatcccttctagcttgtagggtttcttctgagaaatctgctgttaatctgataggttttccttcatgggttactggtgctgctgtctcacagctcttaaaattctttccttcgtcttaactttggataacctgatgacaatgtgcctaggtgaagatctttttgtgatgaatttcccaggtgttctttgtgcttcttgtatttggctgtctaggtctctagcaaggccagagaagttttcttcaattattcccccaaatacgttttccaagctttgagaattgtcttcttcctcaggaacactgattattcttaggtttggtcatttaacataatcccagacttcttgcaggctttgtttatattttcttactccttttactttgtctttgttgtggattgggttaattcaaagaccttgtctttgagctctggatttctttcttctacttgttcaattctattgctgagactttccagagcattttgcatttctaaaagtgcatccaaagcttcctgaattttttattgctttttctttaagctatctatttcattgaatatttctccctttacttcttgtattatgttttggatttctttgcattgggctacgcctttctctggtccctccctgattagcttactaattaacctccaggattctttttcaggtaagtcaaggatttcttctcggtttggattcattgctggtgaactagtgtgatttactggggggcgttgaagagccttgttttgtcatattaccagggttggttttctggttccttctctgggtaggctctgtcagagggaaggtctagggctgaaggctgttgttcatattttttcgtcccatggggtgttcccttgatgtagtactctccctctcttcctgtggatgtggcttcctgagagctgaactgcagtaattgtctctcttctgggtctagccacccaaggagtctacctggctccgggctggtactgggtgttgtctgcacagagtcctgtgatgtgaactgtctatgggtctctcagccacggataccagcacctgttctgctggaggtggtggagggtgcaatggaatccgtgagggtccttagctttggtggtttaatgctctgtttttgtgctggttggcctcctgccaggagggggcgctttccagaaagcatcagagccgccgctgtgtcccctgccacagccccgagtttgtttccaggcggagggtgagacgggcctgaaaacttgcccaaggccatccacctcccagctgcgaaagaaagggctttagttcttccctcctccacctgtgacgtctgcactccggatttgtgccctcccctgagttcttgccaggaggcttctcagctcattcaaattgttacaaagttcgactagagaattccttctccctgtggagttttaccccctgctcctctggccatccttccaatggatccttgtggtgccaggcaggaatgggctgcttggggacctaggaagcccccagggcctttctgctgcttcttctaccctcccccacacctttactcgactcactaacttgactcagctccaggtaaagtcagaaatttctgcaaacagaccttcagcttctccagtgggggtgtgtgtttgggagaggagggtctccctttctcagttccgcagttggggcactcaatatttgggggtctctcgggtcctgcaggagcagtctgcttcctacagagggtctgtgagtcctttcgggattgctggtttgttcttgcagttctgaagctaaaattcacaatgcaagcctctgcatgctgctctgtctagagctgcaatctggtcttgcctcccgtctgacatgatcccaggagctctctgagagagcaacccaaaggagctgagagagatccggagtccccgatgtgagggagcatcaggctgcaaggacgcggcactggcgatggtttcgcaggggcatctgttcccttggggcgtggaatccctgctctgccgctgccccaactcggctccgaagtgcctttgctgcaagatttcctgagcttagcagtctgcccgtttcttttctttctttctcttatttttccccctgaatgtttggtttctctggcaagcccaaacacgtaagattatatgtgaggcatatttatttacataaagatgcgtgttttttcttaactcagcatttacatgtagcttggccaagttaattaactgtagaagacctcaattttgttgtcttttaaaacaaggcagctgtattagattagtggttttcaaagtccgttagatggtaaagtgcctgcaagccatggcctgctttgtgggataccatgaaatattaatacccagagctagacttaataagcacacgtataattttgtgatcccaaatactatcttatatatgattgtaatagagacaaaagttagcatgtatggagatataaatcattaattcattcatctatcacataagtgttattgagtgcctacacaaatgtttctcaaaccagcattcaccacctggagaacctattaaaatacagatcactgagccccattcagctgtttaaccgacgatgctcatgttggttcagctgatctgggaaccaaattttgagaactgctgacctccactagtccagcccacgaattggcaaactacagcccctgagccaaatctggccctttcttctttttgtaagtttcactggagcacctcacatttatttatgtattgtccatagcagcttttgtgccacaatggcagagtttagtagttgtgacagagactatggcctggaaacctgcaatattatccgtgattttccacacaaaaatctgcattctgggttttgtatgcaataagtcatgtacaaaagtatggagctgatgtcctgatggagcttacattctaacagggcactaaaaatttagtgagatttaaagaaaagttataagagaacatcttaattgaggtattctactttcaattattcgtaaccttattattatatatttacttcttttaaggataacatcttcattcatatttctataactctagcgcatgttccaatggcttcaagtttgcatgattaaaatatctctaaactattcttttcctctcagtactttctcctttcagtgtattctaggtaacatttccagagaaaatatccttaatatagttatgaattgatgattgcctccagaataaggttttttaaaagtaattttgactttattttagattcagggcgtacatatgcaggtttgttatgggagcatattgggtgatgctgaggtttggggtgcagatggtctcatcacccaggtagtaaatagtacccaataggtagtttgtcaggctatgcccccttctctttctccccaaccagtagtccctagtgtctattattcacatctttatatccacgagtactcactgtttagctcccacttataactgagaacatgtggtatttggtttcctgttcctacattaatttgcttatgataatggcctctagctgcatccatggtgctgcaaaagacatggttttattcttttttatggctatgtagtattccagagtgtatatgtaccacatttcctttatccagtctaccattgatgggcatctaggttgattccatgtcttcgctattgtgaacaatggtgtgatgaacatacaagtgcatgcatctttttggtagagtgatttattttcctttaggtatctaccccgtaatgggattgctgggtcaaatggtatttctattttaagttctttgagaaatctccaacttgctttccacagtggctgaactaatttacattcccacaagctgtgtataagtattcccttttctctgcaaccatgccagcacttgttatttttttaagtttttgttaatggtcattctgacttgtgtgagatgatatttcattgtggttttgatcagcatttctctgacgtttagtgatgatgagtattttttcatgtgtttcttggccacttgtatgtcttcttttgagaagagtctgttcatatcctttgcccatttttaagggatttgttgttgttgttgctgttgttgaattgtttaagttcttatagattctggatattagacctttgttgaatgcataatttgtgaatattttctcccattctgtaggttatctgtttactctgttgatagtttcttttactgtcaagaggctttttagtttaattagatcccacttgtcagtttttactgttgctatcacttttggggacttagccataaattctttgccaaggaaaatcaacgttatttttcacagaattagaaaaaactattctaaagttcatatggaactgaaaaacaaaaaaagagccaaaatagacaaagcaatcctaagccaaagaacaaagccagaggctttacgttatccaacttcgaactatactataaggccacagtaacctaaacatcatagtattggtacaaaacagacacatagactaatggaacagaatagagaacccagaaataaagccacacacctgcaattaattatctgatctttgacaaagttgacaaaaattagcaatggggaaaggacaccctattcaataaacggtgctgggatagctggctagctacatgcagagcatgaaactggacctctgcctttcaccaaatacaaaaattaatccaagattgattaaagatttaaatgtaagacctcaagctattagaattctgcaagaaaacctaggagatacccttcttgacagaataaagatctgttctaattattccacattgtgacaccaaaccatgaccactactatatcttccacctgacatttcccacagtctcagctctgcatggacctgcccagaatggagatagcaatgggcttaccatgttgacacagcctctgtcacttcctattttctctctgactcaggaaggagtcacttcactcttgtaattcttctgccagaaccctggaggtatcttaacttacaacccccagtctataaactctccactaaagccacactgattgactcaccatcttccaaataaactttattgattatttgctactaatatgagttactgatgactaataacagattatctcaaaattgtgttcttaacacaataatagattttcctttttaaatcttgtagtttccgtggggcagagtctggggagtggcttattttggtagttcttgctttagggtgtttcatgaagttgcacttacaatgctgatctggattattcatctgaaggctcagctgggtctacaggatcctcatacagtgaatgcaccgttgagctggcaaattggtgctggtattgctttggacctcacctcatgccacggaggctactcctcacagagcaagtgaggcaagaaaagaaaacataagccacgatgtcttattttgtaaatttttaaaatttactttacagtgtcttttaagatatagccccagaaatcacactctattatttcagcaatattatatttttgacacagatcagtcttaattaaagtggtaatgacacaggagcatgaataccagggggtgagaatgactgacaccatcttggagccacaccatcctaacccctcctactctagtcagggcttttgcctttgctattgttttcctatttgaaatgtttgtttgtttatttatttatttatttatttatttaatttcctaaatctaaccaccttttaatgctcatttctgttccatcttccccgtgacaccttctctgaatcctttagcctgaagaaattgcatcttccattgttctcctgtggtctcattatcaatatcacacattttagcagttactcacagataggaaataattcctgttcacaaataaaacattctgaggaactcagttcttcctattcgaggaaatcctccactactactacaaaaacctgcataaggcattgaaaaaaaaccctccgttagagattgagctgtattgtagtacataatatagtatgagtaatattaatatggtgtatttgatagatgttagagatcagtgtctaccagagcagtactactcaaacttaaatatttatatgaatcatgtagggacctagttaaatgcagattgagattctgtgggtataaggtggggttgagatgctgccattctaacaagctcccaggtgatgctgaggctcctggtccatggaacaacttttgagtagcaaggtgctagaagatggacataaaatggacataaaatagaataggagttgaaagtagatggaaaataaaagtagtgaagagaatcatggctgtgttcaatcagtagtactggcaaggcataaatatttgaagtcacgaatcactcaagtatttctttattgctctttggtactgcccattatctttatacatgcatgtatgttttacctcttccagccttgattataggcccctttaggattgaaggtgttccagtcacccatagaggtgaaatatagttccctttctggagtagttgctcaataaatgtgtactgcttgattactctgctgctaattctcacggtcatttattaatttctattattacttccccaagttttctcctttcaaaatattataggaaattcaaaatacctttctattataaattgatgtgttttatttacagttccttatgatatataatacaattcctcataaaaaaataaaattttagttggtctaaataccaggtaaattaacatgatcaaattaatagaaaaagtatcatgcccaggtaacatgtcagaccaattaaatcagtctttgagagaggattcaggtattggtattttttaaagccccatgggtgattccagagtgaagcaaaagttgaggatcaccagtttaattatcatcctactatattttaagatagaataattatactttattttttattgtgccccaaagcattttttttttaaatggagtctcactctgtcgcccaggctggagggcaatggtgcgatctcagctcactggaacctcggcctcctgggttcaagcagttctcctgcctcggcctccccagtagctgggattatagtcaccctccaccacgtctggttaatttttgtatttttagtagagatgggtttcaccatgttggccaggctggtcttgaactcctagcctcaaatctcagcctcccaaagtgctgagattacaggcacgagccatggcacccagatccaaagcatcttttacaacatgtaatttggaaatatcaatgaagaccaattcagagaaaaatgtttaccttcctttttttttcttacaggatgtagctgcttcaatttataaataagtatagatatgctatagtaatttttgaaattctatagcaaactaacttttccataaatgaatatggtttcttaattatcccaagcttgttaatgtaggttgtactttttttcttttagcaaacacatcagatcattttgccaaattatccaagtcattttaaaaacataaagatattttgcaaatattttatatctgccagtcaaagtcagtcttggtcctaaataggatgttgttacatgcctgccttataaatgttagcatcacggaaagcatttttgtttaatttagaaatgtttgagctcagaggaaataaggatacttatctcgtttactcagctttagtaactgcaaaaggcagaataaaggtagcttgctggagttgctagaacccacatacagtcagaatatatgacctctcctttaagctctgcctcttactagctgggtgacctttggcaagtctcttaacttctgttagtctccattgcttcatttgtaaagtgaaagggttgaagtagacggcacataagattcttatacctggaaagtgatggggtgagggactactaaggtcctttgagtgcttcttggttacgcactgtgagaagtgatggaaaataattcacactctcaaaaattccatgactctataggagaattttcaagtgaacaggcacaaagtctctagattgttaaattaagcctatgaaaaatgaaggaacataaaataaaaagagagtaattgcattggttctgattctctcatagaaaaggaattttacacgtcgttaattccaatgctttgtattacagatgaggaaaccgaatcccaaaaagttcaaataactttctattactaacacataaaatagcacactaataggggatgaaaatttatccagtttaacaatccagtccttcatgtcaatcaaaagcttctttatcaccatcataattcaacatttcattctgtattgagaaggaggtggatctaagatttatatttatgatattcatgataattcagagtttctgaaactgacatcacaggaagattttcacaagtgggccaggatgtgattcatgggccctgatgttacaagtccagattggcaaaccaagggctgctatcaaagggactaagttggatggctttctggataaatatttctttgtagctggatttacaaaggttatcaaccctccagataaaaagtcatggttcttctattgccctaagagtcatagatagtaagttacacagtaacatattcattttatgtatatacatacatacatatagtcatgtatagtaaattacatgaaaacatcagtggtgccatacactcacctgatcctgggtgacggaaacgagtatgaggaatttaagtagtccttctcaaagtcttccccagagatcaattagctcatcaccattttaccatgagggtatgctcaggggagatatgtaactaaagtcctgataacttgtaccaggtgactgtaaatcattcagtattcagttagtcaacaaaatcaacaaataattatcatgcctctatagtataccaggcacttgctgggcactgggaatatggtgattaataaataagactgtccatgcccccagcttcatattctagtggaaagggaaagatatcaaaacatgtttgcaaggctgggcaaggtggctcaggcctgtaattctaccactttgggaggccaagtcgggcggattacttgagttcaggaatttgagaccagcctggccaacatggggaaaccccgtctctacaaaaatacaaaaattagctgagcgtggtggcgggtgcctgtagtccgagctgtttgggaggctgaggcaggagaatcacttgaacctgggaggcacagagtttgcagtgaccagagattacgccactgcactccagcctgggcaacagagtgagactctgtctcaacaataacaaaaacaacaaatacttacaaaacgtaaaaaaaaaaatccctttagatatttattagtgtgataagaaagatgagaaagcaaatgccatagagaatagagggtgaagagcaaaggctgcatggtgtgagtggtcaccgagttcttctcttaaaggcagtgatgcttaaactcagttgtggagagggacgcagtgtcaccaagttctgagggaaaagtgtttcaagcagaagaagcagaaaatgcagtggtcctgagatgagaatgaggagctctgcacttctgccagaagaggcattgtaatagtattggagatttgaaatcgttattttactcaggcatttattaattaatatattatttattcatcaaaatacatgttgagactactgtatatcatggcctattcaagacccagttcccctgcccttgtgcagcttagttcctggtgggagacacagacaataaataatacccatagtaaaaagcaaattatataatttgtaggaaaataaggactatggaaggaagaaaaatttgggtaaggaggaccaggagcctggggatagggaggtcagggagggcttggctgagaaggtgacatgtgatgcaactgagggatgtgagggaattagccatgcaggtaggggaaagagcatcctgggaagtggggacagagcacagacatgctggagaaacagcaaggaagtcagggaggcggaaacagagcaagtgaggagaagatagtgggaggtctcaccagagagggagccagaccctgttcaataatgcctcgacttgagcccagcatgctggctcacacctgtgatttcagcactttgggagcgaggcagtaggattgcttaaggccaggagttcaagaccagtctgggcacaatatcaaaaccccatctctacaaataaaaaataaataaattagctgggcatggtagactggacttggtggctcacacctgtgatcccagcactttgggagctgaggcaggaggattgtttaaggccaggagttcaagaccagcctgggcaaaatagcaagacctcatctctacaaataaataaataaattagctgggcatggtagcacatacttgtagtctaagcaactcaggaggctaagatgggaggatcttttgagcctgggagtttgaagctgcagtgagctatgactgcactccaacccgggcaacagagtgacaccctatctctaaaaataataataataataaattcattgaataatgccaggagtttttctctgagaggagtggataggtattacagggttctttgatggcaaagaaccgaggaatcttattatccccacctataggaaaagcacctagggaggctggctttccatgcagaggaggaaccaccagggggcggtgcaccgcaaagtcgggctgtggtggccctgcagatggcggtgaacgggaggagcaggctggcttttccaggctcccgctatctaataagtgaatagcattgcttttctgggaaaatctttttaaatgttttttaatatagaagacttttaaaaacattgaaataataactgtacctataggccaggtgtggtggctcatgtctgtaatcccagcactttgggaggctgaggtaggaggattgcttgagactaggagtttgagaccagcctgggcaacatactgagaccctgcctctacaaaaaataaaaataaataaattagctgggcatgatggcacaagcctgtagttccagctactcgggaagctgaggtgggaagattgcttgagcccagaagttggaggctgcagtgagctataattgcaccactgcactcccgcctaggtgacagagggagacctcatttccaaaagaaaaaacaaaatatattataatatttatgaggtatgtacagagttttaatacatacaatgtattaaagatcaaatgtggataattagcatatttatcacctcaaatatttgtttgtgtagagaacataaatcctctcttctagctatttgaaaatatataattgtttactgtagccaccctataatactatagaacactagaacttatttgtcctatcaggctctaattttgtattctttagcaagtctctcactaaccctccaaccctactacctaattctcagcctctagtaaccactgttctactctctacttctataaggtcaacttttttagcttctacagactctgatttaaaaacgggctaatgatccgtacgacacttctcaaaagaagacatacagaaatggtcaagaaatatattaaaaatgttcaacattgttaatcaccaaggaaatgcaactcaaaaccacaatgaggtatcatttcaccacagttagaatggctattatcaaaaagacaaaaaaaaaaaaaaaaaaacaattgcgggtaaggatgcaaaaaaagtgaacccttatacactgttgggattgtgaactagtacagccattataaagaataatattgaggttcctcaaaaaactacaagtctagatggctctttgacttcctaaaatgacaacagcaagctatacacagaattaaaatataaacatactcccaaagccatatataaagtacctgaggcagtccataaaattttaaatttcaatagagtactaatttaatcagggaaactttatctacggcattttttgctgtctccattaagcatgttatatgggctctcagaaccctgaagatcttcatccaaaagggaagttatactctcattttatctctaacagatgtgggcatcaagtgtttatgggcgtgaaaaaggctttccattaaaggaaaccctgtcaagtagcaggattttcttttattatgttgttttacacacaaaacattttttttgaaatcaccaagtctgcataaacctgaaaaaagcaaagtagtattttcataacacatatttgtctgtcactgctgtttttggcggaaattgtcccaacgagatctttgagttaccggtttctaagtagcctccagtcttgaccttccagaggcctcaaggacaatgatgtattggcccccagagactacttttggggctccagcattttgcaaacacatgagcaaagttttcttttcctgaagtcattttatttatcttcgctgtttccttccgcagccctttatagaaacagaattaaattgtattgggaataacaaggaggaaaaataattcacttatattttattgctttaatattttgtattagcattaccagtgatttatgtttcctgctccggtgtccccgttttgaattctccaagtctgtgaagggtgttgaagacaggtaatcggtaaataggctttcaagggagaatgtgtataggtgtgggtgaggtgaattaaggcttattttctcattgatctttcgctttgctttccaaagcagcggacactgggttgcacatctctgttcagttacagggaggggagggaatgcccagtaatttcttatctcgtggtatgttaattgctaaaatataaacaaaggtaagaaaggtgctttgtgcaggtgtaagtctctgggcatttgtccgtgactcacttctcagtatatcaagaatgatttctttcctccacagactaaccaagccttaactgtcaggttagccattctcatttctccctgcttggcctcgatcagctgctggccttccccgggagaaagagcctccatttgctatgagctccttgccggatggagtgattgccagcacatcccagtaagactgcagcaggtgctgcagcttggggaaatggcgtgtgttttccttaccagtacatgtggcttttgagctttgatttcacagaaatgtaaaaaacaggtcgatgctagtatgtactacattcctaccagcatacactttcaatccactttctgacaactggcttgtatcactccctgctttagagtaatagcacctttgcttgaagtttcttaggtgaaaatcatgaaggttcccattttgctgaatctctgtgttactgattaagagagagtaactgcgacaggggtgggcacctgacaacattttctaaataacattagcatgttttttcctcttcagccccctgggtttcaagcatttgatttgaatttttttccctactccctttcttaaaatgcatgactaagaaactgtttctttcttcactgatccttggttattcgctttgaaaaaagacgacagaacaagagtatttccaagaatacaccagtcctattctttggtgatgccactttctaatttaatgtgatccagcagccaaaatgttgttctaactaacatatctccttgctaaaaggtataaaacaggcatcttcaaactatttcttaagaaggctagagtcaatattttaagctttgtgggttgtactgcgtctttctcaactgctcaactctgtgttgtgcataaaaaagcagagctgtgttccaataaaactttattcacaaaaacagatggtgaactggagttggcccacaggccgaatgaccctgggtttggaagatgcttcttggaacttctggcccagctggtttccatctgcctttagctgattaagaagatgtggccaagggttccactgccacctcccccaccactactaatttttactgatcagattacacatcttatttttcactctatttgttctagacctatcactaacagggcaggcaagagccagggaagttgctcttaaaaaaaaataaaagacctggaaacccaaactctctatactgtggctttattttgtcatccaagcttggaagggcagctctcattttggcttccagtgcctgtctccattgccatttctccctctttcagtcctggcaggctgagagctttatggtctcctaaccttgcctttgcagcatcactagccctggtaataagaacaccatccatatactagccctttgacaatgaagaaagctgtccacatgtcttacctgatgtggtcctggtccaatcatttaagtaatttttaaaaattattttctgttttgacaataagaaaacagccctggagaggctgaatgacttgcttaagattctgcatctcatatgcagtgcaactaggcttcacctccactattctcactctaaatcctggtatctggcctctacctggtactgtttctcagtcctgagtcattaagggtctggcttcaggcactcctctgtcacattttttcttggatagattattaataccctgagatgccagataccattctgcagagagaagaagaaagccacagaaagccgttcaggctgagaatgtttaaaaatatatggtgctgaccaccaataccaatggcagcagaggaggatctttagtaaaggattttcaaagatatagagtctgtatctcagagtttaaaaaagaccattgctatacaagatgctccgatcagctctggttctcagtacttataaagcagcggaatctcctgctttatgaactttagttctgggcttcagctctgtattagtctgttctcacactgatgtaaagaagtagctgagactgggtaatttataagaaaaagaagtttaatttgctcatggttctgaaggctatacaggcttctgcttctgagaaagcctcaggaaacttacaatcatggcagaatgcaaaagggaagcaggcatgtcttcacctcgatggcaggagagagagagagagagagaaagaggaggtgctacacactttcaaacaaccagatctcgtgagaactctatcatgagatggcacaaggaggatagtgctaaaccactagaaaccacctccttgatccaatcacctcccaccaggctccacttccaacattgggaattaaaattcagcatgagatttgggtggggacacagagccacaacatatcagggtctggtctggtcaggggtaggttgcaggagactagggaccaaaatgatcttaccaaagggtgaaaaggtaaacacagaagttaaacagcaacactgaaaactcatagtccatgaaatccaaggggccaggagggaaggctgaaggttattaagattaagaagatcaaagcggaagacaaagttgggatatggagccagcagtagatgtgttctagtaaacacacacacatatgcacacacacacacacacacacacacacacacacacacacacacacggtataaatgatggaaaaagaggcagtggtttataaccatgccccaccagaaattctacctggccctaaattagtgtgtttaactatgcacattaaaaataaccaaccaaacaagcaaacaaaaaccagtcaacccaggcctgctgatatatctgcttatctccttggcaagggccaaccacagaactaagatgatttaagtagatctgtaaggtttctcttcccctgttttctgagtagagaaattcactggaaatgggattctttgctccactaagaagtccctggctcctgccactatccctttcctgcataattgtcttaaatcctctggtaaaggacattttagccaccttcttccagaagctacttttaaaaatatttgaagtagagatttgaagaaaagtggaataagtagccagaagccaaagatacttaagaaaccaagcagaggctctttcctgctaagaagaaaagttgggggatggtaagacaaacagagaagctgggtagttgcttaacgagatatagagcttttaggcttgattagggtcttaacaccttcctcatagggaagcactcactctgaatctaatgacattgtattcctatgacacatcaataaaatgcctacaggagaagcatctttgtacaaacttgtgccatatactttttaaaaatttttactaataaatatgtgtcatatattttactaatatgtgccacatactttactaatatgtgccatatacttttttattcctactaataaatatgcatatataaacatgatatagatatatgtgatctatatatgtataaatatatactgtgtgtgtacaagtatacaaattgtgtatgtgtatcttgtttaaagttccccagttttttcaattaaatactcacgaattttaaagagatcaagaagtcttctggcacttagaattgcattctactcaatgatatattgtaggtggaactacatacacattgttacattgttacaggaaaatgccagttaagatgttgtttaggaagcaataccaagggttcacaggtttatattagaaattagtgtctttagctcctttctgttgggatttaattttatgtataaaatgccattatgtccaaatattttataatgatgagaaaaccagttcactttggattatcttcattttttagtgtgattaaaaaaaaatctggctgcaattcttgtgcattagttaagaatgtgatggtgtgcagtcttttaagtcatgtcagcaaacgtgtatttccaaggtcagctctaccaaagagaatagtatttcttttgcaaccctgatcttacttggggatgaaaacaattattgcctaagttagaaatgtaaacacattaatgcaaaagaaaaatcaacaaaaacttatagtattaaaatgcacatcattttatgtgtgtatgtaaatgtatacaaattttactgatgtttttgcataaaaagataatcaaggctccatcactaccaaatttttagacatttagaaaggaactagacagtattttgtggttttcctgtctatgagataagttttgccagtaaatcaaacaatagtgcaatagacatgttgcatatattttgttagtttaatacctctttatcagcacttcatttagggacactctgctaattttacatactgtatgtcttaattaaataatgctgataattggaacgagtacaatgtattgagaacttatttgcctgccaagccctaatcgaagtgtttgatgtttttgttattggtcatttcatcttcgccatctttggaggtagatcattttatcaccctcattttacagataaaaagattcaagacttgctctgcctcctccaagcttgccatgcatatagtgataaacaatttaaggttatatcaacttctttaaaagtactaccccttcacagtaggttggcatttttactccaaattatgcaaggtgttatggcattttacattataatagcacagaaggtaaataaaactattaaattatttatcttcattcattacagatactgcaagagaaggtcaactgctaattctctttcaaccagcctgaagtagtgactaccattaaaaataaaaactatttaaaaatttgtcccaaatatccgcttaaaaaatgctttctgatcagttgatttaaataacgttatttggcaattgaaaggcttgttttgcaaactgttagaggaagaatctctcctacgaatggttttattctgtagtaaatgtctcctccagatacatggatttttaagccagtgtaaggtgtttaagacatggtcgattctagatatgtgttcgcattttgattacaagcaaatgttccagacccatttctatatttctcggacttacttggaaaggcaccaactaaagcagctgggagctgctggagaccattttaaatggttagttttcaggagattagcagggagcactgccttttgtactcaacactgagtttgaggtttttaaaagtgcacaagctttatactttacccccaattctattttacagtgttttaaaaaactttttttgttgagtcaccttattctttttctcgctcatcacaagacaaccctacttttaacaagaaacaacaaaaagaacagaaaagaataaaaactcacagtgaaagccatcaacgggttttctttttctgagcaccacttttggaggcattatcctttataacaggccctaagtgaaaaggaggaaaaagaaactttacatgattaggaaaggctgggaatgaaagatactgaaaggtgtaatgggaaatgaaaatatagtgatagaaaaggaaaagtaattctctgttggcgacaatgttatgttccatgacctgctcacactattttcttgtggacagcttcctcaaatcccattctgttgataaaagcatattaatatgatcaaccatgaaccagcaccaactgagaataccacttctctaggttggttgtaactgtttctttctgacttaaatactaaatatatcctctgaaataattacagttgtttgttacatccctttagttttagagaaaaattaaaactctcatttcttccttaaggaggctagggctaataactggagttgtatttctttttcattgtaagcccaatcaatttgatttctttttctcctaaatgaaaacataggctaaggccagcaaaaagccataattgggtgactaattaaatagtcaggcatctacagcctggtagagttcagggcttcctagttgaaggaaataaaaccataaactgctatctgtgacagtgtatatgaaagaggtgaaggatagagctgttgtgttcactggtggatggaactatgtattcatataactgcaagatttatggagataacatgattgggaaaatataaaacattaaatagattatgccagaagtcttgcctccaaatgtctaaatccttcaaatgtgtcattgccactacctgtggatcaaagaacaaaacagggatgtgagcgtgcagccctaatctagacacctgagacatgaggagtgcctgccaggaagaatttagaaggagcaggccaggagctaggaggagaaagaagaaagggtgacgtggattgtcaaatggggcctgagaattgacccttgcattgggtgaatggaggaccttgggaacagctactttggtggaattgtagggagggagcctgattcgagtgtgttcaagagtgactggaagcaacaaggacaggcaactctttcaaggagatctgctgtaaaggtagagagtgaacagaagcaatagctggcatggaaaatgggatcagcaagagtggttggacacagaaaggctgacaactagtagtggaaggtttttgatattgtggtcctgaaatgtcctcatagcatgttaatgtccatgttttttattgtgttttctctctttttttttttttttgttttgagacggagtttcactctgtcgcccaggctggagtgcagtggtacgaatttccggcccccaggttcaagtgattctcctgcctcagcctcccgagcagctgggattacaggcgctaatttttgtgtttttagtggagatggggtttcactatgttggccaggctggtcttgaactcttggactcaggtgatccaccagcctcagcctcccaaagtgctgggattacaggcatgaaccaccgtggatggccttttattgtgttttctaagcaaacaggcaagttattctttaatctcatttccttgccataaaaatatagcttaatttctaccaaaaacattggctcccaactgtatattaattatgattatgagttttaagtgacaattgcatttttacatagaggtaatgccgaggacatgaagttattttggatttcaggaataggtagtatttgttccaagccctgtggccatgaaaagccatctttgttcagtcctcaccaaggcaatgtagggtggataagcagtgtagggtggatcaccaaggctaggtgtggatcagcaagccttcctccttaaaaccgactctcagtcttgaacgcccagagggaagaggtaggaagtactgtttttcagctgtgatttcagaagtccacggatatttcaaaatcagcagtctccatcttagatccatgacttacgggggaagttataccccctaacgatattgcagaatagtagtaaatctaatgagagaatatatgagaagaactaaagtctgtccttcgattttccttgtgaccttggataagattgttggttatcatctgtcagctcagtggcccttctttggatgttaagatggtggtattaaccaccagaaatgttttcaaaaggcactctgcacattaaaggttctaattatccttcttcaagctagtgtcagtgctgattattaaacagttttctaatcctaactggcctgattttttttcaatgcagtccttcaaattatccttttgcaatgataaatctttcctaaagcatttaattctgcacacagagaaataccactgcttactcacgaatgctactgaacaaaagctatatttatttcttgttcaggttgtaaatattagaaatttatggatgatgatttcttaagaaataagcactataggctctgcaatgactggcagttctgttaaaagggattttgaacaagctttgaggcagagactcctgcagaagaatttatgcactttgccgactctaagaaggtactgcagcaaactaacagaaatttacttgttttcagcatgctgtcatagttgtgagtgaactccagagttttctttactgtctaagcagtctttgaagtcatctatttggtgattagctgtgatatgccttcctaattagggaaaagctattcaatcatctcctcacagattcctccaaaagcttgttttgaatctcagaaatgaccaattttaactaagcttcaatgaaatgacccacttaataaatttaaatacaatcaccaaaaataaatgttggtttgcttggcatcatgtctttccatctttttactttcttttatttttaaatttatttatattttttattgacacataataattgtacatatttacggggtacagtgtgatgttttgatacaggtatgcattgtgtaatgatcaaatcagggtaattagcatatccatcacctcaaacatttatcatttctttgtgataggaacattcaaaattctctcttctagctattttcacatatgcaatatctttttaattactacagtcactctactgtacaatgggacatcactacttactctttttttctaattgtaactttgtacccattgaccatcctctctttatctcccaatgtcccctaccctccccagtctttggtaatcactattctagtcactactttgataagatcagttttttagctcctacatatgaatgagaaaatgttgtatctgctttctgtgtctgcttatttcacttaatgtaatatcctcaagcctcatccacattgtcaaaaatgacagaattttattattttttatagccaaatagtattctattgcatatatttaccacattttctttattcattcatctgttgttggacacttaggttaattccatatcttgactattgtgaatagtgctgcaataaacatgagcaggcagacatcgctttgacacactgatttcattccctttgtatgtatacccagtgatgggattgctggatcttacagtagttctacttttaattttttgaggaacctccatactatttcccataatggctatatactcaaatttcatttttaaaaattttacatatcacctagttatttctctatccttctgccttctctgcactaatcacaaattgccctaacccagggtttcaattgatagaaccaaccgctgcatctttacacgcaacacattggctgattaaaaatcaatgcctcgttagagatgcaatttgtgttttgattagtgtttcggttatgggtttcctgtcctagaatgtctgccttaatcaactatttttgctttgaatcaccctggactattggcagtgagaggtacatctgcatgagtctccactgagaggcttttcttcctatttatgatacctctttgttcaccaaagggacaaaaattctggcaggtcttaattaatgcctgatgtaaagggatgattaagacatataaagccatggcttctgttttagcttttctaaaatgaaaatatagttgagagaagtgcttttttcagtagggtgtagcaatcaaaatcagcctggttcattgcatagttgtttgatttcctggacccattatgttggggttctgtgttttctttgttagtgctgtctctccactgaactttggtcagatattggggggttaattaatgcatttccaaaatccagaaaatatttttaaaacctcaaatccatcttcatgaaaacttttggctaatctatgttaagtaagtctcataacctacacatgggtgggcagattactctgtagaaagtaccttcatggcatgccatgagcatatcactatccttaaaagcacattcatggtgctggcttgtagacgtgcttccagggacattgcattgcaatggtctacatatctgaagtcttgtaacccatgagcatatgcaagaaagtttttcctcagaagcaattggcttgttactcacagacttcacagaatcgtcttgcaaatgttgtaggtttgccaaaatcttctgttaagtgatcattttgctaaaagattaacttcccaaatttctgtgcacttttaaagctatagtttcatccttgaccctttcttgatctctgttgtttttgaagaagtgtattttttagtacaaaaaatatatatcattgtagacaactcataaaatactaaaaacaataccaacgtgtccacaatataaagataactactgttaacattttgattgatttattttagaattttttcctaagttaatgtaaataatcatttttaatttatttttatcacaaatgagaatgattttataacacatattttagggaaattttcttttatctgatttataccctcacagtgtgtgtatgatttgtgtattttgggtggatcacacaaaccctatacataaaagagtgcatagaatgtatctgaatagtttacagaataattatcaaataaatattcctgataaccatcatccttgccaacaataattagcaaaacaggagcccctgattgcgtcacatttttcttctctaaaaataactactgtcctgacttttatattctactaggtgtccctaaaaatacagcatgtttttattgtttttgaatcttatataaatgaaatcatattatatgtattctttaccaaatttctcctgttgcttaaaactacatttgtgaaatgtattcaggttgttgcatgcaactttaattaatttgtctttaatactctatggtattccattgaatgaatttgccataatttatatattcaactttctcttaatagtcattaaggataatttcagtttagggctcttaactggtaatggggctatgaatggtttgggacatgtctgttagagaatatgtgcaaagttttactaatgtagatgcttatgagtagaattcccagggcatagacatcttcagttttgctagacaacgcccagctgtttcccaaggaggttgtaccaaattgacacttagaaatagcagtttcacatcctcaccgacattttgctattatcagatttttaaaaatattttgagaatctaaggtatgtataattttattagaaaatagattaacttggcattctcaaattactactgagtttgagcatatttctagatagcactatattaatcacttggatttcctttttgtgaagtatctcttcaggtctttgatccattttcccccttgttgactgtatttttcatatttatttgtagtagctatttatttattctgaatactagtactttgccaggtatatgtgttataaatatattttccatttcagtggcttatcttttttttattttactctttgcatgatatctttgataaagtgaattttataattttaataaaattgacataatccatctttctcttattctgtactcttaatattctatttcaagagaatttcataactctgaagtcatgaggctatcattttgtattatttctctaaaagctttgcagttttgcctttcacttttacatctttaatcgacctactattgtcaaggatgaactagagatatgattttatttcttttctatattaatatccagttgtcccattgatacttactaataagttcattctttcctttgttatgtgtcaaatgtctatttacctgcaaacgctctgtttcagtccttacatcaacatctcttgcccctgagttttacatgttaatacatagatgttcttttaaatgcagtttaccatcatcttaaaaaagaaaaaactttatttttagagcatttttaggctcacagcaaaggtgagaggaaggcacagagatttcttgtgtacccaccacccccacacaaacatagcctcgcccatttgcaacatctttcgtaacactgatacatttgttacaatccatgaacctacatttacacatcattattacccaaaatacatagcttacattagggatttctcttggtgctgtacagtctatgggtttggacaaatgtctaatgatatgtaccaccactatagtatcttacagagtattttcaccgtggtaacaattctctgtgctctgcctattcacctctcccgctcccaacccactgacgatcgctgatctttatactgtccccatagttttgcctttctaagaatgtcatatagttggaatcatacagtaagtagcctttttcagattgacttctttcacttagtaatatgcatttaaggttcctctgtgtcttctcgtggcttggtagctcatttccttttatagctggataatatttctttgtttgcatgtaccacagtttatttatctattcccctactaaaggacatcttggttgcttccaagttttggcagttatgaataaaactgctataaacctctttgtggtggtttttggaggacataggttttcagccctttgggataaatactagggagagtaactgctggattacacagtaagagtatatttagttttgtaagaaactgcccaactgtctttcaaggtactgtaccagtttgcattctcaccagcaatgaatgagactttctgttgctccacatccttaccagcatttggcagttgttttggattttggccttcctaataggtgtgtaatggtatttcaggattttatttcatatttacctgatgccacatgatgtagtacatttttctcatatgtctatttgccattctttgttggtgaggtatcaagatttttggtccattttttaattgaatggctaattttattattattgagtttcaagagttctgtgtatattttggatgatagtcctttatcagatgtgtcttttgcaaatatattctcccagtctgcatcttatcttttcattttcttgacattatcttttcaaagcagaagttttgagttttatgaagtttagcttatcaattacttatttcatggattatgcctttggtgttgtatctgatgagtcattgtcatacccaaggtcatctatgttttcttgtatgctattctctaagagtcttatagtttcacattttacatttatgtctttgatccatttggagtaaatttttggggaaggtgtaaggtctttgtctaaattcattttttttgtttttttgttttgcatgtgaatgtccagttgctccagaaccatttgcttaaaagactatctttgttctattgtatttcctttgctcctttgtcaaagatcagttgattatatttatgtgcatctatttctggcctgtctattctcttccattgatctatttgtatattttttcaccaataacatactgtcttgattactgtagatttacaataggtcttgaagttgagtagtgtctgtcttccagctttgttcttgtcctttaatattgtgttagctgttctgggtcttctgcatctccatataaactatagaattggccaggcacggtggctcacacctgtaatcccagcactttgggaggctgaggcaggcggatcacgaggtcaggagattgagaccatcctggctaacacggtgaaaccccatctctactataaatacaaaaaattagccgggtatggtggcaggcgcctgtagtcccagctacttgggaggctgaggcagaagaatgacgtgaatccgggaggcggagcttgcagtgagccgagatcacgccactccactccagcctgggcgacagagtgagactccatctcaaaaaacaaacaaacaacaacaaaaaaaaatctatagaattagcttgttgatatccacagaatagcttgctgagattttgaatctatagatcaagttgggaagaactgacatcttgacaatattgagtttttctgtcaaataatatgaaatatctctttagttctttttaaatttttttcatcagagttttgtagttttcctcatgtaactcctgtacatattttgttagatttatatctaagtatttcattttggggatgttagtatgaacggtaatgtgtttttaatgtaaaattccatctgtttattgctggcatacaggaaagcaattgacttgcatgttaaccttgtctcctacaaatttgctataatcacttgttagttctaggggtttttttgttgagcttttagattttctacgtagataatcatgtcatctgcaaaaaagatattcttatttctcttttcccaacctgtatacattttatttacttttcttgttttatttcattagtcagtgcttccaagagaatattgaaaagcagtggtaagagggaatattcttgtctcattcctaattctaggtaaagcttctagtttttcaccattgtcatgtaaattgtagattttttgtacatatacttttttttcaacatttattttagtttagaatccagatatctatatgtaggtcctgtaaaattctcattgaataatatgcaaagtctataatatgaatactgaaattttatttatttatttatattttatattaacttttattttaagttgcaggaacatctgcgggtttgttatataggtaaattgtgtaaatttacctatctaaaaatatataggtaaacctttatataggtaaatctacataattttatataggtaaatctgtacattatgggggtttgatggacagattatttcattgcccaggtaaaaagcatactacccaataggtggttttttgaatcgctctcttctctcactctccaccctcaagtaggccccagtgtctgttgtttctttctttgtgaccatgtgtgttaaatgtttagtttccacttataaatgaggacatgtggcatttggttttctggttctacgttagttctcttaggataattgcccccagcttgatccatgttgctgcaaaggatatgatcttgttcctttctatggctgcatagtattccatgatatgtatgtaccatattttctttatccagtccaccattgacagacatttaggttaaggtttcatgtctttcttattgtgaatagtgctgcaatgaacacacatgtacatgtgtctttatggtagaacaatttctgttactttgggtaacagaataatggaattgctgggttgaatggtaattctgttttgagttctttcagaaattgccacactactgtgcacggtggctcaactaatttgcattcctatcagcagtgtataagcattctcttttttctgcagctttgccagcatctgttattttttgatttcttaatgatagccattctgactggtgtgagatggtatctcattgtggttttgatttgtggttctctaatgatcagagatgttgagcattttttcatatgtttgttggccagtgggtgtcttcttttaaaagcatctattcatgtcctttgcctactttttaatagagttatttgttttttgcttgttaatttgtttaaattccttatacattctggatgttagacccttgtcagatgcatagtttacaaatattttttctgtttctgtaggttgtctgcttactctgttgatagtttcttttgccatgcaaaagctctttattttaattaggtcccatttgtcaacttttgtttttgttgcaattgcttttggcatctttgtcatgaaacctttgtcagggcctatgtccaaatggtatttcctaggttatcttctgggatttttatagttttaggatttaagtcttaatccataatccatatttaagtctttaatcttgagctgatttttgtatatgctataaggaaggagttcagtttcaatcttctgcatgtggctagccagttatcccagcataatttgttgaataaggagtcctttccccattgcttgtttttaacttaacaaaaacagatggctgtagataggcagctttatttctaggttttctattctgttccattggtctatgtttctattttggttccagtaccatgctgttttggttactgtatctttgtagtatacttttacatcaagtaatgtgatggctccagctttgttctttttgcttaagattgcctctatttgggccccttttttggtttcatataaattataaaatagtttttttctgattctgtgaagaatatcattggtagtttgataggaatagcattgagttggtagcttgctttgggaagtgtggttgttttaacaacgttgcttcttcctatccatgagcatggaatgtttttccatttgtttgtgttgtctctgatttctttgaggagtattttgtaattctcactgtagagacctttcatctctctggttagctgtattcctaggtattttattctttttgtggctcttatgaatgggattgcattttttatttgaatctttgcttgcatgttgttggtatatagaaatgctactgatttttgtactttaaaactttgctgaagttgattatcagatctaggaggttttgggcagagactatggggttttctaggtatagagtcatatattttgcaaacaggaacagcttgatttcttctcttcctatttggatgcacttttgtttctttctcttgcctgattgctctgactaggagtttcagtactatgttgaataggggaggtattcctccaggggaatgcttccagcttttgcctatttgatatgatgttggctatgggtttgtcttagatggttctgattattttgaggtatgttccttcaatgcccagtttgttgaggattcttaagatgaaggaatgttgaatttatcaaaagccttttttagcatctattgagataaccatgtggtttttgtttttagttttgcttatgtaatgaatcatatatattgatttgtggatgatgaaccaaccttgcatcctaagggcaaagcctacttgatcatggtgaattagctttttgatatgctactggattcagtttgctagtattttattgagaatttttgtacctatgttcatcaaggacattgatctgatgttttctttttcagttgtgtctctgctaggttttggtatcaggataatgctggcctaatagaatgagttagtgaggagtctttcctccaacttttcggagtaatttcaatatgaatggtacaagctcttctttatacacttggtagaattgtctgtgaatttgtctgatcctgggctttttctggttggtaggctttatattactgattcaatttcagaagacatcattggtccattcagggattcagtttcttcttggttccatcttgggaggttgtatgtttttaaaaatttatccatttcttctaggttttctactttgtgtgcatagaggtgtttgtagtcatctctgagagttttttctatttctgtgtggtaggtggtaatgtcccctttgtcatttctggttttgtttgtttgaatcttctttttttattagactagctagtgtcctataaatcttatttattctgtcaaagaaccaactcctggattcttttctatgtttttttgtatcttggtttccttcagttcaattctgattttggttatttcttgtcatctactagctttggagtttgtttgttctttctctagctcctctgagtgtgatattaagttgttaatttgagatctttctaactttttgatgtgggcatttaacactataacatttcttcttaacattacttcagctatgtcccagagattctggtatattgtatctttgttcccattagtttcaaagagtttcttaatttctgcctcaattttattttattgtttacccagaagtcattcaggagcacattgtttaatttccatgttgttgtgtgattttgagcaattttattagtattgatttctatttttattgtgttgtggtccaagagtgtgtttggtatgattttaattttctgaatttgctgagcattgttttatggttaattttgtgattgattttagaatatgtgccatgtgaagattagaagaatgcatattctgttcttttggggtggagagttctgtagatgtctcttaggtccattggtcaagtgtcaagttcaggtcctgaatatctttgttagttttttgcgtcagtgatctgtctaataatgtcagtggggtgtggaagtctcctgctattattgtgtggttatctacgtctctccataagtctttaagaacttgctttatgaatctggatgaccctgtgttgagtgcatatatatttaggatattaggtattctagttgaactgatgttcgttgtttattttaatgtagtgcccttctttgtcttttttgattgttcttggtttaaagtctgttttttctaaaattcaaataacaacccctccttttttctgttttccatttgcttagtaaatttttctccatccctttactttgagcctatgggtgtcattgcatgtgagatgggtgtcttgaacacagcatgcagttgggtcatgctttttttttttttttggatggagtttcactcttgtcgcccaggctggagtgcaatggtgcaatctcagctcactgcaaactccacctcccaggttcaagtgattctcttgactcagcctcctgagtagctggattacaggcacctgccaccacgccccactaactattgtattttcagtagagatggggtttcaccatgttggccaggctggtcttgaactcctgacctcaggtgatccacctgcctcagcctcccaaagtgttgggattacaggcatgagccaccatgtccagccactgggtcatgtttctttatttgacttgccactctgtgccttttaattgggacatttagcctatttacattcagggttaatactgatatgtacagatttcatcctgacatcatgttgttagctggttattatgcagacttgattgtatggttgctttatagtgtcaatggtctatgtacttaaatgtgttttgggtggttgctattggtctgtcttttccatatttagcactcccttcaggacctcttgtaaggtgggtctagtggtaacaaattcccttagcattttcttgtctgaaaagaatcttacttcttcacttataaagcttagtttggctggatatggaatttggaatttattttccttaagaatgctgactatagccctcaatctcttctggcttgtggggtttctgatgaaaggtccactgttagcctgatgggattctctttgtatgtgacctgccccttctctctagctgcctttaactgtttttcttttattccaacctcagagaatctaatgattggtgttttggggatagttctctcgtaccgtatcttgcaaggattctctccatttcctgaatttgaatgttggtgtttctaatgaggttggggagattttcatggaggatatctttaaatatgtttttcaagttgcttgctgtctcttcctctctttcaggtctgacaatgagtcatacattgggtcactttacataatcccatatttcttggaagttttgtttatttttctttatttttgtctgactaaattagttcagagaactggtcttcgagctctgagattctttcctcagcttggttgattctgttgttaatatttgtggttgtattctgaaactcttgaggtgagtttttcagctctatcagatcagtttggttgtttcttaaaatgtctattacatcttttatctcatatatcatttcattgtattgcttagattccttggattgggttttgactttctcctggatatcaattgttttcatttctatccatagtctgaattttatttctgtaatctcagccatttcagcctggttaagaacctttgcttagaaactagtatagtcacttggaggtaagaagatagagtaagaaggctttttgagttgccagagttcttgcactggttctttctcatgtgtgtgagcttattttccttaaatctttgaaatttctgtcttttggatgaggtttttttattttatattctctgatgcccttgggggtttgattgtggtataaggtgagttcagtcaactgggttgatttctggaagattttaaggggccaaggctcagctcagcattcctggtctgagtgctttaactctggggggctggtaccaggtccccacacttgttctctggcaccttgaggttagaaaccagctgcactagaaaggccaacgtgtttccagtccactggctacaacattcctgtgggaggtactgaccaaagcacttcactggggcagtggcagtgggatccatgctcacttacacatgctaggagccatggcattgcagagaggtgcacatgcgtcgcctggggcaggatactggcagaaacgagtttgcagcattcttttttttctttttatttttttttttttgagacggagtttcactcttgttgcccaggctggagtgcaatagcgcgatcttggctcactgcaaacttcacttcctgggttcaagacattctcctgcctcagcttcctgagtagctggaattacaggcatccaccacaatgcctggctattttttgtatttttagtagagacggggtttcaccatgttggccaggctggtcttgaactcctgacctcaggtgatccacccacctcggcctcccagagtgctgggattacaggtgtaagccacaatgcctggccaagtttgcagcattcttgcatgcccttgcaccacttgtggaacacaggtggggatggggttgctattgtctgtgtttgcactcacaccaatggcaatggcagcggagggttgagcaggattgctggtgtccatgtgtgcattcccactggcagaaatgactaggatatctctttactttaaagccactgtggaaacccaaatatgcatcctgtcctacaagtcagaacactgttgtttcaagcatcatataaacatttcctggcatcttcccagtacctgcaggtcacagagccacaatgactgctgcagagtcacctagggtttcctaggaaatggagcaatggacatggcatcccagctccttgcacaagaatcaatattctttatcaaggtccgatgttcccttctattcctagtttaatgaagcctttttaaaaatatcatgaatgcctgttgaattttgtcaaatgctttttctgtctctactaattaaccgtgtgacttttatttaatgaattagaataatttacttttgaatgttgaatcatttgtgaatattttgaatgttgaatcatttgtgaatatttgggataaattctactcagttgtgtataattttgtaatacatcattggactctatttgctaatatttgtttaggatttttacatctatgtttataagaaatagtggtgtgtagttttcctcttttttttttctgggtttgatattaggataattcctgcctcatggaataagttaggaggtattccctctgcttctgtcttctgaaagagattgtagacaactggtataatttcttccttaagtgttttgtagaattcactagcaaacccatgtggacctggtgctttctgttttggaaggttattaattattgattcataacctttcttaatagataaattaacaatttcttaatagatacaggcctattcacattatctatttcttcttgtgtgaattttggcagagtatgtttttcaagtccatttcatctaagttgtccattacatctaagttgattttcaatccctttcatctaagttgtcaaatttgtgggcatagagtttttcatagtattcttttgttatcctttaaagtctgtgagatctgtagtaatgttcctctttcatgtatgatattagtaatttgttcttttttttctcttggttagcctggcaaaaggcttatcacttttgttgagctcttcaaagaaccagtttttggtttcactgattttctctattaactttctatttttaatttcattgatttctactctaatttttagtgtctcttttttccaggttatttcagatttaatttactctttattctctagttttctaaagtagaagcttaggtagctgattttagatctttctttttttctaaaatatgcattaaaggctagaaagttccctaaaagcagttttgtcactgcttttatggcatcataaaaaaattgatgttttagtttaatttttatttactttaaaatacttttaaatatttattgagatttattcattgacgtagacttaacactgagttaggctggtgctagagtctgtgctcttaactgctattctatggcatttttaggcaagtcaggtccagtccacctgtaaccctacacatttcacatacatacaaacacactaataaatatgagaagtagaatctgaactgcagaaacgttgtgtattttatttttattatctgtatttttgccttatttcctcacttgaattcaacttctttcaccttgacacactggagagccagagatagaaagacccctcacatatgccagccattgagatcattaggatgatgaacaggacacaatttttatggagagttgtgtggtcaggaggagagttgcaagaaccaagaattatgtgctaggaaatgtgtgttaaagtagagatgtatacagagtgctgtagaaacatggagaaagattacttaactctgatctgggcaagggagagggggcaggaatatcagacaaattttacagagggtgttttgaaggaggaataggagtttgacatgtgagaaagtaggatacggatgtcagtaccctatgcaaaggcactaagacctgggcgaggttagcattctgagtcagtgaagagggtgcatttgaagcatgacgccagagagaagaacagggtggaaggtccagatttcatgcagagtcagcaaataggagtaccttaggtcttgacgtcataaacccaaggatcagacaattttccagtgtcaacaaaagccaccataactgatggaagttaacaagacagggtgcagagaggtatgtaaaggaactgagaagacaagacattggtacaagccagtctccagtttcctctattttcccttggcccaaagcactgtcactagaagatttcatgtgataataataaattttctgtgaaatagtagaagcattatggaggagagcagattctgtgcgaggtatccacctaagacatgcatagccacagcactttgttccctgaaactagagtgaataaataggatgcctccagaaaacaaaaatcatcttcaacaagatgccttttacctatttcttgtcccttttatataatttctggcatatgtgtctatatatagaaatttcctttaattaactaattgcacaaacacacatttgccaatgttttctttaataaacctatccttttctgtgattcaatgaaatacattcaattctgctaatttttcataatgctttccattatgatagcaaaataactcagttctgggaaaatataccaataactatcttgaattgtaacaacagtaaaaatgagaacattttacctgaacaacttgagttttgtgtttgtttgtttgtttgtttgttttcaggtagagtctctctgttgcccaagctggagtgcagtggtgcgatctcggttcactgcaacctccacctcccaggttcaggtgatgctcctgcctcagcctcccaagtagctgcgattacaggtgcatgccaccacaactggctagtttttgtatatttagtagagacagggtttcaccatattggccaagctgtccttgaactcttgacctcaagcaatctgcttgcctcggcctcccaaagtgctgagattacaggtgagagccactgcacctgaccaggagttttttaattgaaatatttgtgcacaaaagcccatgatgtcaccactagtggttaatttatttgtttgtctgactcataatgaatatgagagaattgttttagtaaagataaattgcttttaataaggactaaaatccctttagtttaacacaagccactttattagcagtgtttctgggaaataaaagcaagagttggttcttccagaagtttaatgccagatttcaccaccttcatgagaaatcagaagggtattgttaacatgctgtttcatttgaaacagttttaacttttggtggtcagctcaataaatggaattgattgcttttaacccgggacaatgacatactgtaccaggatatgccgctgtgtaactttcaattctactttttgtattggcaggacttggcaaagaattgcagtgcatgtttccatttcctatctttgactatatatttgttttgtcacttaatagagctacagagataacttgaggaacaaactgactacccaggtctccaggtcaattttctgttattttgcatgaaatgagaaagtcattttgaccctcagaagacaaatcagtgcagattatagatcttctcttgatccccaaaggaataccccaaattcacacatttaatgtaacatatctttattgaacacctaccatgtgctgtacactatactaaactccttagggatatatatacatatatctgagatacggcatcatggtagagagaaaggggcttgggccctagcatatctagccctcacagcttcttactaaataaaacttagcttatctgagcctcagatttctgttcaatggaaattataatacctacatgtacagctattgtggacactaaataacatgaatagcattgccacattgcagatgctcagtacctgttggtttctcattctctctacatcacaagtttagagtcacattggaatgacccacatccacactccaacaagaattcaaaggactctagagcaagtgccacacatatggcataattaactgtggtggttttaggaatcgttggcttgtgggtcactagtatgaagatagttgctgtttcttggagttgaggttgccaggcaaggcttcatgaagttggcaacacttgaattgggccttaagtgtttctggattccagatgtgtacagagaacatgagatgaaaatcctggttggataaaaagtgtgagcagcatcttgggagtaggactacacatgtcactttacaagagctgagagtagactaatttgagtagaggagataatttaggtgggtaaatgggagcagatataattttaagacacatgaagttgagtggacattaaaaatatgtttagtttgtggacattaaaatataatatagttggccctgttgtgtctgcaggttctgcatgtgtggattcaactaactgcagatggaaaatacagtatttgagggatatgggctctgcacatactgagggctgactttaagtagccattggctccacaagacctactgtgggacttcagcctctgtggattttggtatctgcaggaggtcctggaaccactctcccattgatattgagggacaattgtattgtaataaaagtcacaaaagatttttgagttgaggctagtatttttaagaaatctagtccagttttacaatgcagagtgaataaaaaaagtaaataaccagagttttaataatccagaccagcatgaattaggttgatggcaggagcaatgggagaaagaggtgtaggacttaaataaagaattgattggctttggttattgattgtatatggaagtgagaaagaaagaagaaactagtatgaatccaactattcaaggcttgttaactgggaaaatgaggaaggttgaaataatttttgaagataaagtgtgtgcttttagatgtgttcaatttaaagtaattacagggcatccaagtggaaagctctaaacactagttggcatgtgaggggagaaacttaagacacgtcaggaaatcaagatgtgagttatacatcctcatggtgttactaagcacctaaaagaagatgagttttctaaggcagtatttctcaactgtatcttgtattattaaacacccttattcaacaataagtacttactgagacactgatgcgtgtgccacatgccaagctcccatctgtgtaccagggatatggtgggaaacaccaacaaagtccctcccatcatggagcagtcagcacatgatagttgatgtgcatgaaaatgttcaggtccatttgttagctcttacaccgtgtctctcaagagagcctgtctacatggatgtgaagaacagtggcattgctatgaatatagttctaaatgtattctaattcattaagaaagtaaatcattcacaaatattgagaacattgtaaataatttgcctcgacaaccattgtatgtcaacaccttagatgagaagctctgctttaaggagaggttaggaagagagcaaaggggctcaaaactgaaccttggggaatagacatatgtaatggactggaaaagtagccagtaaataaatcaatggatggatggatggatggatggatggatgatgaatggatgatggatggatgggtggatgaatggcggatggatggatgaacaaacaaaacacaggtagacagacaggtaaatatatagattaaaagagagctaaaaattaaaacaaactcatggagatagacagtagaacgatggttaccagaggctggaaaggggaatagagggatgggagagaagttagaatgggtacaaaatatagaaagagtgaataaaatctagtagtatttgatagcacagcagggtgactatagtcaataataactgtacattttaaagtaactgaaacagtataattggactgcttgtaacacaaataataaatgtttgaggtgatagatacctcatttattctgatatgattattacgcattgcatgcctgtatcaaaatattacatataccccgtaaataaatacacctactatgtaaaaaagaaagtgagacagaagtaaagattagagaatttagaggactagaaagagtcaattgaggcagtgtcacagaagctgaggaaaggaaaaattaaggaagaggacacgtttcacagaatttaatgatatagataggtctacagagtgagagttgataagtaagaaggaagcacactgataaaactttgaaagagcagttcagcaaaatagagaagagtgaaggtaatattgatggggttatggaaaataacactcatagggaaaagaaagcacaaaatgattcaaagtctttattggcttatttataagcaaatgacaggttgaatatcagaaacagaaatgaagacattgatgaagatggataaggtgtagttgggagcatacagaatcccagaagttgaggcacatccagcagaaccacctcataataggtttgtcacaggaagtggatcttggggtcaagcagagtaggtcagttcctagtactgaagtttgaaacagatgttctgtcggggaggagagctatcaaccccagtattacatgggagagacttgagaagtttaaaaatccaaccaaagttgtttatggagttgttttttacaatcattttaatagctgggtgaagggtaaattgtatgtagctaaaattttaggcagagacactggtaagatgcaaatctaatgcaaatctaggccaaaatgataatttcgagctaggataatagctatatggatggagaggaatgataagattcttgggcttgatggggccttgtgacagtgaggaatgagagattaggtgaagggaagtctctgtcaataaatatttattgggtacttaagctacagattagtcacacagaaggagtggatttgtctgtgttgattggaagcaagatgaattacgttttgatgatgttgagtcagaagtgctttcaaaacaaacactaagttaaagatgccctttcacaattgtaaataatttggagctcacatgagagataggggttcaaatctggatttggaagtcattggtttataaattcagtttctacccagagagaacacattctgtgagaagagagccagactcaggccacatttaaagggtaaggaggcatagaagagacacatgaagatgcaaaaaatgagccagcagaaaatagtcgtctcttagaggccaagagacaggaagtgtagagcaaaagatacagaagtattagataagttaggagcacacattacccttgaagttaatcttagtaaggacattttcatcccagtagtgagaatggaagctaggctacaaagagatgaagaacaaatggaagtgaatattaaaaatgtttgtatagactcctttatgaaagaaaatcagaagtctgctaagcaacaaatatagaatgaaaacagtagaaagattacatgacagagatgatagaagggtaaggaatgacataagggaaatgcaaaaacattttggaggaagttaaatacaggcttggaaatgctaagtcatccactgttctaacctgctgccttcaaggactgatgtaaagttggcataataatggcattacatttcaagaacttaggatattgtctgacacatgggaaacattcagtttctctattagtcaagatatgcaaaccactgtaaacaaattcctaattttagtagctgatcatgacaaggtttatgtctacttcaggtcacattccaatgtagattgacatgggagctctgctgcacacaatcctttggggtctcaggcgctatgaccagctgtcagacaaggaaagaaagaaaatgtggaagaatatgtgggagggttctttgagacttggaatgctatctgtgatttctgtctttgtttcattggccaaaagtcagtcacatgcctccttctaacagcagggcaggctagaaaatgcagtctaactgtgagccctggaggaaaagaaacaagttttggtaaaaacaatggcagtctttgtaacagcctagtacgatttactgttattactatctatagcagggtcttagtcaaattaattccctgcagaatgaagatgagagagaagacagatacaccttgatggacgctggggatgggaaagttagactcataaacaaatggaagcctaggaagtgaggaagaaacactgccatcctgagaagaaccacaagcactgggaagagatagggcaacattaaaatcctaaagctatacttcttgtccagacttgccctgcatttctgacctgtacagtcaactgccactctatttgccatttggggttctatagataggtcaagcttagcatacctaaaacaactcatttcactccccaacaaaatttactttacatggagcctttttttttttaatgcaatgcatggtgacacctttcttccaggtagtcaaatcacaactcttactgtcactcttgagtcctctctgaccctcatatccagtaaccagttaatcagggaatcccgttagctcaaccttcaaattgtattcataatgtgatcactcggcaccatctccactgctcgcgtgctatcctctacaacacctgtgccatctctttcctcccagtctcctttcaacccagtagtgagagtggtccttcaaaacacaatggaaatgatgtctcatctctgctcagagctctccaatggatcacacctcactcaaaataaatgtggaagaactccttgcaatggtctacaaaactctcagttatcatatcttttttttttttttttttgaggtggagtctcgctctgtcaccaggctggagtgcagtggcgcaatctcggctcactgcagcctccacctctcaggttcaagtgatttccttgcctcagcctcccaagtagctgggactacaggcacacaccaccacacccggctaatttttttttttttttgtattttagtagaaacggggtttcaccatgttgaccaggatggtgtcaatcttctgacctcgtgatctgcccacctcagcctcccaaagtgctgggattacaggcatgagccactgcgcctggcccagttatcatatattacactgcttccgactgatattgcctcacctcacacgctggcctccttgtcattcctcacacatgtcagccatattcctgctctggggcctttgttctggctgtttttacagtatggaaccctctgtcctctgatatgcacgtggctactccctcacctccttcacatctttgttcagatgacacattttaagtggaatctttggatactttcccctgggcaccatatataagaaagcaacatctcccactccaatagctccttaatcccttagtctgctttacttcttcatttctcatagcatgttgcaccctcacacacaagatatcattttcctaattattatgtctaatgtttagtctgactcactcctccccactaaaatgttaaactccagaagatcaggggtctttgcatctagtagaggttcagtaaatactttgaacatagtagaggttcaataaatactagttaaatgaatgaatgagttaataataaacaaatacgttgattgattgattgactggttgattgattttgccttgagccctcatacttcttacattgcttggcaagtagcaatgttctacattttgtgaatgattgttatagtaatggtctgggccccacaatacagacggcagctgaataatttgacactttggtaaggaataaatttctcctttcattaatgactgatttattctattttctttatagtataaatattatctgtgtttcaaattgtgtctgaaaacttacaggccagcaaatggttgggagtggggagcatgcatcacttacagctacagtgattttctgtctctgactcatcttaaaaagccttaattgagtatttattcttatgctgtgagatccaagaaatcttaactgccattaagctgtctacagaagcaaaacaaaatggagaattaaggcaattatcagcatgatatgaaccatagaaaacatgtttccctcaatctggatgtttcgagagaacttatttttgatctaaattatctgagtaatttccccttcagttttcattttattttgcactgatagacaataatttagtatagaaagggacagcccataacatagggaatcagcgtgcgaagaaattcattatccagcatgtgtatgtctgtatcttctatttttactaaactttgttgccagaggagacatttaaaaaaactgctttctaaggaattgttgaaaattaactgatttactgaagttgtgctttgatacctgcctgccttttgacctcaactaaaataactcttcagtttgaatttcttttagctccccttttgggctgtaactttagatccagctttcaaaagccaacaggtaaataaacaggatattaatcatcatacattcatttcaatgagaatgcagccacaatcagcataagcgtgggctatttctgaattacatgaaagccagctccctagggtatgtccaatataactgtgataatgaggaatttgcaggtggacctgctgttcttgtgtaccttattaagtgccttgtcaggtcaattgtatttgtctgatatcttcaatctctttcccctgagatattttccagtaagactatttattaactttaacatttcatattcaaagtagccctcaccccggcctcaaccaccaccaagttctatcacatgaagtaatgacaaagaagaacctgggtaagttgctgcaaggctgggctggctgagttattaggcctctgtagctaaccaggcctgcatcttcctgatatatgaacatttcagcgggcaaagaatagaatccccacgaggatctcagataacatcagccttacccatgtgtaccccaattactcacctcaaatgctatccctcatctatcacttggctatagattcatcagaagaattgaaaatcaaacagaaatattgtacaactttttcaggaagtgatacaagtagacatggaggttacagctagtttgacgcagcctaggaaaaaagggtactggaatgcaaaaatattccccatgtctatgtctctagcagtcaagacctcaatttttcatttttgcttttaaaatcccacttgacttcatcctaacctacctaccatcctaacccatattctctgtcactcctctccattgtgacctttctgcccaaattgactaatctgttttttgatccctgaaaaatctctgggctttcctccctccaggcctctacacatatcttttcctttgcctggagtgcccctcgctgcacttgtgtttgagccaatctaatccacacttcacagtctagctcagaaaccttctcaataaagttctctcgtttagcacagagtaattgcttccatctctgaatccactcagcacaactcactcttctttctctttctcattctttctagatttttaattcttttgattatagaatatcaacttatacaaaaaaataggcataagcttaaatttatagtttgctaggtggttcaaaaaggaatgcctgtgtaactaccccaggagaaaaactagactgttgccagcacacaagaagcaccccagcgtcctggccaattgacaacccccttcttttccaccagagctaacctctgcccttcatagttcatagttttcctatatgtgtgcatccctgaacaatacagtttagttgtatctctttttttcttttaaaaacaattatgtttattcaaaaaaggctagatgaaattaaatcaggctattttaattgattcataatgcaattttaaagattaaaaccaaatattgaaagactaaaatagccaagaaatgctgaattgattagtaaataatatgattagttcaaaatgctcttatattaataacataaaatcattttttctgctgacattgattatagctaagttgacattgtgagagttaaatgcagtttattgaaacctgaaatagttaagttgcctagtctagtaatggagttaaggtcactttatttgaaggtactaagcttactgcataagtaaagctggcagagttatacttgctgtacttgcagttaccaaatttaaatgccttccctggtgaaagagtgttggttaaatgagccctgtcaaatttttgattctggctgcctccattgaagttgaccaagcttgtgggtggtgatgccccaggcttccttgtagctgaagaaaactgaagaaatgaggatactacattataagtagaagagaatacagttgcaaagagacagaaaccaagtatacacacacacacacacacacacacacacacacacacacacacactacacacaaggtgtttttaggtgccgtttcagaagcattgtgtctgtgtatgtgtgaatccttggtttgtgtctctttgcaactttttttaaaattttttatttatttttattatactttaagttctagggtacatgtgcacagcgtgcaggtttcttacatatgtataaatgtgagttgtatctctttttgaagtgtacatttttttatgttctacaaaaaaagataaaaactaaatactaaccactctaaagcacatcaatacattatgtatttggggactttccccagtcaatattacttataacgtttaagtttatggtggtagctacagtccatttatttttattgttgtataattttccactgtgtacatatactacagtttattcattgtatggttgggagatagttagattgctttaatgtttagcaaatataaatattcttgctgtgaatattctttgacatacatttctttccacatcatcacacatttatatcggacacatacacagaactggaattgttaggtcataggtaagcattacctacttttatcagacttctacattttggcaacctggtggtcctgtatcttactgcatttatctaattactctgaagccaagcatttttctggatgactttaggcatctggatttcattcgactgaagtgctttttcaagcacttttctttaggatggtcaaccttcttttctcattgtgagaaaaattgtgaggcaagaattctctctatagcctggatactatttcagtcaatttcgtgtttgtaaaagtcttcagtgattcctatggcttgtcttttccatttcttctggatgtttttgaagaaaagctcttcgttttgaatttattaatcttttttatgtttaacacttaaaagtattttcctatataaggaaatggcaatattcccctatattgtcgtctaattattttaggtatttaatccacttagtatccacatcatagtacagtacaggtagtggtatattttattttgtacatagctattccgttttttccagcataatatattgaaaagactgacctttccccatcagcttctgtgctctttctgctgtatattaaagacctatatatgtgttagtttctgtccacttgtatgtttgtctacatctgtgtaatttctggtgtgctgattatttaaaatatatcttaatatttggcagagcaagtcttaccttttagtttttgtttttttgaaagccttttgactattcttggcctatgttattgccacataagtcttagaattagtttgtctgcttcacaaacaatcttgcctgggttttgattaggattgccttaactgtatataaatttgatgagaattttataaaaatattgggctttataattcacgaacaatgtatataattcatttaagttatttttagtgtctctcaatagagctttataattttttttgtaaaaaccttgcatatcttttgtgagaattatttccaggtgatagattatttttgatactactgtaaataatgtattttaatctaattttctaaatatctgttatttttatgtattgattttgtacaagttttgtatgcatagccttggtaaactttcttatcaatttgataagtttttctgtacattattttggaagttatatgaatataatcatactatctttgaaaaatgacaatttgattctccagttccaattctattaccatttagttttacttgccttattgcacttatttccagtgaaacagtaaagactgagtttggcatggttgtttggtttccagtaaaaaaaaaaaaaaaaaaaagaaacggtgaaactttcatcattttataattttcaaaattagggatgatatttgctctgtaagcttagtagaaaacatttatttcaggctaggttccttctcttcatagtctgctgagggtttctgacatcgtttgctgaattgtattaaatacattttctggatctattgaggttgtgtttttttctcctaatgtgctaatgaacttgtgaagagctgagccagactgagagctgagctgccaggggttcgagtggccatgaagaaaataagccaaaatgaaagtaacagtcaagattttcgtcaatagtgcaatactataagcaagatgctcaactggggaaagcactgacttccctagtgttccattgttcatttggaatggcaccatccatggtcagatagatcagcatagacatgatgaatctccttattgctaagaaagttctaaacaaaaagctccttctgttttatggaccataaacaggagaatgggaaggttagtaatggaaggtattgagtactgagtcagagtgaaaaaagagtatcctcaaagttcctccctctaccataataaggaggtctcagcacctgagaaaaatgtcttctgaagacccccaaataggaggcctctgaatgtaggtaccaggactaagaatgcagacatgagtaagaacatggccagctgatggcacctgagtccctgactgcaatactcttcaaagactgcagtgcattggctgtgcaccaaagtaggtgtggggaaggtggttttccctgctgaggcctctcaggtaaacgtttggtaatcacctatggtcaggcttgaaggatcacacataggttttcaggcagtatcgagagtccttagtgatgaatgaagatgactgtgtttaatgccaaactaaatttgaattcctggatgaacccagtagtaacatgatacaattgatgtttttaaatagtattgttatgtttattttaatgtgtcagtaatattttgtttagggctcttgtattattgcttgttgatggaaaatcaatggacttttgtatattaaatttgtatcccgcatctttgctacaattgcttattatttccagaatttttttttgtcaattctcagattttccacggagatgatcatagcatgtatgagcaaagacagctttatttcttcctttccaatttgtatacccttatttccttttcttgtcttattacattaactagtacttctagtacagtgttgaaaaagagtggtgagaggggccatctttgccttcttgacattagcagaaaagctttgagtagataatacaattttgtttcttttttctagttttctttttaaattctgctatcctgttttatagggttttgtcctctgcagatatttttaagtttttcatttattcttataaacagggtaagcatagctcttttaaaatgtgttctacaaatcccagtgtctgaagtgtgtgcagatctctttctgctgtctgccatgctagttctggccatgttatttcctttcttaatgcatctgcttatatatgactgcttcttggccattgcccttaaaaataacttgggaagattccttgaggtctaaaatatacctcctacaaagaatggggcactgtcagtctgggactacttcagtcaaatttggtgacttaaattccatcaccagtccaggctctgagttcaaatacatgaaagagccaatcaatgtccacaatcgctcaagaaattttcctctttccttccttccttccttcctcccttccttctttcctttctttctttctttctctttatttttttttctgtcctgcccactcatcaccacagaaaacttctctattatcccctcggatttggggcttgtggtggaatataggttataattagttcagccttctttcaaaatgtagcgttctgaagcttcaaaaggaagtgtttcttataagactcccaccttgggtaggccatggacattgacttctgttcctctcaccacctatagctctgaattgaaacccatgtgtgcagtattgaccagtgacttcaggacataagtatctttgttaccttaatattccacttgtgtctagttacaggcttccactcaagtgtattccaacattgttcatattttattaagaagtctgatctgaataaatttgcccaccattattctaaatcaagacccaggagaaattttctctaatgatattttgacaaacacgtatatactgtgtggggaggtggagggctatagtaagaagagcaggctttaatcttcgttccaccatttgccagccatgtaactttggacaagtcagtgaagacattcaaaccttggtttactcatctataatataaggaatatagaattagtgacaataaatacaaagcatagctttgtatacaaattatgtatacaaatacatagctcttaccattattattttcatgtctccatgacatttttatatgttcttgacttgaactttaattaacttttggattaataatttgtctgttttaacatcttgctttcttaaggacaatggaatatcttaaattgttttttataatcctctgtattagctagcatagagtaagtacttattaattttttcagtttgttcaatacatccagacacttgctggtctgttatgaaagagtatgaaactttttgagtgattatgtgcaaggattctcaatcacttgccatcacaatagccattttcactttctttatagcacttgtcactatttgaaattatatttctctattatatatttacttgtttgttccaaatagaatattaattttcctccctaaaatttcggatctatcacaaagtgggtgtttaatggatatgtattgaattaaaaaaagaataaattttacaggaatcaaggagtgggagctttttgtgacattgacttttcattggtatttgtcatctttctcagctcctatacttctggaaaatatttattcttaatttggctaattgttttatttattgagaatataaactttccctgaaggctaaagtttggcccaaagagtgaggaaaatcagctgttacctgtgacatgggttaaaaatcttcttacaaaatgagaagtgattacacatgtagggctttttcattacattaaaacaataacagtcctgggaatactgactatcgaaaggcagaagaaggagactagacacctatctctcgctacatacaaaaatcagctcaaatgattaaaggcttaaataagaggctcaaaactatgaaactaccagaagaagacacacaggaaatgctttaagacattggcctgggcaaggacttttaaaataagacctcaaaagcacaggcaacagaaacaaaagtagacaaataagactacattaaactaaaaacctttttcacagcaaaggaaaaacagagtaaagagacaacctacagaatgggaaataagatttgtaaactatacatctgacaaggagctgataccaagaatatgtaaggaacttaaacaattcaagagcaaaacaacaaatagtccaattaaaagtgggcaaaagacgttaatagacattccttaaaagaaggcattcaaatagccaataggtacatgaaaaagtgctcagcatctctaatcatcaggaaaacacaaatctaaaccaccatcagataccacctcactccagtgagaatggctataattaaaaatactttttaaaacccacaagtgttggctaaaatgtagagaaaagggaacacttacacactgttggtgggcttgtcctcgagaaaacgtagttttcataattttaatttgacaaaatttttaaaatcctggaaatagtaaatatgttacccttcaataaacaacaactgattaatagcttgggtaagagttcagtacatacttctagctacacaggaggttcctcaaaaaaaaaaatatagaaatacaatataatccagcaatcccattacttgtatactgtatattcaaaggaaatgaaatcagtatgttgaagaaatatctacattcccatgtttattgcagccctgttcacaacagccaagatatagaatcaacccaaatatctaaaaatggatgaatggataaagaaaatgtggtatatctattaatcaacaatgaaaaactatttggctattagaaaaaatgaaatcctgtcatttgggacaacatggatggatctggaggacagaacaaatacctcatctgtggaatctaaaaaaaacaaaaaacgacaacaacagaaaatattttaagaggtgtttttttgtttgtttgttttttgtttgtttgttttatcacagaagcagagagtagaacagtggttaccagagatgggaggagttggggagaagagaatgggagagattggtcaatgcatacaaaattgcaattaaaatagatgaataagatctgggattctattgcacagataaacaataagatatgatatattacaaaatagcaagaagataagcttttgaatgtcctcaacaaaaagcaatgatgaatacgtgaggtgatggtcacactgaatgtctggatttgatcatttataccacatgtatatgtatcaaagtgttaaaatttaccccaaagttatgtataattatgatgtatcaatttgaaaacaaaataaaaaattaaaacaataacatgattcaggtactaatgtttacccacagtaaaagtaacattttattactttatcataacatgtatattgatatttgaaagagaagaaaataataacactatgtagctagaagtatgcactgaactaactctttcccaagctattaatcagttgttcattgaagggtaacatatttactatttccagggttttgaaatttttgttaaattaaatctatgaaagctatgttttcttgtggacaaagacaagagatgcttcccttttatcctcttctaagaatgccctaatattgtctctaggatttaccactttggcacgttagttatattgtttgagcataaattgctaagatgtaacagaaaactgtagctttgaaggtcctacataaggcccacaatatactatggaagcctcttcttggttcagaaattctctcctgaccagaagatccaggaatgatataatgagaaagtgtcataaaagtgggggaagagtgacacaaaaaccagctgcaacccatcctatctaggttgcagctggtttttgtgttagatgcgtatgtcagaggttttttttttcagtcagtgtacatcaaatgtgctgtgaataaaagaatgaggtacatggcttccatttctattactctccactctgtaatagaaaagctgaaattatatcaaggttccataaattcccacagttctagaactcggactgacatctttaacttggagtataattatttagttcaggctttgtcacctagttgattataaatacttaatgcgtacagagatgtttaatatttgcattagagtctttagtttgcaaagatcttcacaaatatctaatcttcagagcagctcttccctagttaatctgaactcaaagctgcttaggttataggtattttagtattttcaacccagggaaaatataccagtttccttttaggaaccctttaaactacctaactgcaacctttattattattattattattattttgcaggggagaaatagttgggaagaaaaggttagtctatagtgttattcccataatcaattagagataaatcaaaacccctgctcctgtcaagacaaatatgtttctctttagttgtgatttctcttgtgtcagtggcaggaaaagaatcatacaaaccacatacacatgaatttctgttccagtatgagcagtccaattacagaacctgcccactctttgtaccagtttctctatcaaaggtcctgactttgaaggttggtgattcgctcactatgcaagattatctttttcattgcatggtttcttctttagtgaaaaatctctgtttctgagcaaatgtcatttcttgtattaaactttatagctacccctctgtgatgtgatattccatttcgctggaatcacttgtatatttttttattatgtcctctcccaggaagctcatctaaatcacagtacctcaccaagatttgtttctctcataattgttcctacttaattactgtgtgcacattggacccttccaatgtgctgagccggtcttagagatgagaggatgaactatgaaaataagatttagcatatgaagagaataaggctgaattagaatgggagagggaatgtgtttgtatatgtgtgtatatttatatatgtatgtatatgtatagattatacacatacatatatactttgtaaatgagaaatttatactcttttgcaaagcaaatgcagttgaccatgtgtagatcttaaggcaattttttctgggacgacagcatatatggtattatattaattttttaaatatattttcaacttcttattttagattcaggaggtacacgtgcagatttgttaaatgggcacattgcatgatgctgacgtctgggatacaattgatcctgtcatccaaatagtgagcatcacacctaacaggaagctccgcttccttccccacccccagtagtccccagtgtctactgttgtcatctttatgtccatgagtacccaatatttagctctcacatgtaagtgagaacatggagtattaggttttctattcctgtgttaattcacttagtataatggcctccagctgcatccatgttgctgcaaagtacaagatttcattctttttatggctgggtaatattccatggtgtatatgtaccacattttctttatccaatccactgttgatgggcatctatgttgattccatgactttgctattgtgaatagtgctgcaatgaacatacaagtacttatgtctttgtggtagaatgatttactttcttttggatacataccaagtaataggattgctggattaaatggtaattctgtttcaagttctttgagaaatctccaacctgctttccacaatggctgaactaatttaccgttccacaagcactgtataaacatccccttttctctgcagcctcaccagcatctgttgttttttgactttttagtagcagttgttctgactggtgtgagatggtagctcatcgtgcttttgatttgcatggctcacatttttaaaggaatttgtaataaataaacacttgcaagtacctaacaacttgaatttaaaatatatgaagtaaaaatggtcagaattgtagggaaaagttgacaaatctataatcatcacaagatattttagcacatctctccgaaaatctgatagatcaagcttataaaaaaatgtaaaaagagagaagatatgaatgactcatgtaatagttacttaacatacataatgaatggtataaatcaaattactgcatctatcttagtgctacaggcataacttgtaatagatatttaaatgtaaagtattacttattgaaaagtgaaatagcaaagatgttttctctacatgactcccaactaaagtttgtttctttgtgtttttatctttccttttacatgtagccaaaaatcacggtttctttaggaaaaaaataaatcagcaaaattggttcattaacattcataaagagcttagtctaggccaagcgcggtggctcacgcccgtaatctcagcactttaggaggccaaggtgggcagatcacctgaggtcaggagttcaagaccagcctggccaacatggtgaaaccccacctctactaaaaatacaaaaattagctgggtgtggtgacccatgctactcgggaggctgaggtaggagaatcatctgagcctgggaggcagaggttgcagtgatctgagatttctgtcgcccaggtttgagccactgcactcaagcctgggcaatagagcaagactctgtctctaaaaaagaaaaaaaaaaagagcctagtctaacttggttagaaagaatctattcaatcttttttttttttttttttaagtgccatctaaacagaacccatctcagtggcatgttgttgccctggccattatgtataccctaaagaattatatttcaaatgttaatctatgttagaatcacctggagggattcttcaaacaagattgttgggcccaagatggggcccaggagtttgctgggtttttttttttgcaatggaatctagctctgcctcccaggctggagtccagtggtgtaatcttggctcactgcaacctctgcctcccaggtttaagcgattctcctaccttagcctcctgggtagttgggattacaggtgtgtaccaccacagccagctaatttttgtatttttcatagagatgaggtttcgccatgttggccgggctggtcttgaactcctaacctcaggtgatccacctgcatcggcctcccaaagtgctgaaattacaggcatgagccaccgcacacagccaggaatttgcatttctaagaagttaccaggagacagtgatgtttctgggttgggagccatgctttgggaattgttctagagcacatgagcataaggctgctaagtcatcagaattccccatggtgcatttcagatgtgggttgccatgagtcctgagtgtgtagaacaaagcagtgctttaaactagaacaacctcaaatgtaagaagaagtttaaatatgtaatccaacattggagagaacagtcataatgtgaactgtaaagagaagcttgttgggtagcttccaaaaatgagtagattttacatttcagattatgttacatttccttcatcactaaagcccatatgcacgtgcactggaatatactctaccctctgattcctctacaaagggctcaaaaacctcccaggcaaagctagttctttctccatgcttgtctcattcatgaataacatcaaacaatattgtacaatgacttttgccatatgtttctctattaaactggaagacccttgaagggagagagatttgattttgattatcatgtacccaacattgtgcctgaaaacatgtgcactcaataaatgctgtggcatgaaagcccttcaagagcaaaggtattaaattgtccatcatcagtcaacatgtcttcctggcactgggtggagtgcctcatactgaattaatatttattggattaaactgaaaggaaacagcaggaaacaaactctaacctcttcctgtattaggtaccaggaaaaaataaatccccaaagcaggtatgatcttgtttcctgttgagccactccaaatgggcagataaaaccatctgctcttggtccaatgtagaatagatggtacctcaggttgcagggagccatcctggttatgccacctctgtccccttgccacattgtccacacaccatccctgctcttggtccatgcattttgtgttgctgttccttggtaacctctgccactgcctatgacagcccgccactggtactatgttatgcaaattgccagcctcaatacaaaccctgtctatgaagaggcacttggttggcagagtgaaaacacagagtaacgagatgccatctgcatttcctactacatagctcaattagttgattgatttgtaacactttaaaaaacattttctaggcaaagcacattaggagagtgttttataatgtattcagtttaattaaaactgcactaagtggagtactttgcttcttggtttgagaaaaaaaaaaatttacaaggaggtcacatatcatattgatttttaaccccctaagcaggagtaaaataacattgttaaaggttgcagcatctagagccacacaagtgtacctctttaaaaggtttgctgtaattagaatagagaagattggttagtaagagaaaacatgaggatgccgtcataaaatgggggtgggtaggtaaaggagggaagctggtaacatgctctgaatttgaataaccaacaacacctgctcctttttgcacacaaaaatgcttttatcatctgaagggggaaggaaaaacctgcaaccattccagatgaattcaaggcttaaaaacaagttagaaatgtttaatgtctatgcaagtctttactattaaggtgagtgcattaaaaaccttttggtaggacagttttccaagtttggataattttagatgttaatctggctcctccctttcacatctcagatcgttgttaccaggctgctttctcctcattcccactgcctgtcacattaccaaatgcaagcaggcttccgaattgttagtcagctgattaaaccctcaaattattggagacatttgcatgggtaattatgatttatttaaaagcactttgtttgcattgctcttgtctcagtttcttcaaagccaattactgaaaaattgattggattggtttgatttttgaaatcatttggaacttcagaacacatccctttgcataatttttttgaaagtaaaaccaaaacaaaacaaaatggaaggagttctctttgaaaatctgtatgcttcatgtctttggaacttctgtagtatgcaaataagtggttaaaattagtagtagaaacagtaatagttatttttcaatagaaggagagatcagagtaaatcagttaaattcactgtttcagctccatctcattttgcaaagttacctgtacttagtagggcaatttttttttttctaattctgttggacttctaagaactagaaggattattagccaggatgctggcaataatactgccctatatcaaaggagattatttttctgatgaatatgttgatacttcattatttaaatcctcttttggaagaatccaaaactgaccaatctaatactgaattctaccatctactgtagaaaatacctccatgagtgtcttagtttaagctactataataaaatacaatagactgggtgatctaaacaacagacatttatttctcatacttctagaggctgggaagtccaagagcagattcggttcctggtgaggaccctctttctcattttcttctcactgtgtcttcaaatagataagagatagagaagagagagagagaaagaactcttacctctcttcctcttcttataaggacacaaatcccatcatgggggccccatgctcaagacttcatctaactttaactaccttgcaaatatcccacatccaaataccatcacattggagttagaacttcaacataagaattttgggaggacacaatcatttagcctatgataatgaggttctgactttgtatctactccttcccaaaccatgcccacaaaaagtctcaaaatattgcctttggcttatccattcactttttataagcgattccaaaacagaagatacaattaccattggtttcttaggatagacagttgctttaaaaatattgtaagcaaataattgttgggtatttattacttaaaagttaataatttatgtataaattaccaacagctcatttctatatgataagggtgtctcagaaagacattttggaataatacattcctgtaattctttttttttttttttttttgaggtggagtcttgctttgttgcccaggctggagtgtagtggcgggatcttggctcactgcaacctccgccttctgggttccagccattctcctgcctcagcctcctgagtagttgggattacaggtgcccaccaccacacccagctaatttttgttttttttagtagacacggggtttcaccatgttggccaagctggacttgacctcctgaccccaagtgatccgactgcctcagcctcccaaagtgctgggattacaggcgtgagtcactgcacccagtcttttttttttttttttaagaaactgggtcttgctctgtgcctcaggctgaagtgcagtggcacaatcatagctcactgcagcctcaaactccttggctcaagcgatccttcttcctcagcctcctgagtagctgggactataggcatgctccaccacacccagctagttttttagtatttttttgtagggatggtgtctcaccatcttgcccaggatggtcttgaatgcctggccttaagtgatcctcctgtctcggcctcccaaagtgctgggattagaggcatgaggcactgttcctggcctaattcggtttattaaaggaccccaggccgggcacggtggctcatgcctataatccctgcactttgggaggccaaggcaggtgcctcacaaggtcaggagttcaagaccagcctggccaaggtggtaaaacctcgtctctactaaaaatacaaaaattagccgggcttgctggcaggggcctataatcccagctactcaggagactgaggcaaagaattgcttgaacctggaggtggaagttgtagtgagccaagattgcgccactgtactccagcctgggtgacagagcaagactccatctcaaaaaaaaaaaaaaaaaaaaacagaaatggaccccatagtcattctatccttccaaagacaaagatgttcaaagatgcctctgtgggaacccgttaattccataaggagcgttttcactaagaatataatgaatccatgccaaaaaagaaaaaagacaatatagtacttatgattttatatattactaatggaactggaagtaaaaataattactatttaattacagaaatgtgtactccaatgcacaaatgcctgatagaggataatgacgttggacaccaaaaacgttctgtggctgctggggacatttggcaataatttacatgtttaattgagttgctgtgaaaggctcattgtgcaattacatgttcacttaggtgctcagatagatactggaaatgcctaggtttcacttgtacctatttcccaaattgcgcctgcaacaaatgtgtccatttgcttatgtgggactctacatgtgattgcactctaccgggagtttaaagtgccttctgcccttaggtttgatggctcagtcttgctttgagcactattgcgacgtagactatttatgggacaatattgccctctggcagtgaggcagccagtggttttaataactgttttatgtcattttgacagtttttaaactagtcacacccagcagtttaggccagaagggaaacatcagtgaatgcctacaggagttttctattacagaactcgtacatgcatttgtaccaggaaaatgctacaattcttgctttaaagcaaagctgcctttcccaagaggagaactgaatttttgccgcgtaaagcttcagaaaagtgcaaataataatgacaatattgtgctcacaggacaaacagagaatagaaccattctccctttgagaaattcatgactggagtgccacaaagatcaaccccacgtgagccaatcacaaaacatcttcctgtaatgcatgttcagacactcgtgggatcaaaaaaggacctcagggtcatatctgatcctttggattgaatcatcgtgaggagtgtctcggcttcacgaaaatgacccagagctgctcgctgaagctggagaaaccaaaggcttgacagcagctgccaattcctggaggggtatctcagctgcttctcagccacttacgcaaagggaatgcctcaagagagccaggtgggctttaccagatggggctgaaattacagggagtagaggctctgctatgttgagaagtgcagcttcggcagacagctgagaaagacacagctcagtaggcacctgcctttccagcccagtggctgctgcaggaaacatttctgggatcacagaaggcaactctggatctcatcttggtcattgggacaggaaaaccaggcactgcacggcaaccccacgcattccttccttgcttcccactgcggaataggtcatgcatctctgggggcagagtgcagggagagagggcaggaggactccccaggagagggaggagaagataaaagtagcaatttatgcttttacttcaagcatgcacacaccgacatctagcaaaatgcctggaagtaccctgcacactgtttttcagctcatatttcctgagtgaccttatgtgaatggacacagacactgtggttcaaaagggaccaaattcgcaattctatttcaataaaacaaaaattagggattttgaagttaagatgagatatgaagaaagccaaaaaggaatattaccacagaaggagaaaaaacaaaaaggctagattcagaaaactgagtttaaatgaaacctagaaaggaatttcagactctgcatatattgaaactatcaagagtccataacatgaatgaaatatactgcgtacagtcatttagataaaagtgttttttgtttcgttttattttgttttgagacggagtctcactctactgtccaggctggagtgcagtggtgtgatcttggctcactgcaacctctgcctccctggttcaagtgatgctcctgcctcagcctcccaagtagctgggatcacaggcacgcaccaccaggtccagctaatttttatatttttagtagagatggggttttaccatgttggccaggctggtctcaaactcctgacctcaggtcatctgcctgccttggcctcccaaagtgctgggattataggcctgaacctctgtgcccggccaaaagttttgaatttttaaaacttatcctgtttaaaaataagctaaattattatcactcaaatacaacctcagtgcaaaagggaagaatttagcttagtaaataattaaggcaattgttttaattgtgcaagagataacaaaaatcgcttcaatgatctgatcaattgagggggagaaaaaggctattaaagcctattttaaccatcaagagtatgtgttacacgtatatccacattttgttataggcaaaattcaagaacattaagcatgtcactgaacatgaaactaagacatgaggagacagggttggggctatggtgtggtgactcagattttacagaagatccaatccagaaaagctagagcgcttttccccaaaatatgtaccagtctcggccaaccgctcaatcactaagccttgcaaataacctattttccaaatgatttcaaaagaaaataatgcctgccaaagcaaagcaactcattttccccagtaatgactgcaggaagacctttgatttccttctcagcttctaaagctttctttaaatttccctatttacacacagtgtttcacctcacagattctcctttcaacagctgtgtgggacaggaatgatgcccaaggacatgcagcccataggttttattttgttttctttgggtaattttttgggcagaggtgatatgatttctatctgaagcatttaaggaagaaattgagtatgccaattttgacagatgatagaataaaagccccagctatttctaggtttgaataataataataatggaaataatggcaataacaataacaatgataacaagtgccataacttcttaggagaatactacagactactgttcatacattttttcagtaatcacagaaatcctgtgaggcgaatgttactgttttcatcttactcacgtggaaagtaaggacaaggcaggtgacattgattactccagggccagagctagtaagcatttgaactcaggtctgtctgccctcaattccatgtttttagaccttgtgctactgttatttcttcagattaaaagatgcataggtgggctctggtagacaaattactaaccattctacctaaacctccctgttcctacaccctttgccatgtgaccttggagctcctcccactaaaggagcaggtctgtttccccaaccactttgagcatgagtttgaccatgtgacttgctttgaccaatagaaagaagcagagttaacagcctccttgtggctcttagtccaggctttcattggccttggtgcagctgctcatcctcttgcaccctgttatggctatgagaagaatattcctggccagtctgctagtcccaggagaggggtgagggacatgtaagataaaactgttctggtgacttgctaataaccaaagaccatccagatattcatgagcactactaaacgatcattgctatctgagttttgtcattgcttgttacaattactgtaccatctataaggtctatttgaaagaatatgtgcccaatgagtgagtgtacgggcacatgcacaacatatacacataccaaatggagtggaagtcttggtgtcttacatccagataaccatttggtgagaataaattcattaacaacaacggtaagggaatttcagtattttggttttcctttagaaagctgtaaccattctatttgctgctcagttctcttgttaaaagccaagaggatgttttcagacagtgtagctgcttagctctggttttggtctttgatgaattttacctgataactgatacttaaagggaccctctgcgcaccgccactgacatatctcagtaagagggagacatcttgacccctgaagggcagtgacagttcagtgctcctctgtcgagcccatcctgattgcgctcagtggcagaaccacccgagatggttttgactttgaacaacatcagcagtgagttgaattgggaagtaactttacaacatcaaagcctgccatcaagtggtatcatatcattttatgatgtaagacaccagacaaaggttgaatgaaggaaaaagaagtgtggtgtgcaagtatatattcaccacacacacacatacacacaaacatcacaggcatttgaaggtgttctcagattgtgactaggtgaaagtgttctttataactttggcttttgatatatttacctatctggcactagcaatgaatatttgatacagtcatagctacatgcttagactatgactaagtataatagaagaagtggagaactggcctaatatggacagaaatcagatccaaataatcttgccttaaaaaaaaaacacagatttttgtctcaatgttctatttaacatgctttctgctaactcaactgagaaaattgaatttgggtcaattgttacaaatacagaccaatgcattcaaaggctgtgtagtttcatggctaattgattctgtttaggtaatatttgcaagaaaattacttttataatgcatgaataaaaagatacatgttatgatagttggaaatctgtgaaacataccctaattttctaatatcaaagtaagacataaatatactttgatttgagctagatttttagcaagatttgcataatttcaataacatattaaagagttacatttgtaagtgggagggttgcagggtttagaaccaaactggaagaaaggctggaagtggccagccagttgaaacaaagccctgccattccatagaagagaagtgtatgatgaagagaaagctggctgtgctgtgcaccattatctgccacttttgccttgttaaacttgccactcaatttgatatgacctagtgtttatgttctattttgaagttcttctatgtcttctattttatattatttttttctgttatattgatctgattaagatgaacactgtcacatatcattagcaagttctgattacttgaccattagaaagaatatttatttgttctgttcatccatttaataccaccttgaaattcatagttttctacagggatgtctaataggcatcttaaaattaactgtctaaaaggaactcttgactccttcccttccaccaaacctgttttgcccagcctttcccgccatcataaatggcctcaccattcacccatttactcagacccaagcctagggattgttcttgatttctctccttcccttgcactccacctccaatccatgtgccagccacctaccagttttattattaaaatacgtcttcttccgatgccaccaccatagttcaaaacatcattgcctttcatctaagctgctataaaagcttcctgatgggttttcctgatttgactctttccccttatattggattctcaggcagcatccagggtgagtttttaaacacaaaatcagatcacagcaatttcttgctcagaactctccagtggtttccaagcaccctctgaataaagtctaaatttctcatctcagcctacgatgacctttatgatttagtccctgctaatctcttggttttctccttctgctctctgctcactctacccatgctggccttcctgctattctccaaatgtcccatgcttgtgtccacctcgagccttttcacttgctgttccctctgcttggaaaaccacacacaacccccggtctttgctgccttgctctctcacttcttctagtgacatttcttctcaaatggcacttcctcaaagaggtcttgtctagctaccctatcagacatagccctccatgctctataggctcttaccccttggccttcattgcagtgcaacctgctatccattgacagctgggttttcctctcgaagaaaggaattctggatgcaattgctagcttttccttattattatttttaatgcaaacaaaacggcctctgctgccagttcaaatactgagctcagagctctgttctttcctgctgaaatttataattctactcccattcttctggttctccttgccttataaacaacaaacatgtgaaccaatgtgacttctatattatactgatgattcccctatttaccaataaagtgtgatctaattttcataacagaaacattcattattgaacggtgtattgttcaggtttgtaaatgtgtagaaaatggcacaagcaaactgaaatgatacatgcaaatctattacggtgggaaagaatatttttatttttcaatctataaatactatgattatccttcatatactgtttgcatatatttatgtgttttttgtgttaaagagggaaaacataaaaagttaatgagatcctgaagtgaaataaagtgaacatatttacaacagcaacaagaaaggaatatgtcaagatagacatatcacagagatatatacacatgtgtgtagataagattggtgagatagacagataatagagcttgtacttggcctgccttcacccaatgttgcaatgacaatctatacaatgtaagtatttgtactttttatactttcaagaaaagcagatataaaattaatgcatatactttttgtttttggcatcctttcatggaagcaataaaatattctggagagagagagaaagagagagataaactaactcagggatgtgagaagaagaaaataaatatcactcttactcctccatctgaagatgatgatggaaataattgtcatatttctcttatgttttttatttgttttttctcccagccaagtatgctttttagtgtgggtctctgtgtgttccctttggtaatgtctaataacatttctaacctggagatttatttcttagaagcaaagttctgctcatcacaagccatctccatcagagccatttctccttatggtttccttctcatcatttaatgcttagtacttcttcacaatagaagcaagctgcctttctaagggatgaactgatattctagctagaggacttaatattccttttcagaaattgagaggttctctttgcttttctaggccttaattaagtgattggttatttcataaacagtcagattacatttaccactcacaattgtcaaatttttaaaactcaagtaaactttttttccttcttcaaacaagtctcttattctctcctgaagttaatggcgggcattactaccagtttcttggccagctgctaaggagattcctttcccttaaaaagttaaagtatttaagaatcaccctcaaaccccaggaagggtggtcaacaaaaaaagatgtcttcatggtcaaactttatggacacaacaagaatcccaaagaagggagatgactcaagccatcttttattacttagacgatcgatggcgatgatgtggaatttgcaacaattcttttcttgagacccagtaatagttaccttttgctacataacaaaccgcctcatagtataatggcttaaaaacagacatctattatatctcaggactcttagcttggagttctctccatgcggggtctctatcctcaactggctggcccaggcttgttttcatggtggcagaagggatccacctagccagagggcgagcccccttgcacaacacttttcatgtctctgatcgtgtaagatttgctatcgtcccactgaccaaagccaattacgtgttcaagctcagattcaaggaaggagctctcacttctcagggcagtgctgccaagagtttatgtacacttcagcaatctatcgataccacaaatatgagaggccagctttttctcttttaaaaaaataaagcttataaaataacacaagtacataatttccctacacaatgagtaactagattttatgttttctctttcggttttcctcaaaaacttgtatagatcatcttttgagatgaatagcggagcccttgtgatacaccacattctaagaatgctggggacactgtattcaacccaggacagctgcctaaggttgtatagtctgtgcaccgcatgatgcaggagatgctattcatgccatattcctaaaattttgtatatttattgcaataatttcctggcaaacaatagttacatttctagagagaaggactgctttttctgattcttacaaaaatgacttgttgatttgcaactcatgctgacaagccatcctttcttaaatgaagaaagacttgtttaaccaatggcaaagaattctccaccttgtattgattatctttagcccctcatttcttctgccttgaagtgcatgatttttcctgttttctagagtatgaagtcactttagtcttaagtcttatagattgtgttagatcacattcatgtttacaagccaaatatttcacaattttcaagtaccttgtattcattgttaattttccaagtctgaaattgtttctctctggactcatttttatttcaagttctactctaaatgatttttctttttctgtttcactacataaagttctttcttcctctcaggggatctctgctaatccctttaaccaccgattgccaaagacattcacaacccctgtgttggcttatttctttgttaagtaaaattttttcatcctttgaaattgaaaacctgaaacattttttcttaagtctatgaccaaccattatttataaagctgtatcatatcttagaattagcatattagcatcagttgcaaaaaaaaaataggcaatagagaaaataaaagatatatgtatatagcatgaaagttactgcaaaaagaaaatgaggctgtgtgtgtgtttgtgtgtatgtgtctgtgtgtgtgtgtgtgtgtgtagtcgtgcatcgcttaacaatggggaaatgttctgagaaatgtcttgttatgcagtttcatcattgcacaaacatcatagactgtgcttataccaacctaaatgttatagcctattacacccctaggccatacagtataacctattgctcctaggctacaaacctatacaacatgttactgtactgaatacagtaggcaactgtagtgcaatgatatttgtgtgtctaaacatagctcaacatagaaaagatactgtaaaaatatgatataaaaagataaaaatggtccacttgtatagggcacttaccatgaatggagcttgcaggactggaagttgctctgggtgagtcagtgagtgagtggtgagtgaatgtgaagtcctcaaacattaccgcacactgctgtagacttcagaaacactgtacacttaggctacactaaatttacaaaaaatatttttctttcttcaataataaattatttactgtaacacattttactttatgatttttaacttaattttaactttttgactattttgtaatcatacaatttaaaacacaaacacattgtacagctatacaaaaatattttatttctttatatctttattccgtaagcttttttccatttttaaattattaattttcatgtatgtatttattttcacttttcagactttttcgttaaaaactaaaacaaaaatacacacgttaccctgggcctacacagggtcaggatcatcgatgtcactatcttccacctccacatcttgtctcactggaaggtcttcaggggtgatatactcatggagctgtcagctcctgtgataatgataccttcttctggatacctgaaggaccttcctgaggctgttttacaattaacctttttaattagtacaggagtacactttaaaataatgataaaaagtttaatatagtaaatgcataaaccagtaatgcaatggtgttttgttttgttttgtgtttttttgttttttttgagacggagtctcactctctcacccaggctggagtgcagtggtgcaatctcagctcactgcaacttccgcctcccgggttcaagcgattctcctgcctcagcctctcgagtagctggaattacaggcgtgcgccaccacgcccggctaattttgtatttttagtacagacagggtttctccatgttggtcaggctggtctcgaactccgaacatcaggtgatctgcccacctcagcctcccaaagtgctgggattacaggtgtgagccaccacgccccacctaatataattatttattattaactattatgtatgtatataatcatgctagacttttatgtgactggctttgcagtaggtttatttataccagcagcaccacaaacgcatgaataattgtgcaatgataatagtgcacatgagtagttgtgctctgacattatgatggctatgacattattagacaataggaatttttcagctccattaaaatcttataggaataacactgaatatgcagtccgttattgaccaagacatcattatatggcacatgactatatatatccttaaagttattatgaaaactaacactgaatctccatatttacttctcttcgaagagtttaaaggattctaaaatttgtatttgagagtgagtgtgcaagaaataaggaaggtcagaaaagttttacatttgttaatctcatcctgagagtattttttgtaaattaaaaatacatgtattttcatcaacaactggctcacattccttaaactattaaagttcccaggtagacacacatgcatgtgtgtgagtgcgcccccccacacataatgatgtgttttagttttgcatctgaaggaaaggaatgctaggttttcttgcccataaatttatttttttaatttattttaattttcttttttttttttttttttttttagagatagggtcttgctttcttgcccaggttgctgtgcagtggcatgatcatagctcacagcagcctcgaactcctgagctcaagcaatccttctgcttcataagtcactgcatccagccttgcccacaaatttctaattttacctcttcttctttatatcttctgagaagaaagagatgtttcctctatcagtggtcatttatagcctttctaagtctaaggaagaattgtggcagacataaagatcgttgaatcaggactaagaaaagtagattctagctgatcttgaaagactgacttcacttctctggggagatgatgggtttggatgaaataattccagaagactttcccatttttactcatctctgactctattacagcttttctatttcacccttgttcccaactctcatcaggaacttaaaagaaagacacaaactcacaaacagcgagaaagagagacagagaaaacaataatgtagggtatcagtcatctattggcacaataatgctgcataacagaccatcctgaaactcagtggcttacaataaggttttgtttttttaattcacgtgtgctggagcagacctgccttaggctgtaggtcacccaaccttggctccaggctaagatcctgaaagaagggctcaaatccactccctgtgtcttaatctaagcccttagataaaggggccacctcctgggacacaccctcctcctggcaaacaatacaaacataggtcctggccaaacacccaagcacacttaaaccttcttctcgtgtccaatctgctgacattccattggccaaagcaagtctcgtgatcaaactccaaatcaatgaggaatgagagtgtgttctgtccacgggtaggagggatttggaaaagccatagatatttgcagaacaataatccaattttccacattctgctacaaatatcatacactgaaatgccttcagaaactgacaggaatgaagcaaacagcagagggaacacaccatcaaaatcaggcagcagggactcagcctcagggtcaaatgtctcttcttcttgtgtttgtttttttcttttgagacaaggtctccctctgttacccaggctggtgtacagtggcacaatcatagctcactgtagcctttacttcctgggctcaagtgatcctcccacctcagcctccaaggtagctgggactataggcacacaccaccacacctggctaattattattattattttttttttgtaaagatgggattttgccatgtagttcaggctggtctcaaattcctgggctcaagtgaacctcccaccttggccttccaaagtgctacgattatggatgtgaaccatcacgccctgccagatgtttgatttttaaagaggggagatagaaagtcacagtcttttgtctaaattttctatttaaaaaaaaaaagttagaaagcagcttactttctgtctgtctgtatacatatggaaaattacatgtatgcatatgtatgtatgtgtatgtagatgtatgtatgcatgtatgtaatatatatgtctgggtaaaacaaagcatctgcagaccagatgtaattttgagattgttatttgcaagctttgactagaaacctctcttgtttaccaatatatgaccctataattacacatctaagatagttttaaaatctttctgggccaggcacggtggctcatgcctgtaatcccagcactttgggaggccgaggtgggcggatcaaaaggtcgggagatcaagaccatccttggctaacacggtgaaaccccatctctactaaaaatacaaacaattagccgggcgtagtggcgggcacctgtagtcccagctactcaggaggctgaggcaggagaatggcatgaacccgggaggcagagcttgcagtgagccgagatcgcgccactgcactccagcctgagcgacaaagtgagactcggtctcaaaaaaaaaaaaaaaaaatatatatatatatatatatatatatatttcttttgtattcaatgaggccataatttcatcctgccccatgcagagttaacacgtggtcaagctctttggcctaaccttgtgtagatctttcctaaaaactaaggactgtgtacctatgatgttacaatgttgcattactagagaaacacaggatttactcagcactttcaagtacatacattgacttaatccacatagtaagtgattctattagcattttgtagatgagaaaactggggctcagaaaaattacatgaaattttcaaggtcgtagggctatagcagagctaggtttctaggtcatttaactctttctcaactggcaaggaagctaagtaatcacagattcacagaacaccaaaagctgttctggctactgttatgatttgattctaatattaattatgtggttagaatgattgtattagtctgttttcacactgctataaagaaatatgccagactcaggaaagaggcttaatagttcctcatggttagggaagcctcaggaaacccacaatcatggcagaagacgaaggggaagcaaggaccttcttcacatggtggcaagagagagaagaaagaaggaggagcttctaaacatttgtaaaaccatcaaatattgggtgcaccaaaatctcagaaatcgccactcaagaacttactcatataatcaaatactacctgtttcccaaaaatctattgcagtacaaaataaatttataaaaagaaattaagcattgaaaacagatatttctttcctggaaaaaaaaatcagatcttgtgagaactcactatgacgaggagagcacatcacctccctcttaacacgtggtaattacaatttgagataagatttgggtggggatacagagacagaccatatcagtggtatttcaaaatatcttccttttgagtcatttaaatcccttatttgatgcagagatagtaaaagccctaccagataatcaggaggttgctattatccttttttgtactttgtttcatctgctcttatgtctttgaacctcatttccgtcagatgattaaataatgattatcttgtctacaaataattggttttgttttgtgatttcacttgacctcaagtgacatgatacagttttaagaatgtcacagatgttaagttgtaaatcagggagtgctattttttttaatcagagaaatatgatgattcagtgtttagaacatattctttaaaatgaggggacagagattctaaacttgattctgctgcaaatcagctatgtcatttggggctctgacatctcattttactctctgaatcatctaggaaaaagtaagatgatgattacaaagcactgggagctctttcaaaaggcacagctttcatctaaaatgatattactaattaattaatcagatcaattccctgttaactcatcctaatagcccaagccctgttagccaagtatattactgtgatttattttgacacttaatggaaccgtgcagcatttcagtcacaggttgataacctaagcattataaacttcaagcagtgtttatagttttgttgttgttgtttttcctgaagacagctgataaaagatacccttttaggaggtgctagctacatccctcaaatgataaaaaatacaaagtggtgagtagatgttatgaacagcattgtccttaaaagagaagtcaccactgatctcgaagaaaagtttgcaaaataaggaagaagaagatgaggagatgcagtcttcatttcatttcttttcccaatattttgctgctgttttgtttttaatatcttccttggagcaatgaatcaaatgtcttccatcaaagaaaagcaatattgatatacatttgcacatagtaaaatctgcatgaattcacggctcctggaaaggaaaatattttctctctttctctcttcctgtgtttctttaatgtaataaaatagcttcccttggaggtcaaaggattctgccatttctcttttctgtgctctaagacagttgcaaccacttgttttgaaacttgcttttggttttggggagttttaatggaggtattaactggtgcctaaagggagcaggttatgtatatgtaaaagcagggaagttataggaaagtagctataaagactctaagcagttcaagagagttatgttaattgctgtttcaaaatgctcccctgtagtgggagccttaggcctccagaactcacttttctctcagtgactcttatttagtttattttcctttttatactgtgctttttagagttttcctggtctcttttactttgaaatctcaaaggctgtccctcggaggatccactgtttacttctgaacactttctagagattctgatgggtccaaattccccaaggagctggtaaaggtctgcttcctcccttcatgctgagtgtgaaagaagggaagagtctttcacttcaaacttcagagaggtctacctaactggagagtgaaccgaaactctgaggagcactggccagggagggggagggcagcacactgcactgtctcacctgggcattttcattgtcacccactatgaaagatctgctaggagaatcgagtttcagagaaaaaaaggaatgaacatattttgcatgacagcagtagtatttcccctctgttccccttctacagagaaaaaaaaaatgtgttaatgactttctaagaacaattactatataaatgtgacaaatttagattgaatttggatttgatcctcttctcacacccatttaaattggtttgtgctcctagctcctgtgccatatcctatgtggaaatttaagaatgacaaagttcataaatttggaaaggagaagtttgtttctcataaagggttgcagcttgcagggtggccattctgacgggctgagaagtgtagcctccagtcagaagccagaaacagacactttgagggaggggcaaagggaacaggaatttatgctgagctagtgactgaatatacatatttaataagctgtaggaggagtcatgaatatttgtgatagaagaaacatgcacagatccagcggagctttatgccccttcctgagtctcactacaaaaaaatggcagtacaagcatgatctgagggtggcgttttccatgctctaacatcaataggtgaagccaaggtcgcaaaaactcttactgcacattctccatagactggacagaaccattccatggtcagtgttctcttatcagccaaaaaaggaagggcagcctcaggcagatcagtagtgtggtcttttgaaagaactggtttctgtttagcccttagggaataaagcctaattgtgattagcaagggagggggtataacaaggcatgtctgacctcccatttcattatggccaataaagcagttttcaagcttattttggggtccctttggccaagagatgatctgttcggtcaggtgggggacttagaattttattttccgtttacatatggaatagccaaatattttatgatacactttgctagattgtgaaatgtttggcaaatgaaagaatgggacattttcggggcgaggggaaggtcagcgaattcatctcaggatatcctgaagaaatcaaataatgaggcagacaagaccacccttgaacagactgccatatttcttgagcttcaggaagtttctttggaatgccaaagtaagaataaagttggcctcccatgaatactagggcaatttggtgatgcttactcagatccaaagaaataaattataacaaaactggaaaagtacccatgaatcagggccaaatttataagcatacacctaaaagtatggaattccaggcctgatatgtgaaacgtaaagccctaaggcaaatatatttcatgtgggttggcataaggttgcttccattttcacagtattttaaaaaacaaaatgaagtttttggcaatgcttcacaattgtagttttcacttaaaaatacagatttctggcttctcttggaagactaggacacacatgcccaagaattgaatagcagctacttctttcggcagtaacatgaactcacctggtccatgtgttcatgtcttacccaccatcccctcacacacatactcccaagtatctgactcttgacacttcccttactcccttgacctgctgtacctctgttgctgttctatttatcaagcaggaccctgtcctctcccaaaatattctccagagtgatggactgtgttttctgggaggcttctctcacctgaaggacaaggttgacctgtctggctgcctttgctggctgatgctgactatttccaactcagctctctgctccatttggtgctggcttcttccagttgtggatcctagtctgtcatcttgacgacactccagaccacccaaaatgtcaacttggcagttgtttaaatcaaatcatataataaaataattaagctgttaggctgtgctgatatacattgatactcttagtacacacacctgcaagagtggtctctttgtaaactacatgacaacgagaacattcccttttaaaagttcctattttcaaatctgcctaacagcaacatatttgctccaaaactacatttctattttacaggagagagaacagaaaccaaagcaaaactaaatttcatgtcttgattactcaacaagagagtgtattgatgacacaagttgtcctgggttaggtagtgattatatttaagtgccatagaagattttcttggaagagattgcaatcactataagtacttagcattgcattgcttacatgaaaagaatgcgactgttgagaggaaaagaagcctctttagtatagattagtcttcctattgtccattaattatgaatgaaagttgaaattcggctcattgtgattcaatgctagattctataaaaacaacagtgcttgtttaaggaactgcctggaagatctgctttgctcttttgctggtgcagttacttgtggaggttataggaatttagggacatggatttttcctgttactacagcataaatatgttgtaatatacaaatatacatgtatatctgaatatgtatgctgtatatatttacacacacatacatattctaaaactcttctacttcaaccagggcagcagctactcttctgtttagttttatataatgaggttccatataagattatacttaaagagaaagtgccggtttggttaagtaaaatttagaaaaatactaatctagtccaactgtcctattttctgcatgaagagaccactgagagacatgttttttttttttcatcacactgttggttagtgacagagccaagttgattcttttttttccttccttccttctttccttccttccttccttccttccttccttccttccttccttccttccttccttccttccttccttctttccttccttccttccttccttccctccctccctctctccctccctccctccttccttcctctctctctctctctctttctttcgagacagagtctcactctgttgcccagactggagtgcagtggcacgatcttggcttactgcaacctctgcctcccaggttcaagcaattctcctgcctcagcctcccgagtagctgggattacaggcatgagccatcacacatggctaatttttgtatttttagtagagacagggcttcaccatgctggccaggctggttctggttttgaactcctggtcttgagagatctgcctgcctcggcctcccaaagtgctgggattataggcgtgagccactgcaccccaccagagccaggtttagaatacaacgctcccaactcctagtcagtgttctttgtactgtatttggccaatatgtattgattgtttgctatgcacagacactgtgccaagattgaatttcctcaggtgataatcccactaaccccatgaggtcaatcttacgtatgttagagaaaaggataaaaaccctcagggaagataagtaacttggtcaagtttgcacagctacaaagtgcagtgtcaaaaattcaagtctaatttaatctaattccaatgtcaataactgtactcttatccacttctctctactttcctcataaccatttttttcccaggttggtagaatagaccacaaaagccaactttgtgtgcatttctatatccatatataaaataatataccaaaatacatttgatcatggcatatttattaagtgttctatattactctgagctctattactctttaaaattttttaaattctattcataagcgacacataataattgtacatctttctgaacttcattcttaaaggaacaattgtagctgcatcgaagttgacatcagggcaatttctgcttcacagattttgagggcctggaagaagatttgatgagaatattttaatccctggatgaattttatttacctgtgtaggcaaaaacttagtaaaagatctttgaaccctaaatattttactttaggtacagaggttataaaatacctctgtacctttaggtacagaggttgaaatgaatgaactgttatcttagatagtatgccatttcagcatgagaagggaatctgaggatttattatctataaacacagaatattcttgcagaatatcttcaacaagcacttccagtcataattgaaggaactgaccagcaaagagagaagggaaagaaaagtgatttatagctcatatgctgtcttgataaaggatctaggttttatgaaatattatggaaactttaagtgctgagaattctatgcaatctaatcaaagattgtagtgctgtgagtaaaagaaaaaaatgtaacaacagagagggattggagaggagtggaagaaacagcaagtaggaatcacacagagactaacaatgataattcacaatgataattcaatttaagctggtcctctaactatcatatcccatggggatcccaggagttacctggagactcggcattattattcagagaacacttggaattaatgcctctcttattgttgaaattctccctagagttgtttgcatacaccttgatatcgatgttctaagaagctattatccctttatgtgcattagatcacagaacagctacattagagatgctcttgaattttgatttaatcaaacaggcatttttatgcttcagtcctaataatggttccagtggttcatccagtagttcctgatatttgggtaaagaggtaggcaatgtgagctgtccattgagatattttgctttgcttaattcagtgtgatgctgtgaaactcaaccaataacagtttgaaagtgtgcccatgtatccaaataccaagtagcagcaggaaaagagttctctgcagccagtaacaattagagatttattaagactctggaaaacttactggctggtcaaaaaaaccaatgataatctccacctcactcagggaatttaaggttgtttgtttgtttctttgtttgtgtgttttcccctccacagcctaaggattcagaaaggtcagaaaaacagaagtcacttctcttgatacttcttcccataaagacttacctttctgccagggaaagatatagatttgtataacttccattattgtagaaaacacaaccaagaacctgccgcaggagatatcctgaaaaccattgcaactgttccacgtggggcgaaaagacatctctagttgtgttggagccttattgatgttttgtattgctatgttctgctgtgccattcttgtatgaaaaacaggaaaaagataagttataaggcattttagcatatcagagcatggttagcacatttagcttagaggagttgctccattacaaaattacctctttgtaaatcatattattaaaaaaaacacacatctgtcttctcagggaattgccttctgaatataaatctttgagaactgatacttaaattccactgtaatttaagtttcactgtaattaaccaacattttatggcctagcccacttctgccttctaatatatagtttagtgggaaagacacaagttaaacaaacagaaaaataaatatttatttaagattctagaaaatcttttaactggacagagaacagccttgccacatgagagaatagactaagaatggcttacattaagtttactagtctggtatgttctctctgagcagatagttaagctgagtcctgaaggatgagacagtaaaaccattgggagaacaaaggaagaagactaggctgtgcagaaattgttgtggtttgaaaaagctgagtggggaacgggaagaggcccaccttgccaaaaaggtatttaaaaacaaggaagaagagggcaatgacatgcagtggtaggcaaggctttatcacgtaagactttaagaatattgtagctctagtgaaagtttgaatcagagaaatttaaatacctaaatgtcactttgaaagatcattctaactattgtttgatgaatggtggttgctatagggcaaggggcaaaatggaagttcattgggaggcttctgtagttgtttacaaagtaaacaatgatggcttagactagggtggtatccatagagagagaagtagacagattcaagatgcatttttgagggaaaactgagagttgtatgaattcagtgtgagggattcaggactatgtgacatctcatgaatgccctcctggtttctgctctgagtgtgtgggtagatggtgacattatttactgagatgacgagggcatcatctataccttgaatacattgaatgtatttcttaatttctccctcattcctccttctccctttccttaccatgtttctctaaatcctagctatcttttcagattcagcatgcttaataaacatattgagtaataattaaaataataagtttaaaatttttgagtggttctaaacactgtacatgcccaatttatttaatcctcccaataaaactctataggagaaattctctttacaaataaagaatgtggagacacagagagcatacataatatgcctaaggtcacacagctgtatagcaattgctaggaaaagcaagcatttacctttacagagttacagtcaaatgcaggtggcagacttacaaacagactgatgcaatgctttggcaaagctgttttaacaatggtttcagtggccttctatgtgacccatgcaggggaaactgatctggccctgggcaaatgtctgtgctgttataacaaaataccacagactgggtaatttataaagactagaaatttatttcttatagttctgaggctgggaagtccaagatcaagatgctagcaggctcagtttctgatgagggctatctctgctttcaagatggcttcttcttgctgcatctctggaggggaagaacactgtgtccccacatggtggaaggtggaagtgcccttcaaatactgtctgaagtctctttaatgggggcctcaatcccatttatgaggagaggaggcctcatgacctaatcatcttaatatgtacacattggctagtaattttcaacgtctgaattttagagaggacacagtcaaatcatagcagcagagataatgaagacaggctttctagaggggatgatacccgagctacactttgaaaagaaggtaaaaatcctggtggaattaatgggggcagggaaggctttctcaggtaaaggaacatatatgcaaaggacactatgtagtggggtaagagcagggagaaataatgagatagtattgagggacaattgatgggaaatatggctaaagagatagattacagagatgaagtctggtattcatagagatgtactttaattatttaaaatagatctcttggcactatatcgagtcgatgaattggggagggcttaagtcacaagtctagaaatacaatttgaaaacttgcatttttatttttctattggagaaaaatgatggtttgatacagagcaacggtgttagagatgaagaaaagatgaatttgaagattaaatgagacaggacatagaaagcactcagcacaaagtttggcatagattacctacataagaaatatcattgtttcagatgtctgttgctgtttaacaatccattgtaaagcttggttgcttaaaacaacaaatacttactattttcttctaattctgtgagttgagtgggctcttctgggtggttcttctagtcttcagttgcaagtaaatttgatttaattgattatgactgaggtcactcatgtagctacattcaatttcaactggactggggctggagctgcaagaatggcctttctccaaggcctcttttcagacaagctttagtcattcactggtctagcctggacaacatggcagctgggttctaagagagagacagtggaagctgctaatgctcttactgtatggtcccaaaagccctataaccattttcctttcaccttcaaattggtcaaatcagttacaaggccaacccaaatccaaggagaggggaaatagagggagacatatgcagatagagaaatggcaaaaaaaaaaaaaaaaaaaaaagttgttggtgactgtatttgtagactgcataccagttatttaaattgtctaatgccaatttaattccttaaacagcattcttcatttatatttgtattagtttctttctctagctctataagcttcctttctatctcacacagagtctttcctatcttgtactaaatctatgttttagggtttttttccccttaatgtcccggagaatacaaaacagcagttaccggaaattcaatttattttcctagctgaggtaaatatttttcaaaattatagtctttatttatcttttacattctttcttttttaaattttcttttttagttgctgaatattttcaaacatactggttatgcatatgtatgcctgtatgtggcttgtttatttttcttgactgactattgaggatgacaagtctatacagtctatccatgttttctatttgcataaaaattgtttgtctcgattctccttgagacctgggcagcttgagttctccccatttatatgggcatctttaactcttgaggattgtgtgctggaggtttctaattagcaaagtggaaaggcagctacagtcctagttgataaatactttacgtcatggtttttgtcttgtttgttttgcaaagaatgtatcagactgctgtgttcacctgaccttatttctagatacaccatgtggttctcatcactatcactctggagtttctacctatcactctggggagtctccagtcctattggaggggtatttgtctcattaattaaaaggctcctcctggtttagtcacctatattgattaaaagtcatgaaaattccactatctttctctttaatgatgccttaggtaaggatacagcttactatccaaaataggacacttttaggataaagatacattgttaataatgtataataataaataagacaaaaaatgtaactattttggaaaatgaggctatatggtcactcaagtgatgccataactggagcttttgcaaccagtgtgtctccagttgcctctctttccccgtagccagacctccatccatgtcctccagactggtggagtttaccccagtgggagcaagtttacactgatattagtagaaactgtgcttggaaaaaaatacacttaaaatagactcatgctttctcttcccacttcacacggatgctgacccacgatgaggaaagggatgcgagctggctacctatgtctcagttccctcttccttcaaaaggtgcaaatattaaatagtttgcacttcttcccctcaacatttcttgcgatattccttgaaagaaaagttagttgttagtggatattccatgtaatagtctcaaatgtcgaatctgtggtagagagcaaagcatataaaaaaattataggggattaagtgtgtgactctacagtttgaaaaaagcactgtagctagttttaacatgcagtatctctgacttccccagcgcatgtgtattgagaaccactatcctctctgatgtaacagtaaggtgtgttgtaacaagtgcctggtagctcatgctaccaggatcaagaaaaattagctctgaggaatgatttttttctacttttattttatatggtattaatcacatctaagtaaacttgctttttgtttgaagccagatgccccaacagaccaagttacacagaaaagaaatttatgcatctggtcattaatgcatatttggcccctaatagctacatgtaaaataattcacttgaaaacattactcatttttgtcaaagggctgcacaagagctttattatacatcttatttttaaactgacttctactataaatgaagttttactacttcctgatcatcttcttctgacaacttgctattcagtttttttggcaaaataaaataacaataaaacgtgattaatttattgatgaatggatggagaaatagatgagtggatagacatatgattaaaacaagaacagtaaagctttagtggtagaatctagatggtggataaatggggggccatggtagatttctttcaacttttctgaattttgaaaatttacataataaaatgttggaaaatgattacttattattttctattaaaaatcacggagtaggccgggtgcggtggctcatgcctgtaatcccagcactttgggaggccaagatgggcagatcaccaggtcaggagatcgagaccatcctggctaacacagtgaaaccacgtctctactaaaaatacaaaaaaaaaattagccgggcatggtggcgggcgcctgtagtcccagctactcgggaggctgaggcaggagaatggcgtgaacccgggaggcggagcttgcggtgagccgagttggcgccgctgcactccagcctgggtgacagagcgagactccgtctcaaaaaaaaaaaaaaaaaaaattaaaaaaaatcatggagtaaagggaagttttgtagtgctgtcctctctctaactgaacaagagccactaaaagcagttagaacacaagttccaagcaaaacaaaacaaaacaaaaaaacacagcagtggctctgaagctctccctcctgtcagagatcgtgcagtccagatggattcatgggaactgagaactgactcctgccgtcttgattctcttggagaatatagattccctctcccccaacaacaagtgtcgtgatcctgaaagacgtatctaagaattctttacatcgagttgtaaaacctcaggtcatttaagtgactcagtaggggagaaaaaacataaggcaaacagaaaaagagggtaagtttagggaggaattatgcagcagagttattttctatgttctgtaagtagatctttaaggggaggagtgttctctgaggtgaaggggtgtcaaggagtgtcagattgaagcagagagccctaactgaaaggcttttagctgagtttccctgaggcaggtcctcaggtgtccaacattcctgagcagccactgtgcatgtttcatcatacatatcccaccgtgctttctcttcatcccgatactcttctgcacaaaatagccaccctaactttaaaaatcaataatacttttggaccagttgaaaaaataagagaaattaaaagaataaaagcaaaattaagggatattaatataaagcagatggacatcatatatcacagaaataatacccaaagagacacaggaatattttataaaatacttcttcatatccgcagagttctggttaacatgttttatcaaaaacaagcgatcgaagaatagatacaagggttcaaataaaaagtaatggcataacataaaagcgttagagttaagccccgttaaaaataacaaaaggagaataagatggactaaaattaaagactaaggagatgaatttgagaaaatcttaacaatattaaaaaaaaaaaacccagcaggggcaaatcattctagattagatgacagctattatagacagtcaaaagatatccagtgtattaataatttatgttgctcagaacaagtggaagagaaaaaattatatttaagatagaatgagaaaacatgagttgagaaacatgatcctaatttgtaagaaaaaaaagtgtgtgccagaaaaaattgatgaaaattttcaatagcaaggcattataatattgaagttactgaactgcaaggataaagaaaaaaatatcacatttctatgtaagcagaaaaagtaaattaaatgtgatgcttgatgtattatagtatctgatgccagaagatagttggctattgtctacaaagttaaaaggaagaaaattataacagaataagataatactcctcctttttcttttgaatagaaagtcaaataacaaattatctcacatatgcaagaactgagggacgagagtagacttgccccatttttggtgtgaagggcaggtggacacaaggctgtgaagttcagccaaccaagagatctggactcttgaaaatgaagggataaagaaggtaaagaaacagtgtcactcaatacatatatttaaatttagaaagcagataaaacaacaatggggattatagttataaatagaatacaaacattttaaaccttgacaatacaaaataatcatataactatcaaaattaagtgattgagatggcatacaaagtgtaagtgtcccaatttttgtatcccatactgtaggaataaagaaaatttttgttttgttttgtttttgtttttgtgtttgtttttgagacagagtctcactctgtcgcccaggctggaatgcagtggtgtgatctcggctcactgcaacctctgcctcctggttcaaacgattctcctgcctcagcctctcgagtagttgtgactacaggcatgcgccaccaagcctggctcatttttgtatttttaatagagacgggatttcaccatgctggccaagctggtctcgaactcctggcctcaagtgatctgcctgcctcggcctcccaaagtgctgggattacaggccgaagaaacattttctactgttggcatacatagttttatgtatatacttatttattttttatttcaacttgtattttagattcaggggtacatgtataggtctgttacatgggcatattctgtgatgctgaggtttggggtacaatgaatcccatcactcaaatagtgaacatagtacccaatctgtagtttttcaactcttgcttctctccctccatcccccagtaggagtcccccgtggctgttgttcctatctttatgtccatgtgtacccaatgtttagctcccacttgtaagtgagaacatgcagtatttggttttctgtgttaatttgcttagggtaatggcctccagctgcatccatgttgctacaaaggaatgattttgatatttttttatggttgggcagtgaaatacatagtttgcccatattgactccaacttttaaaatgctttaaaaatcttcttttttaaaaaatttaaagaaatattttagaaaataaaatttttgtgctatggaaatgttatgtaaaatctttcaatttaacttttttatcacttgaattcaagtttaatcttctctcctgtgaataagcctactgctgtatgaaatgctgtttaccaaaggatgacaatgattatttctgaatttgggggaattgcaatgttttttattttacttttctgtattgattttttaagtctatatcactttttcaagaaatatactctttttaatgtaatcgtttccatctggtgttaacaaaggcaaagaatgactttgaggataattctttaatctttccatatccacaggcagctcatttgagcacgagtagttagttgctttgactggatagtgatctctgttagccatgaaggtggtaaagtcactggaatcatcgattccatttagattccagtagcttagacaaaaagcgaccagtttactaaaaaccttagaaaacaccttagaaaacacctggaaatgccacacttaactgccgttgctgagattattagagttttgctgctgttgttgtgggtatactttaagggtaactaaatttccagagccataagtatatgaagccttgtccttcgtaatagtggaactgaagttcttaagaggggctcaggaggctgactcattgtttcctcttaggaagtattggtatttaacatgtgatttaaaatatctataaattgagttatgacatgagttttcacatgatgaccttctcaccaatgtatttgtgtaattttgatgttagtggagttagtttatgtagtgaaggtggaaaaatgtgttactaagaggtaattactgtaaagctatttaattattgatttccccaacatagcaggattgacattttgcagatatagtgaaggaaaagatatgcattaacagaatgagaacagaataaatgtacgttttaaaaagaaacacaattcattttaataggtatgcagtcattattcaggaaatgtgactgcttctccataaatgacattagctgtttaagttaaaatgacagacctataataagtaaagatattatgagggcgttttaaaccctagcattggcgtaaggttatattaaaacttcatatttaccaacattgtttttttgtagtctctgtcttcattaccctttatgaaaagcacactttattttgaagtatttatattggcttgtgcttcattcttcacttagaaaagcattttgctttgcatatttgtctaatagctataaataaatgcagctacttcttcccttgaaatgagcaactttgcattttaggctgaatgaaaaagatcagctcaggacttctacagaagttccagccttgctgaatccttgctttttcatccctggtttatctgcctttctgatttctagccacagcgaacaagcatctgactacatggtaatgagcccttaaaatgacaaaaagaagtgcttacacattcaaaggagttttagcttctaaagaatagcctttggttgaaagcatgttttgaactgtcttttggattgcgttcagagtcagtgtatgagacccacaagaaacaatgcctcatttaattacggcggcacatgattcctaacataaaatcatatgacccagctggtcaacattcatatcaggcaagctttgtttgaaataatattcagccatttttcttatatgacagcaaaaacacaaagggaaggatttgtcaccatttaaataattcaaagaatgtaacagcgattctaaaatgagttcccaaaaatgaagtttcagaaatattctgggccataaaagactattgagtatctaagaaaaagttggaaatagaaaagcttaaaaaatgaaatctgcagaatgaaaaggaggtggcaaatataaaaataatgaattgaaaagtgaaaaaatattttcaaattgattaataactttaagtactttttggaaacactacataaagaaggaagaaaacacaagtgcataaaatttaaaatggcataaaggaaatgagagttatattagaaattaaaagaataataaaatagtgcttcataaagctctacaaaaatgcatgttaacaattctcaaaatttgaggaaccaagtgttaacaaaagtgattctacagaagagatgaaactcgttgatgaataactatgaaaattatatagaaaattattaaaaaggtatagcaaaaagaaatttccagactcaaatggttttcaaagggagaattcttctgaaattttaaagaaccaatttactaattacttaagctttccaaaacagagaagtaatgcagcctccaaattttttatacaaagacaatgtaacatctaagttgaaatttgatagagatgatgaaataggacaaacttataacagtcttatgtaatataatcgtactactgttggggccaaaacattaaatgttagccaaatgaatggtggtatattgaaataattgtgtgtcattaatcaagaatatgtatttttcaaataaatattcagcatcaagttaaatgataaaaattttgaatttttacattcttattatgaataagatagtaatgcctactatccccgccattaaaattattctagaaatagcacatgtaattcaatatgagaaatgagaattaaaggtataggtattggtaaggaagagacaaaaattattgttagttctattcctaagggactttatctcaggtatccctctctgacaacataattgagaagagaaatgagcaagagtcagattatccaggaggccgtgtctagggttcttatgtgatttatgtctctgatttatgtaaatattgacaaatatagattaatctctagatggtagaaaaaccaaaggaggagcccctgctcacagagaaaataaaagatgaattcaatgtttcttagatccagcttaatctaaaccatggggcattaaatctttttagaaaaaaaattatcattagttgctgcttatgtaattgtatacctagtaaatgcagtggaatcaactgagaaatgtgcaaaataattagttaatatagaaaagtaccaggaacaaaatcattagctttgattcttcatcttttctatttggtcagtttaattatatacagaaaatagatgtcaatgtatttggatgagttttataaagtattatgttatcattaatttcattttctctatatctgttattaccctgttatgattttaactgttgtgtacatgtctttgtgttctgcctttttcatttttattatgcttcatttttcaaaaggtctaaaactcactgatcaattctactattatttttctttgttttccatctttcctgtcaccttccttttgatttccatggaagtagttagtcattcttctcaattctttatttggatgctcaatgttctctccattggcaaggccacttctggaacttgatatttggagatttctttgaagttaacattcttttctttggaatattttaaatggtcacaaatactcttctatttattttcattgggtaatacaaaaaagtagttaagtttatctaaagaaagcttagctgatatacactggttgaccaaggtaggccatgtcaatctgtataaaaaaaaccatgtgtcactatgaagtaaatgagacattgtctcttgtgggcaattttaaaaaaaaaaggatgttcaaaatatgtttttaataaagtctgattatgtttcttttcagtagctaacattcatttagatgtgtaagcatcatttggggggatgtataatttttaagaattcattacaagtatcacaaaagataaacacacataaagaattatataaaaattagtagcattgtaaacaacccaaagcagttagaaaatacaatgggagaaataatccatttataatagcaacaagaaaagtaaaatgcctggtattaaagttaaccagaaatgtgaaggacccatatgaagaaaacttgaagctctaaagataacataaaagaattcttagtaaaattagagatacaggtattctttataggaaaccacaatattatacattgacaaactgacaaatctcagtttagtaagctgcaaattcaatgtcttaacactccatccaaatttatttttgtacttgacaaaataacacaaagttcatcatgaaaaataaaagtgaaaaatgctttgaaatgtttcgaaaaggaaaatgaatgagctggaaatagtattatctatataaaaatagccaacaaggctgtactagcttaatcagcttgacactagagaaccaatagattgtgagagaatgttcccagattctccagattcagaggtaatactggcattcaaatcattgggaaaagagctttttcactaggtggtgccgggacaaggtactaactgcatgcaaaaacaaaaattggatggtagtctcatttctcttaccaaagtaaattacagaaagtaaaaattaaactatgacagtttgaggaaaaacatgagtgaatttatttaaaattttggaattagtggaaagtctttccatgaaggacacaagacacagagcacaaaagagaaaacattaacaaatctataaagttacaaccaactaaaaaaaaatctgaactaataaaaatacagtctaaacatgtgacaggtcgagactaattttcttaatttgcaaaattttatacaaattagtaaggaaaaaatacacttaacccaagggaaaatggacaagttgctgaaaaagaaatacaaatggacaataaaaacgtaagaggaccatctttgccttcctaattaaagaaaggcgaataaacaataatgagatgtcatgttttaatcaatcagattgatagcagttaaaaaaagttagataatatccagtgtcaaatgaggatccagaaaaatagccactgttaatacattgttgcttgaggtgtaaattggctcgacctctttgtcagacatttaggtcatatgcgcagaagtctggaatatacatttcttcatgactttgtgatgcctctgatgggaatttattcaatagtatattcacacatgttttctaagatgtactagcaagaatgcttactgtaaaacatacaaactgaaaatactagaaatgatcacataacggacctggctgaaccattaaggtatatggcacaactgctgaaaggctaaataatcttaaaacatgaagcgtatctcttaatcttaaaacatgaagcgtatctctaagtgcagatatgaaaacacctacaagataaatgacgtcatttaaaaattaaagtgacgatcactgtgtataatgtggttcattttgtataaaaaaagactgtgtgtgtgtgtgcatgcgcatgtgtgtgattaaaatatatctggaaagaggtgagatattgaactccgattgcctttgtgtagaatacttgttctcagatttcagtgtgcatcacaatcaccaggaaggtttgttaaaacccaggtccccaccgtagagactctgattcagtgaatctggggtgaagcctaagaatttgtatttctaacagtttcccaggtgatactgctgcctctgttccaggcaccacactatgtagaccctctatggagaggaactaggcttttcacttgatatcttcctgttcatttaatttttagaaatagtatatgtatttcttttgtttttcctttaagatcaaaagcagcaatctgaattgtaagattctggggcattttaattttttctttatacttaatcacattttaaaaagccatactgttaaaaaaaattctaccaaataagatcaaatccactgctttttagttgctccttaaatattttgtttggtaattcatttccttaagaatagacttagtgaaatattaaatttttcttatatgtattcctcctaggtagatccttgtatcataatttgaactcagaagttagattggcttgtgtggtatgccaagaaataaaaatattttaagaatattggggatttacattattttatattatatataatatatatcataacatctatattatataaataaatatataattttattatattatattaagaatggggatttacattattttatataatatataatataaaaattagtggcaaatataaaagataataaaagatattttatatataatatatttaaaagaatgaaagaaccgtcaccattttctgtaaaataagaatgacaatatgcagcatgcaacagctatcatagagaaccacttaagatgacagacaacatggcaaatccttaaggaagactcctggcattgggatatgctgtcttatttgtatttctgttaatacagctttatgattgcattgcatttctgggtttgaactttgtaaagatttagagcaataacaacaacgacaacaaatggattgtccaattctatccactcctttttttcttttagcaagtcatattcctgtaatcttctcttgctattatttttcttttgttaagatttatattattttttatttattcagcgttcattatatagtctcccttaggagcactgaataacacatacaaacaaatatgaaatagctaaaaatttgaatccctgtcttgccaaccctcatatcttcagctggggcagaaaacctgagcaaacaggcattgcactagaccgtgtcggcagcaaagcaagctgtagtcaggttcccaagggaatgaattcttatgttttgttttccataccaagaccattttttctcctttcccctaaagatcaaatctggtggttcattagctattctggctgatctcagcttcctctgtgcatgctcttgtcttcccatccccacaactccaggggtttgatagaacaaggttaatactcggaatcacggtcaggagcaaattgattgcaagtggaggatgtaaagcttgtctgtcaccatctccttatggcctcaagttaagcaggcggtttgcatcaagtgaagctttaaaagtctcttttttaactgacatccgtaacagagaacgctatttctctcaaaccatatgccactaacgcctgattagctatgatcagatagaccgatagatacactattaaaaagaattgaaccccgtggctagttcctatgaatgttgaataagtaattaatgtcttcctctttcctaccccccacccaaccagtctgctgttatttaatttaacaagcatttgacggagcatatcttgtatgctaggtaggtactaagaaaagatctccttgtctgcacaattccaaaagttgccatttatatggattttaatgtgaatagtgcccccagggagttgtgcaattgcaaccttcctagccattcatgtcactaagctaggccaaaggagggggaattgttgtgacgagttataagacatcatttgtgccttgtcagagttcacataggagaacggttagtggggaaagaggtacagccacaggttactataagtcataaatcaagatacatttatgtttctatagatatctgactaaaggggtgtgggatcagcaatgagggtgtagtaaattctgcttgggatggggtgcaggaatcaagaaaggcatcaaagagaagacgacatttgatttgggcgtttgagaatgcgtcacactcagagccaaggggagtgggagggtaggccatggtgtagttggaaataacaagaatgccactgttgcccgccattgtctggagtgaatgccagccgggaatcatttaaacactttctcttgtaatttgaaggacacaaaccatggcttctctctcagtgaaagaccattattctctaaattgtttaatctgtagtcccgatttattaagatatgtgtggcttgtcttgggagtctgagtaatcactgacattgtataggggaatacatttgcatggcattataagaatgtcaagttgtctttcaaaactgagtatagataaaaggctcaccaatgcctgggccatctctgagtgccgactgtgggaacatccgttggtggcattcgttctactgtatgcacacatttcaatcagcccaaaaggcctcctgtccacagaaggctggacagtccttacctctcactcataatgccacattagcatttctattctcatgctctgtggtcataagaggctgggagatcttcggagagacatttctcaacctgtagacacaaaaggggtgctttgagctctttgaagggcagcatttcagtgggggtgcatctgttaaaagactgtgttgcaccccaacacctctggagactgaaagggaagcaatttgggatagcagaaatggacgcaggtattaatggaaggagattgtaataaggaatgtaaagaaatggaatacacatacactgccttatctgagccattttccatagtggtgttaactataagaagcccacgttaatactctgaaaatctatccccttcaatccctgcagctatacttcctgctaagacgcaaggcagatggacacattttgaggctcaggccaaaattcattgagctctctaattttaagaattttgaactttcctaccacacacacacaaattttagaagtcttttcctcttgatgtacacatttgtttcaagattgtgcctttcaaaacctttgcacgtaacaaatagttttgagtatgcaattaaataaagaagttatttaatattagctgtgattgaatgtgcaggctctaaaatcagattccctgggttgatatgcacagtatgccaactgaaacagtcacctctcttaatggaccttagtcttcccctctgagaaacagggattatggtcaaaagtataagaggtcatgtcagcagagtgccgggcatttggcaaatgctcaataatacttagaattattatctcctgaaaatttctttggtgtcagatgccatcaaatgtaacttctaaataacatgaaatgagtactggtaacagtgaattgacacgattctagccaaaagcaagcaaacttgacttttcacatagtttatagtatctcttcaaggccaagtttgctttgtgagattcactttttttgaaatgttgagaataacatatatatttgaatgcctgttatatatacgagctaggagtgtgtttgactgcaattaatagtgttctaaataattagcagtatattttcttacgtatcaaggtaggagtttgttgtccttgatttaggtgctcaaaaatgtccttgaggaaccagctgtttctgtcattttcttctagcaacctgaccttttagggttctttttttgtttgtttgtttgtttgttttgtttttgagatggagtctcgctctgttgcccaggctggagtgcagtggcgtgatctcggctcactgcaagctccgcctcccaggttcacgccattctcctgcctcagcctccctagtagctgggactacaggcctccgctaccacgcccggctaatttttttgtattttttagtagagacggggtttcaccgagttagccaggatggtctccatctcctgacctcgtgatccgcccgccccagcctcccaaagtgctgggattacaggcgtgagccaccgcgcccagccttggggttctatctttatgctagtgaccccatggttacaaagtagctgtgatatccaggcctcctaccagcatcacaagccaaaaagagctcaaggctcatcatcggatggtcattttttatcagcaaagtaaaagcttcttagatatatccccagcagagtcttccttatatctcatgggctaaaactgtcatgtagccacgcatagctacaagggaagctggaaaagcaagtaaagaattatcctgagtagactaatcataatctaccaactaagggttgggatgttgcagccttaaaaataatcagggttctattagcatagagcaatggttctcaaacttcagtgagcatcaaaatcacctgaagggcttactaaagcaaaattttgagtcccactgccagaatttctaattcagtaggtctggactagggctcaacaatgtgcatttctaacaagttcccaagtgatagtgatgctgttatctgggatcacactttgagatcttctgtataaagtcacagactttttctgtaaagagtcatatagtaaatatcttatttttggaagttatacattctgcaccagaaatttcagtgcaaaagctgccatagacatttcatgaatgaatgagcatagctgtgttttgctaaaactttatttacaaaaacagatgtgcactggctttggaatagaggatgatagaaattaatactgcatattgtttcagttattgtggtagtatagcaaattattccactttatgttcatgaattcagtgaattatgaaagagcacagtggggatgactcttccctgtcccacaatgtctggggctttaggtgggaagatccaaatgcctgtgattgggtgcttggggactggaatcagctggaagctccttcattcacatgtctggcacctcagctaggatggctaggatacccgctctgccctgactctggatcagaacacctacctgttgcctctctttgggactgagattctcacagcatggtgtctgagttctaagagggaaactgccaagaaaaccagggagaggtttatggtcttcatggacctgccctggaaagtcacgagcatcacttgcatctcattctattggtaaaaagtaagtcacaagcctgctcaaattcaaagggagaattaaacttcaccttgacaaggaaatgacatggtcacattatagaagggtatgtatgatgggagatattttttgtagctacctttggaaaatacattttgccataagcagacacataccaatgtctgttgcctccctcagacagattactgaggctctagatacctcattagaagcctgtgtcccagcatcagagcacagaatgtaggtctatcagagcatgatatgggaggatttctgggtatgaccactaagttttacctggccaatacaactgcttttctatggccccattgcctgtctagtcagccagacagtattgattttttatttcagcaggaccttggctaggttttcggggatagaatgaaaacaaatgaacaaagaaagaaacccggggtatgtatcatccatcatccaacatcattatttagcaaagacctttaatttcttttgtgtgtaagagtaatgccaagaactgccaagttcaaggcaccaactcttctcttcaaagagcttatgatcttttgggaaattgggcctatagttttaaaaaagataaatatcaatgaagaggcatctggtatgtcaaaagaaacactttatattgatatataataattgtacatatttatagggtacctgtgatattgggatacctgcacacaatgtgtaatatccctcacctcaagcgtttatcatttatttgtgttgggaacatttcaaatcttctagctatttttaattaggtaataatttatcattaactagagttattctaatgagctatcaaatgctagaacttattctttctatctaattctctaatatgtttgtacccattaaccaacctcccttcattcctcctcccacccacactttccagcctctgggaaccatcattctatccctcctccataagattaattttttagcttccacatatgagtgaaaacacacagtatttgtctttttgtgtctgggcgatttcacttaaaataatgcctccacctctattcctgtttcttgcaaataacagaatttcattatttttatgacagaacagtattccattgtgtatataaacatattttatttatccattcattcgttaatggacagtaaggttgattccccaccttgactatgttaacagtgcagcaataaacaggtgagtgcaggcatccctttaaaatatttgatttcctttccttttgataagtaatcagtagtgggactgctatatcatatggtagttctgcctctatattgttttgcataatggctatactaatttatatttccaccaatagtttataagagttcccttttctctgcatccttgtcaacacttttttttctttttctttttttcgtctgttcatttgataatagctacgctgattggagtgtagtggtatattattgtggttttgatttgtattgccttgatgactcatgatgttgagcaattttcatatgcctgttggccatttgtatgtcttcttttgagaaatgtccattcagattttggcctgctttttaatggaattctttgtttctttttgctgttgagttgttttgagttctttgtatattctgggtattagcagcttgttgatagtttgcagatattttcttccattctgtaagttatctcttcactttgttgatagtttcctttgctgtgcagaagctttttaatttaatatggtcccatttgcctatttttttgttttttgcctgtgcctatgaagtctgagccacaaagtctttgcctagaccaatgtcctgaagcatttcccctatgttttcttctagtagtttttatagtttcaggttttatatctatatctttaattcattttgagttaatttttgtataagagataaaggtctagttttattcctctgcatagggatattcagttttcccaacaccatatattaaagaggatgtcctttccccaatgtatgttcttaatgcctttgttgaaaatcagttggctgagccaccccgtccgggaggtgaggggcgcctctgcccggccgcccctactgggaagcgaggagcccctctgcccggccaccaccccgtctgggaggtgtactcaacagctcattgagaacaggccatgatgacaatggcggttttgtggaatagaaaggggggaaaggaggggaaaagattgagaaatcggatggttgctgtgtctgtgtagaaagaggtagacatgggagacttttcattttgttctgtactaagaaaaattcttctgccttgggaacctgttgatctgtgaccttacccccaaccctgtgctctctgaaacatgtgctgtgtccactcagggttgaatggattaagggtggtgcaagatgtgctttgttaaacagatgcttgaaggcagcatgctccttaagagtcatcgccactccctaatctcaagtacccagggacacaaacactgcggaagtccgcagggtcctctgcctaggaaaaccagagacctttgttcacttgtttatctgctgaccttccctccactattgtcctgtgaccctgccaaatccccctctgcgagaaacacccaagaatgatcaattaaaaaaaaaaaaaaaaaacgaaaaacaaaacaaacaaacaaaaactggacagtggatggtatcccaggttgaagaaacagcagaaacaaagactgggagggagtaatgtacaagttgtggtctggatagttgggctggagcagaggatgctggaggaggctcagcagggcaggtatgaccgtcacagccactggctggcactagccaatgcagggttcttctgggaactctggggtcctgaaactaaggcagctgaggaacttccagaatgctttaataaattaatatcaaacatgaaaaaaaaaaaagaaaatcagttggctgaaatacatggacttacttctggagtctctattatcttccattaatctacgcatctgtttttataccagtaccatggtgtttgggttactataggtttgtagtatattttgaagtgagattgtatgatgcctccagctttgttctttttgctcagaattgctctggctattcagggtcttttgtggtcctatataaatttaaggcttttggtctatttctgtgaaaaatatcattggcattttgataagcattgcattgaatctctagatagctttgtgtagtgtggacatttttattatatcagttcttctgattcatgaacaggggatgtctttccctttgattgtgcccctttcattttctttcattagtgttttctagtttttattgcagaagtctttaacattcttggttaaatttattcctacatatttccttttattttattggctattataaattgaattgctttcttgatttctttttagctaattcattgttggtgtttagaaatgctactaatttttatattaattttgtatcctgcaactttactgaatttgattgtcggatctcagagtttttcagtgaaatttttaggttagtctgtatataagatcatatcatctgtgggaagggacaaattgacttcctctgttttcaatttggatgacttccatttatttcccttgactgattgctctggctagaaattccaatactatgttgaatcagagtggtgaaagtcatcttcctattgttctagttatttcagctttcagcttttcccccttcagtatgatgccagctgtgggtttgtcatatatagcttttattatgttgagctaccttgctactatgtataacttgttaagagtttttataatgaagggatgttggattttattgaatgctttttctgcatctattgagatgatcatatggtttctgtccttcattctgttgatgtgctgtatcacatttatttgtgtatgttgaactgtccttgcatccctgggataaatatcacttgatcattgtatataaagttttcaaataaacaccctaatgatgtaccttatgtttaatcccttaagatattaaaaaagcaagaacaaaccgaatccaaaattaacagaaaaagaaatagtaaaggtccgagcacaactaactgaaatcatgactgaaaagcaatacattggatcaatgaagtgaaaagtcgtttttttgaaaagataaacaaaataaataaactgctagcaagactaatcaagaaaaaagataatatatccaaataaatcacataagaaatgaaaaatgagacgttacaactgatacaacaaaaatacaaagaatcattagaaattattatgaacaactatacgctaacaaactggaaaacccagaggaaatggatactttcctgaacacctacagtctaccaagattaaagcaggaagaaatagaaaacctgaacaataatgagtaatgagattaaattggtaataaaaggtttcccaataaagaaaagcccaggaccagatggcttattgctgaattctaccaaagttataaagaaaactagcaccaatttttctcaaactattccaaagacttaaagaggagggaattcttcctaactcaccctatgaggctagcatcactctgataccaaaaccaggcaaggacacaataaacaaagaaaaatacaggccaatatccctgacgaaagatgcaaaactccttaataaaacatcagcagagtgaatccaacacatcaaaaagagatacttttgatggctttaaaatgaagctgagattcttctcagctggacagtggaaaaagctaccctagtgtaggattttattaatttgaaccttgaaaggtaaaaagggatggatgaaaagaaagagaaaatatatttcaaataaaaagtgcctgatgatgaaagggtgggacactattggtctcattggagttgaggaggagatcattatgtcagaagaaaaaatgtgtattgagaatgggaaataacattaaaaataatggtggtcactctgttgaaggggctcctacataacatttaataatttagtgatttcccacagtgcaaggcctgggatgctattgtctctactgttctatcttccttctccactagctatttcttacagggacattctgtcatggtgagctcagggcctgcttgtccttctgattacaccagtcataacaaagagtagaccaggcttttccatccaacacactcatcaaagtccattacactgaactttgacatagcaatgcaaatagagacgaaaaacaacaataaaaacaataaaattctagtaaaaagccaaagataaattgctcttaagcacctactctggttattctaaaatgcttcccaatgtttctttaaactataagttcttagaattagggaaaaagcagtttttggtttaaaagattttagactcccaaagaaatgtgtaagcctcattttagaagtttcgagtagatgtttgcacctaatttaatgtgctaacccagtctaatgaattgagtatttccccaactcagtgcttggcttttggatgatgaagtggcttaaaatcatgaccttgagaagttctattccatcagatcaggccctacttataaacttcttaaagttggcatttgatacatggagctattgtgagctgtgctgtgacaacatctttggatggttttttaaattgtagagtcctaaaaactggcttggtcaccaaagcaatacaaatgctgtccttatgtgtatacgaaatccttatgcttgcctcactttgttttaaaggcacctaatagtattctgcttaatacttaacagtttgacagaaaagttcatttcaatcctataaatcaatgacctttctaattacaaatattcactgattctgtaaacaatgacaaactttcatttgaataacattttatagtacatttttctatgaaatgtgaagtgctttcaaaaggttgccttatgccatggtaataaaaacgttttagagcatgtgcgttgtcaaaagtcactaaggtatgttctttgtagaaaagcacacagctgagagtttacagtggataggactctgccctatcccacccacacatctaggtttcaggctgtgtctgtctggagaaatgtgtcagtgcttacctatatctctttggcactccaatctcatggaagccagtctgctggcttccaactgcaaatacctgtgactctttgcccaagggtcatctttccctgttacagcccatttagcccaggcaagaaaagccaggaatttaatatctcccaccttcccatgagtggctttcaacccatgatcaatagggatgattcctgcatgcctcagctcccctgaccagcagtgagataacgccaagatattttctacactgtctcccagagcttcccagtaagattgcactcgcgttgcccacagtggttacgtgctgaacaatgcatccttattgactcccttctctatctcacttttcaatgtccctactggtaattcccaggatcacttcccaaataaaccatttatacttaaatctgtgtctttggggtctgtctctggggaaatccaactcaggacatactgagactgattcccacaaaggcacagtgtgggttagctgcagatgttgggatctgagaagctgaagaactggatagaatgggcaatgatgtagaaccactgtaggcttctgaacaagagaagggcgtgttgttaaaggaaaatgatcctcgcttttgtctacagttcactttgcatcaaggggaggggtgtggctgggaagagcctggagcctagggaatcgagttttatcactattgttatggttatctaggggcaggtaaagagaggttggattagtggagaggaggttaaaatgaaaataaggaatatttcttttttttttttttgagatggagtttcactctttttgcccaggctggagtgcaatggcacgatctcggctcaccacaacctccgcctcctgggttcaagtgattctcctgcctcagcctcctgagtagctgggattacaggcatgtgccaccacgcccagctaattttgtatatttagtagagacggggtttctccatgttggtaaggctggtctcaaactcctgacctcaggtgatctgcccacctcggcctcccagagtgctgggattacaggtgtgagccaccgcatctggccaaaaatacggaatgtttctaaggtacatgatggagaatcagtgaggattgatgttgactgagttggtaatggaggagcaaagaggagggaggaagcaaaaataacagtcttggagaactgggagtatggcagtgcccttagcggttttgatctatgtctaatttgtagcctctgcttacagggtaatatttattggtcttgagaatttcctgaagcaaccttacagttcatcagaatagggctcatttctccaaaagaacagaccctgtgaaacctctggagatatagtcagtatttcatatgagtttatggatttttcttcagccttccaatacatataaaattacttatctctcttttctctgcactgaaatcctccaacatgccttttccctgagtgaataaaaaacacgagcttttcttaacaatagaccttctaatgagtgagcagagccacatttttagtatgtccaagtcagaatctgtttaacaattggtggccgtctctcaacattgcagctagtgacagcctcatttacactggttcaatgaagatactgaaatgttctcggccagacagtggaagtgaacttacactttcaccagtcctcacttagcacagattttcaagccacttaacacctttcaagtgtctgaaagctaatagaatgctcaacacaaggctcccctgacttttacagctgcccagaatttttatttattatatgtctgtgattatttatttatttttgctaagaagaaaacagagtgatcttacacactgataactgaggaagcatttcacagctggaccttatgtttttttttcaaagaacagagttctctgagctctaaacaaaacttcttatcagacaattaccaatatattttactattttaattttgcttttcagcttattgattaaatattcagtgtggaggaatgggcattcagccttaaaatgatgtaattttgttacatatgaaaacagcaaaggacaatatgtcactatttgaatgagccaggtgaaaagaaactctatgaccttaattcggccatgtggataaggggttctaaaaaattgaaaggagacgtttaggaaaatttgctgaaagaccaaaagaacaataatttcctagggtgataggtttgagctattttctctccaccctagaaatgagccaaagatgtatttacccactgaccccaagaaaatggctgatctccagttggaggagacgaggatctttgcttggccttgttttatggatggaatttttaatattccgtccatacaaacctatgcatgtatttccagaacatttgtgatgaaaaggaaaaattatgttcaccttgataaggtttcttaatattatctcttccactggagaatccagctgattacactgacttccaccaataaccaagctccaactacgacataggtcccaggagtcttaggtagagcaggcaggtggatgaagttggcttgagaattttagtgaccaaaacatggccttcgttaggctatgattttggtgactgaaaaaataataaggctgtggatcattatgtgggccatcagggaagtttcaaagaaagaaccatcttctgaattcattgtgggtcgtattttgtcaccttcttcctactttagtacatacacacacacttctccaagttagaagattcgagttgaagatataagcctgcactatctaattcagttcccacaagccacgtttgtccattgagcaatgggaatgtggtgagtgcagactgaggggtgttgtaaaagacactgtgaatttcaaaaacgtaatggcaagaaaagaaggtaaattagctcattaataattttttatattgattgtaagttgaaatgataatgtttggatatattgagttaaataaatataaaattaatttcaaatttctttttatttcttaatgtggctatcagaagattttaattacatatgttgccaacataatatttctatcagaaagttctggaaataagggacctaagtgcatgtaagggaggagaccaccccttatattgtcttatgcccaatttctgcctccaaagaaagaagaagtaaaaactaaaaggcagaagtgaaatccacaagcagacagcctggcgccacaccctgggccttgtagttaaagatcgacccctgacctaatcagttatttgcataaaaaagcactgtgaggatccctgtcctgttctgttctgttctaattaccggtgtgtgcatcccccagtcacgtaccccctccttgctcaattgatcacaaccctgtcacgcggacccccttagagttgtgagcccttaaaagggacaggaattgcttactcggggagctcggctcttgagacaggagtcttgccgatgctcccggccgaataaaccccttccttctttaactcggtgtctgaggggttttggctgtggctcttcctgctacacatggactgattttcctcttcttcattactttggaaaataaagaaactgaacttcttacttgtaattcatctgttcacccctttaattcacctaacaacattgtacctatgaatctgatataaaatgatgcccataaacccatataattaataaggccagctacttagaaatgttagttcataaattaaatagctttacatatgtttttgaattctacatgcatacacaaaatgattaagaaggtatttattttcttataaattatgaaaattcatatatttcaacttactattttacttataaaagtatgttctattattttattatttgtgtctgttttttccactaaatttgtttcattaataagctaggtttttaaaaacacaattatcatttgacagatgctaaatatctgatttaaatgatacataataagaaataaaggatctagtctcaaagtaaataatactaatttgtaaaagcatctttgtgacatttcagtaatatataataaaactgtattttttaatcaattaggaggctcatattccaatatccctaccctaacacattggcttgggtagaagaattagttggtgagaacagagtcgttgaacaaacagtgactagccatttcccatttaagttgggaactcttaaaatatataaaccattatcctaactatggaaatataaggacatatgcacaaagcatatgtcctctacttccaagaaagcataatatagtagagtggagaaacagagatcactaagccgacaagaactatcactcttatccagatcaatgtactctttttctacatagcagccattttctatgtagcagtcatcatgattttgttaaaataatcatattttatccctcccacttctaccttttaaaatcccaaagtagattttcagtgcacttataataaaatcttaccataacctgcaagacactgcatgatgtgacctctgttgccttttccatttcactccctgtcccctctacccttcacactcaactctccagctgactgatgcctccaggtctttgcctctggtatccctcatcttagtctatttgtgttgctataaagtaatacctgagtgtgagtaatttacaaagaaaagaaatttattagctcacggttctgcaggctgtacaagaagcacggcttcagcatctgcttctaggaggacctcaggctgcttctactcactgcagaaggcaaaagagagccaatgtgtgcaaagattacatgacaaaaggagaagctagagctagtatgtggggaggtgccaggctcttttaaaacaaccaactctcacaggaactaatggagtgagaacccagttgttacaatgagaatgacaccaagccatccatgaagggtctgcccctctgacccaaacacctcccgttaggccccacctctaacattggagaccaaatttcaacatgaaatttggaaaggtcaagcatcaacctattgcatcccctttgcctggaactctctcttaaagcttaagaataatggaaaatacagggagagtcagtcttgtgggcacatctgagttgccttctctggccaccctatctttttttttttttttattatactttaagttttagggtacatgtgcacaacgtgcaggtttgttacatatgtatacatgtgccatgttggtgtactgcacccattaactcgtcatttagcattaggtatatctcctaatgctgtccctcccccctccccccaccccacaacagtgccgggagtgtgatgttccccttcctgtgtccatgtgttctcattgttcaattcccacctatgagtgagaacatgtggtgtttggttttttgtccttgcgatagtttgctgagaatgatggtttccagtttcatccatgtccctacaaaggatatgaactcatcattttttatggctgcatagtattccatggtgtatatgtgccacattttcttaatccagtctatcattgttggacatttgggttggttccaagtctttgctattgtgaatagtgccacaataaacatacatgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctgtttctccacatcaaggtaatttatagattcaatgccatccccatcaagctaccaatgactgtcttcacagaattggaaaaaactactttaaagttcatatggcaccaaaaaagagcccgcattgccaagtcaatcctaagccaaaagaacgaagctggaggcatcacgctacctgacttcaaactgtactacaaggctacagtaaccaaaacagcatggtactggtaccaaaacagtgatatagaccaatggaacagaacagtgccctcagaaataatgccgcatatctacaactatctgatctttgacaaacctgacaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctacacagcaaaagaaactgccatcagagtgaacaggcaacccacaaaatgggagaaaattttcacaacctactcatctgacaaagggctaatatccagaatctacaatgaactcaaacaaatttacaagaaaaaaacaaacaaccccatcaaaaagtgggcaaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggccaccctatcttaagtagctcccctgtattcctgacagtgaccttgtatctcactttcctatttaattttctttatattgctaacaactaccccaaattatcttttactttaaatttacctagttatttgttgtctatcccttttcatagaattaagaacacaagcctgatctcttttatttgatcttttttttttccccagacatatcaaaggccctcaataattaaatgctggctgactggatgggtgaatggataagatagtttcataagtgtaaaggcagagagaattcagagtaggggaggaaatagagatggtatctaatccagattagaagttttctgaaggatatagtacgtcagctggtacatatgaataagcgggaagtggccaggcaatcagcaaagggtttaaacttctgggcaaaagagcaagagtctggtggctaaaaagaggctgtcatgctcagagaactactaaaagttgagtcaagctgcagtaagaagtgggagtaatgctgagacctgaggacaggtagccaggaaggagcccaccagttcataagaggcaactgcatgagaagcctgatttggatggtattgtaaccccaaatgtctgaacgttctgcaatatgaagcatgctttgcatgtcagcttgcttactccagctcagtgtttaagctgcttatgagattgtaaactgaacaaaatcagggccgtcccccaccccttggattcttctttacttataacacaatgccttatacaaggtgggcttccagcaaatgcctattgagttgaattgagtcctttctcttattatttttcacactgttatctgaactgatatttggggctgtctagactattctgagatatcacacaaagtgcaagaataactcatgctccattgatcctccataatagttactttgaataaatatggaggacggacatgcacaataaactgacatgctccacagcttttgactatggaagaataccatactgacaataaagaaggcccggaagggagctttcagagatgtggataagatatttctcccccttgagttgaaacaggaaaagggaatccagttcttggtatattggatttaaaaaaaaaaaaaatacactcgtctcaaaagtctgcatccttgcaagaattatcaattctgaaatgcctgttcattttccacagattagtcttcattagacacaattttagctaggtattcaattgcatttgtttgagtaggtaagtagaaaccaagtctcagtgatcagaattttagtacagagctaacttaagttgtttgcttttgtctcttcaacgttagaaggacaaatggtgccttgattttacaccacttcataaataattttctagagccacattttttacaacagactgaaacaaacaggcctagatctggttctgattattatgacagagaaatgtgaatacaatagagaaatgacatattaatcatagtgatgtttgatatgctcacttggaatgtgaactaacaggttcaggtaccccagaaatatctcaaagacttcttttatagggctgattccccccttattatggaaagctatatttttcctatatattttattaattccctatgtctttatttcagtgtagaacatattcctttaatcattagcatgcaccaacccctccccaaaaaaagcacaagctaaagcaaatttatagaaacccaacttgaattctaactcagcaactcaaaaccattggacatttctaaattttttatgtaaccatgacttcatctgaaattctgttgcttacacgtcttgctacttcttaagctcacttttctaaaatgatgaatgctcatataaaaggcaaaacaaggcagccctgtagagacatgttaagtctacaagtcaattgatttcctatgagaaacttttgagctagggaagcagggactcaggaaagttttgtttcttgttagatgccagctgaatagaattaaatatattgtcacaccttgaatattaaaatatcctggctggatgcagtggctcacacttataatcatagcattttgggagcctgaggcaagaggatcacttgagctcatgagttcaagaccagcatgggaaacatagtgagatcttgtctctataaaaaatattaaaaattagccaggcatggtggcacatgcttgtgatcccagctacccaggaggctgaggtaggaggatcacttgagcccaggagttcaaggcttcagtgagcagtgactgggccactgcacttcagcctgggagacagagggagagatccccgtctcaaaacaacaacaacacaatatcttgaacttcagatgttttaatagagacagtgtgatacatgtgtacatagggaagaaactagcccacggagttcactattacataaaacagcatggtttacctaccattgcttttattaaaagtttttgtttttccatgttcatgttgtttttggaaatatattgtaaagtaatattgtcaagtaaataattttctcaagggaaaaataacaattagaaaagaggtaagacccctttgctctgatacccttaaccaagttaattgaggagagaagtagaaataggaagagaagaagagaggaaggacagaaaaaaagaaaatatatgagggtaaaataacatcactgcaggagatgttgcccgtgccctgttcacattggaccttaacactttactatgctccacacaatttttagcttccagtatctgcaactctgttgcaggggttcttttccattatagtggaaaccttcctggtcagcagaagactactctgcacatggcaggctgccagtgacaagaaattaacatcccttaaaacctttccctcaatcagtgattctctagtgtatcaataccccagctcccctcctcttggctgccataattctaagctttctcttatacaccacatctcagagcttctctgtagcagtaagctccagtgacccattgtagtagctggcttaataattcacccattattgattgctttgcctctctgtgttacttcaccactctttccatgctccctgggatcacctcctaaataaaccatttgaacttatatcctagtcttaacactatgcccctggtggaacacaaataagataactactatttctgttcataacagtttgtccttggactccattcattagaattgtaatggcttctattattaagacctgtacaaactttttcatgatactgcacttacctgggttatgcattctccctgctttcttcaatatccatcacaggtgtttcataaatattttctgagtgtagactaattccaccagtgcaaagcttttgctacagcacagttctggcacacagtctgtgcttactaaatgttttatcagatgaagtgtgatgattatgcctttggcagtggaaaggtctttattcaacttttaattatgtccagaagaatggcagaatatgtagtgtttgcaaccatctggttgaaatccacctgcttacacaggtatttcagggcagagggggtactttatccatcttagcatctgggaataatttatcatagaggccaacttgcaaaatcagtcactctggatgcctcatccctttcaaatgaaaaggatttggcttcaagtgctggacatggaaactgagaatgcagtgactcatttctttaaaaatgtgaatatgagagaggaagatttttatcactcaaagtgcagcacggtgagagctcgcctgagttaggtaaaatgcacataacttattttatggacacctctctaaagtgccttaaagcttaaaggataaagaacccagtgggttttcgttttgttatatgccccaaggctgaaactctgtggcatattttaacagagtttttaaatggcaaaacaatagttctttttttttttaatgtagtctaaaataaaatggaactccagacctgtgtgcgacagctggtgttcatatgacactgttagatgcctccttttatcccaatctcagtctcccttgggtagacaagaaatgggagagaatagtcaaaagtaagaaacacttctacttgagtgacatcttcctgatcgtagcagaatgaaatattatgacagttgtccaggtagttctaagttttgaaattttttactaaaatattcagatataatggaagcaaggacttcctggaaaaattatctcctcaattatcttttttaagttgaagttatatgagtctgacttttagacttctagtcaaattatgcaacttttcttcttctgccagtcagcttgttgccactgataagtaaaatgggattctagaagttaacagggtttgagtttttttccatgatgttgattattagatttcaaaacttttaaatcttaagtttatttacataattagtcaattgtaacctgaatatctgaggagttattaatgtgtcaagctgacattatttaatcatcagaaaagctatctttccttccccagtccatctctccgtctccctctgcgtgtgtgtgtttgtgtgtgtgtatctctttctgtctctgtctctctctacatatattcattatatgtatataatacatatacatcacatatatgatcctatttggcctgacatactatacccataggactaacttaagtaatatgagaagagtgagaagagttcatggtaggaaggtcaatgaattgatatattgcaaattatctggtagataatgcagctgcttcttccacttagcaaataatgttttctgtaagtgttctgtgatcaagacatagcctgcaatgacttttgtatgctaggtcaactccatcgaacccccaaattgtactggaatcagactttttcattaattcatgcaaaccagcctgaattctactggcaaccatgaaacacttacctatccatacatggcatagtcttcgaattctcatttgtttctgattttaaccaaaaaaaaaatagattttcatcatttacaagccatagcaatacacgttgcagtcactaagctaaactcattacatgcaagtagattaatcattcatagaccttatagcttatcaaaagaccttgataactcccacggcttcttccttctgctccttcgatatttgacaagcaaacttatatctgatactgatagatgatcaaccctcttgttagtttgaccccaggcagcaggacttcattagctccagtctgtactaggcattacgatggtaagtccagatgcaaagaaaggatatagcaggatccctgtctcccatgtacttatggccttgctggagaaagaggactttaacctgtaaaagaccaagacaattttgtgaaaacagatagaaactctggtagtgataaattgataaaccctgatggtagagactttgtctaatggcttaaatgaggtgccatgttcgtgccagcgagaattcaatacctacttgtccacgcacaaaaaaaaacgatgctcgttacctgatctcatggagttcaatgagagcggaggctaagcctttgtaagttctcaagattcttctcacaagttgtgggctcaattaacatgtcttgttatagaacttttattggttggtgtttgatctggttatccatactgtacacaaaagtcgctgtcagctgaagagggaatgcttcaagtactcagttttctcttaaatcaaagcaaagataaacttcttataattatttttctgcaaaccaatttataaagcgcactcatcccaataataagtgacaagaaagaaagagataggctgtgtttatttgaaatatcctactattcctctgatacagcactgttgttagattcctttaggaaatattagaatctttctcacaattgatcagcctccctgaatgtgcccaccaaaaaattagttcttcagagcagattttgtattggcagtttgctaaacacgatactttcttctgaaactcacttatgcaagcttgaatggtatctaatgagttcataccaaactatgcccaaaatgaaatccaagcctcatttctgacataccattgttcaccatgcccgatatcttactaagttctgttaatttttctttcctaatgcctctcacaactgtttcttctcttaatccctggtgccagtatcttaggttagaccaccaccatatctctcctggatcaccaccacacccttctaatctctctgtctatatttttgccaccatcctcctctccatctcaccctttaaagtccagatgaaggttttaaattgcaattttaattgggttctttcctccctaattagtttcagaataaagcgtaggtgcatcctcagtgtggcctggcctggccctgcccttccttcagccttacttcttgtcattttattatttgaatgccagttacctactggaccacttcttgttcccccaaaagctatgctttctttttcctcgaggattttcatagcagggtctcttctctgctcttccttcatgccttggggaacccttgctcattgttcaggactcagcttacatgttttgtcccaccctgtggtggcttttcctggtccctcaaggctgttgctggaaaggggtcccaacctagaccccaagagagggttcttggaccttcctcaaggaagaattcagggagagtccaaagagtaaagtgaaagccagtttattaagaaagtaaaggaataaaaaaatggctactccatcagcagagcagtggcatgggctgctcgactgagtatacttatagttcttttttgattgtatgctaaacaaattgtgaattattcgtgagtttcctgggaaaagggtgggcaattcccagaaccgagggttcctcccccttttagaccatctagggtaacttccagaagttgccatggcatttgtaaactgtcatggcactgatgaaagtgtcttttaggatgctaatgtattcgaattagtgtataatgagcaatgaggacaaccaggggtcactttcactgccaccttggttttggctggtttgggccagtttctttaccacaacctgttttatcagcaagatctttatgacccctatcttgtgctgacctcttatctcatcctgtgatttagaatgccttaacctcctggggatgcagcccagcaggtctcagcctcattttacccagtctctattcaggatgaagtcactctggttgaaactcctctgaaaagactggctttagtatcctgctgatatgctcctggagccagtgccctgtgctaatagattctatcacagcactgaccacgctctaatgatagcaattgttaacttgtttgtttctctcaccaagaagtcacgaactgtggctttttttggttatgcattccctgcagctggtactatgtgccagttcagcaaatatttgcttgacaaatgaagtcaaagccgtgaagttattacacaactagtaattggagaagcagggattcaaaagcaagctctttgataccatgtgacgcaacaatctctctgccaggtatatgcccaaagtagatgaaatcactaccttgtaaagatatctgcattttcatgttcattgcagcattatttgcaatagctgggttctgaaaacaacctgtaaattgatggatgaatgcacaaagaaaatgtggtgtaaatctgtatctatatatttatatatataaaaatatatatatttatatatacaaacatatataaatatttacatagtatagagagatatcaatatatattttatatataagtatataaatatatatacttatatataaatataaatatataagtatataattatataaatgtatataaataaataaatataaatatagataacatatataaaatatttatatatatttatataaatataaataagtatataattatataaatatatataaatatataagtatataaatatatagttatattgatatataaatatatatctatatcgatatatttatatgtcaatataggtacataaacatatatataaaatatacacacacaatggaatattatttagccttaaaatggaaggagatcctgccatttaccacaaaatagatgggcatgaaggacatttatgttaagcaaaataggccagatgcagaagataaattattgcataatctcacttatatgtgcaatctaaaaaaaagttcagatattcagagagagataataaagctatccaggggttgggaagagggggaggaaatggagagatataggtcaacagatacaaagtggcagatatatagaatgaacaactccagagactgaatatacagcatgaaggctacagctaataaaattgaattttggatttttgttaaataagtagatttttgttattctcaccccaataaaaaagaactgtgtgagatgatagatatgttaaatggcttcactgtagtacctattttactatctatatgtatcccataatatcatgttgcaaatcttaaatatacacaatagattttttttttaagcagctctttaaacctcaactataccatgctctatatcctaggagaagcgacactgtgtgctgaagcatgaatgggtacagttaaagtctttccattagccatcctccacccctctgcccgtcttttttctttttggcaggagtagggggtgggggcgaggacagggtcttgctctgttacccaggctgaagtgtagtggcacagtctcactgcagcctcaacctcccaggctcgagtggtcctcccgcctcagccccttgagtatttgggactacaggagcacaccaccacacccagctaatttttattatttttggtagagacagggtctcaccatgttgcctaggctggtctcgaactcctgggctcaagcgatccttcctccttggcctctcaaagtgctgggattacagtcatgaaccactgtgcctgggcccttctgccagtttttagtacagtagtttgaatatttttagaagatgggctgtgtgtctaactaaaacctaatcgagtgatttatgctaaaattgtacctattctcaatggcctgtcagaactgggaataagccctttaaaataaaatcagctttgatatatattttcttaaatgtgttcactgctatcttttctctgcctgagaattctgctaagaaaacctcccagcaaggatagcttgttttaagttttttatagtttctcccattgtcttttcattgtctctgtcactccttaagatgtcatctgagctttattaatatgtatttggtaatttgtattcatgctatatcaacatgagaaataaaagagtctctcagttttagacttcagagccccaagtcgcctgaatatatagccacctaaatatgttgtactcagcattgggactaagcccctgctgttcacattacacaatggagcacctttctgagaggctagcatttacctctccagacatgtgtgccatcaaatagatccacagacacagatccttggtcatactgcaaatatcttctctgtggtttgcctttttattctcttagtagtgtcttaatgaccataaattcttaattttaataaaattcagttcttctcctttatagttacttcgtgtatatatttccttaaagcattgcttgtcttcatattaagttgtacaatattttgtgtaaattattttaaaacatttcttcattttactattttatttaaaatgtagtttctaaatatccagcaattttcctcctttgttttataagtccctcactccgcaggacatattacaaattacttggttgtaatttgtatttctatttaatatttattataaattattagatattttaaaatttagttttgaagacaagaaagtatattgggtgctaataatacatttctgaccctgacatcaccatgatagctttgcattaaatacagtctgggccggatttggaaatgctaacttttagttttcttattgaaataaattgtatatacttgcatgtacagtcaaccctctgaatctgtgggctccatgtctgtagattcaactaaccttggattgaaaatgttcaaaaaatggatagtgtgtccgtattgaccatgtacacgcatctttcttgtcattattctctgaacaatacagtataacaactatttacattgtattaggtactataagtactctagggatgatttaaagtaacaggaggatgtgcatagattatatgcaaatagtatgccatttttaataagaggatggagcattgtggcttttgggatccaagggggtcttagtcttagaaccagtcccctgtggataccgagggacgactgtataccatatgaagagtgtgaaaactgcattattttataggactgcatctttcaatgtaatgtcaggacttgaactgtgcaacagttaggacactcaatctagagccctggaaagtacatgaactacattgaaattctgtcaaataattattatgcgattgctgtttcacttttagtcaagaagcattgaaaaaacaagtagcctcattaatcattgaaaacatcagaatgaactttgaggatcaggaatttagggacatgcagatctggtcaattggccattataatgatacaaattaaagcaaagtccagcagggaaaataatccagcttgaatcctgggatctattcttgtacctttgtggcgtacacttaccagacaacagatctaaaatgtggtgtgtatgttttacaatactatattaatataaactatattaatagtctctaagccaaatgatatgtgatacatcctaaacttttgtttgaatagttgaatttttctttattgttttcatggatagttaatgaaatagttatgataaaatataccatgtttgaagtcataacttaattacatttattaacaagaaatagtaatgtacaggaatgaaactgaaagttattgtgcaatttactattatcttttatggatagaactggttacaagtaacaaatgtaaatttttacatttgcatgtaagaagataagtcctaacagcattattgaatgataacattattgaaataactttaatttcactaaattgatccacatttgctatttatatagagagaagaccaactgtgatttttatatacatatttgaaattatccatcaatatcacatggaatattcaatctggccttttgcgggaggaagaaaggaagagattttagagactaggaaaggacagcaaattaggaaagaaaaccgcagatacagcagataagggaggaagaggtggattatctacctcagtgacaatttacatgctgaattatactaatttccctgtgttctgtgatgctcagtaaatgagactctgctgatgttcctataggccatgaaccagccggcacgttggtttccactacaacacctacaaataaactgctgagttaaaatctattatagcagagaatggcttatgacccacagacaatcattcctcttctaaatatattcacaaatgcctcataaatgtttgcttgggcattttatttagaagcaacatggataaatatttgaaagagtattgctaatgacaaagcaaaagtgaactataaaatagctttaacgatgactttaaaatctgcacttttcaaatcaagcactcactaaggaaagacaggaaaatataagatagcagcaggtgagctcttcgtgtgtgtgtgtgtgtgtgtgtgtgtgtgtgtgtgtgtgtgtgtgtctatagctgtctatgcgaagcaaatcatatttgcaaaataagaccaatatctgctgaatagaaaagagctgcattgaacagacatatctgccagaaaaatctggggttgtaatttaggttttatagtccaagaatgactagattgcttttaaaagcactacttcttcaatgcttttattccattctttgatcaaacatgtcagccaaggaagaaatggtcatttatttcttttgaaagcaggaaaaaaagagatttacattaaatagcggtcatcacggcgttcgtaagtttccaactatttatcaacatgcttggttcgcaactgcaattcacttaattggacttgcatcttcagtaacactgcagcttccatactggaggtggtagagttattctaagccatgggcaggctggtcaaatgtacatatggctgtgtaattgtcagaaaatgtcctcgtgtcagacggggccatggcttatagtgaaaacaatcctgttagtgcttctgcagcatatgaggagacagctccactttattagtgaaattacactggccatggatgactggctgtcttgatcatttacaggccaattgtgaagccactgatgaaatcactgggcagcccaatccaattcagtcattaagacaactggagtaaccagactgtaaaatggttggtctggttatttcttaatgatgtaattggatagaccagagggagatccaattaattgctgagcaattggtggctatggtggtctcactgataagctcagctgtcagtgatggacttgaattgactgtacagcttcctgatcaattgtacaagttactcttaccaagctgggggttggggagaattgatttaattttggtgatttcattgagcccactgataaatcacatatcttaagtgtctctctctctctctctctgtgtgcgtgtgtgtgtttgtgtatgtgaatgtgtgtgttattttctcaattgcaatatatttgtgagatatcagtgatatataatgctattttaagatatggttattttaccttgccagtgtatatttcattggaaaagtctataggctcttgtagagatctgtagggcaatttgttactttctagaataggaggggaaatgcaagcttgaatgaaaattatgtgtttagaaggcgggaaagcaaagtattttttcttcaccctttatgcccagtctgtgaagttcactgcatggttactgcagcctattcatgacatagtgatgctagatattcttctgctttgctgagtggcctgtgaaaagagcttaacaccagtgtagcctggcatgaggaagtaaatgattggtataatattttggggaacaaatatgcagccgatgagtatttcagctctcccccacccattaagagacactgtccatggaaatatcccttcaaagaaaagacttagttactcatgcaagctcttcttggccagggcctgtgtgaggacttaattcactatatccaccactcaaccatgcctggaatagacgctcattaatgtttgttgatttagtgaaggaatatgttcttaagataaatttctttctgagagttgatgccaaataagtataaaaaggtacataactgtggagtttttacttattctaagaaaataaataaatttatgagttggaagtgtgacttgttgaggtgatttaggccacctgtgatttttctaatgatggtccattgacaagtgccaatctttgacaatgttctcaccaggccaaagcacaatgagaaaaacataagaataatggttttgagagattaaaaatgtctgcaaattttttgtcatgccccccactgaaaggtggcatctctttccttttctcttaaatctgggcagcccttgtgactactgaaccaggttaagcctaaactttagggggactagaagcttctgcctcctatgttgaatgcttgctcttgagacactcccttccaggacacaggcatcatactatgaaaagctcaagccacatggcaaagccacacatagatgctctggtccaaggctgaagctgatctcccagccaatgccagctgacttacattgagacccattgagacccaagctgaactcagtccacccatccaattgtagacatgataaaatggtttttttttgttgttggtttttttttttcgagacagagcctcgctctgttgcccaggttggagtacagtggcccaatcttggctcactgcaagctccgcctcctgggttcaagccagataaaatggttttttaaagccactacatttcaggtcaagttgttcccagcaatagatagatactaatgatatgtattgaatatatactacaacaatgatgcatattctcctttgtaagaattgtcacctctgattttctgaggattagctattcagagacgctgtagttcttgctttcttggtgttggaatatcctttctttttggcatgatggctagagaagatatcagtgatgtatgtagatgtatgtttttaactggaataagaaaaagttgagattcatgaagagcagtcaatgttttcagcacccttcatttatctataaaattcaaattctctgcccaaatccaacttcacaccctctgcaggaattccccctcatccagggccatcctgaagattaccaaacttctgctcaacctattccagtggaaacaactgattcatcagaaggcagtgctgtctgcctttaaacatctgtgattataaagaaatacagtaatataaaactttgatcataaagagaagttttgcacagatatttgtaattcttaatttaaagaaatattccgatattgttaattacacacaccaacacatttgcaaggaatctctggacttcagatacctcacttcaaattgtattatttcacattattgttgttgtctctgataagggaatacgcatgggggatgggaagtggcagtgggaggtgttggggagggaaaggtgaaaaaacaccacatttactgaaaacatactatgtgctaagttctactgcatatgccagactctcaagaacttggaggttttagaagttctttaatgcagacatttccataaagatgtatgttttccctacaaatcaaacattttatgaataaacattatttaactcaaagctttttttaagcttttgaatggagaagaagtctcatctaccttgaaacattattgctatgaaattattttattccaaagtcaatggatttgttttttacaaaaagcttaagtaaaggcactcctgaacacaaattcttttatcaaactacttttgtcacaaaggtgtttagtataatgcgttataaattatatgagtgcaaaatatgaagaggaaaatgtgtctgtacaatggacattaggaaaaatataagtaacaaaataatgtgacgtgaagcttatctttgaaatgatacggcatttacttctaccatatgtgtttgctacggtccttctaaagttctcagcatttttaataacaaaaaatgtggctgacatatgaactttagctcttacagcattaacatattccagtactagtgaacagttaaaggaataataagtgaaataaggtgtgtttgtcattattagtgagaatatggagccctgaattatggtaaatagtgaactaattgccttaaaaatggtagaacttttcttttgggtagctgtttcttgaaagccattttcttccttagaaactgttttcaaaaactgccatcttcctcacagatataaccttcattccagcagtcattggtctataacaaagcttttcaaagataagaagaaaaactatggtagtacttcagtgaatgtcacttgactgcagactcatttttctaatttttcagaataaagatatccatgatttatacccaattcaagaggagactttggatcatttcaataaatattaagggagattatgtatataagatattatttagataaaaggattattaaatacctcagataccttttcctatgacacacctgttaaagaaacaaaatattctgtacaagtctactcttcataggaaataagatgaaaattgcaagaagtttcttcaaaacccacctgatgttctttgaaataagatgaaaattgcaagaagtttcttcaaaacctacctgacattctttgaaatggaagaaaaaaatgctatgtttacgtacatacctttagaagaagaataaatattattctccttgtccgttgcctttccctcttttgtttatagggatggggttgaggggggactttgggagaggtctccagaattaatgaatggaatcaatcatctagaaagttatcagcatgaactaaactcttaacagcagactgtggaggtgctgactacctttcatgctaattgactgccaaggcaccctaactagccatttgcatagggcattgtggtagatgtggctctgaaatgtgcatctccacagcaatggagcaagttcacctgcctgaagaattgacagagttgctagcccagaatgcatggcttctggagacttctcaggaatttcagctggatggtccagctcacttatcatactaataccaggttagaacagttaccttagaatctttgtacattaccagagaaaatctagaagtacaatgcttcagttagacaggaggaataagttctggaggtctattgtacagaatgatggctgtaattaataatgtgttgtgtatttggaaattgctaagagagtagattgaaatattcttatcacaaaaatgataaggatatgaggtgatgaatattagttagcttgattcaatcattccacaatgtatacatatatcaaaacatcacattgtataccataaatgtatctttctcatttatcagtttaataaaatatggataaaacttagtttggggacaagtagggtcatttcacattgccttggtttctttttggtgataagtgtttacaacatatatgaaagtagaaaaaagtttgatggccaaatttaaacttacctctcatatgttccagaaacaccactgcctcccctcaaaatgatcagattctactctacttccgttcaaaggtacaaggtaacaaatatactgacatttgctcttgaagggaagaaaatcagatttctgccaatttaaagccatgaacaaatgtcagaattaagatcagtttgttggatgagtttgtaattccacatgcaaaagctaaaatattttcacggtggattttactgtcctatgtggcaatgcacccatgagtagattgggttcactgggtacattccaaagggccatctaaaatgtgttttctggttttcgtcattacatgttaagtttttgaacactagtggtcatatattacctgtgttcagcaacacgctgcttatactgttgttgaaaaactggttaacatttagtaggcacttaaatatctattgaataaatagtggggatgcatgactgcattacatgctttaatctcaggacatcctttaagttcagaaataatcctatgagctgtgattgttcaatggtttgtaaataccataattttttagagaagattgttattttaaaatgttggtgtttcacctgcctgttatttacaaacaattcttttcaatgatgttcaataattattcaattaaaaattaccttttgccccagtcagtatttaggtggagtagattgttctggtatttatctgattattatcggaaaaaaaaaactgaagttgaactggtgtcagagtggatatatatttacaggaaaaggatattactgttcctcaaaaagcattcctagaactttgcctatgctgcttgaagctattgcttaacagtttcttcccatcttatactcagattttaccatgtcccttagctgtaaggttttctccttctctcctatcccaggaaatccattgcagcaacttatcagtagaacacatcgtattccgtgttgtctcaccagttgatggtttaattagcacctagttacaaactaagtagaatcattcatggaaaacatggatctaaaaacaaaacacaaatcattcatccaggccgtagatactataaactacgtgtaatgacaactgtgatctcctggtcccaccccttgaccagcaagctgtcctgaagatgctgtttgaagattctcaagtaggctccagttggttccttcattcaaaggcccaaattatggggagctcatctttgatcctctttaagttctacattcaataaacttattcattcattcattatttgttttactcattcaaaaagcatatgaagtgccagagacacagagaaagcattctccacagtcacactcttaagttcctttgggtgagggtggcaagcagtggacataacaggtgaatgaaaaattgcaaaacaatatgataagtgttacagctgagctatacaagggcaatgtgagcatacagaagggatttaactaactcagcctagaggagcatggttaaagcaggagttgaatctggaaggaagaaattttgaaggaaggatgaagaaaaagactttgcagactcaaggaataggatgcacacagctgcaaggcaaaatgatggcatgttccagagtctgcaggcaggtgtgtatgaacagaacggaggacgggtttgaggggatggaggaaaggtgccagacaattaaggacattgtattctcatgaaagtgcaagtggtgggcagccatatatgtgttgtgggacccattgccacagtggacaacataggtggagatcatgtcaacgctaagtgtttctgctttgtatatccatacttcaataaaacgttcccaaatcaagggtaacccagttggaaatagagcaagaagaggcatccacagcatacaaagtcacaaggtggggctgctttcataggataagtaagtgaaaaccttttaaatctctctgaatcaatacatgccagtataactccgatcttccataaagctttctaaatatctaggctggtgtcaatatctaaaattccatagccagggttttatctttgtctcaatactgttcattcatttaatatggatccctgaggagttggaatgcactaaatcccataggtcaagtcgtttggcaaagagagtaagtaagcattaaacgacacagaatgaggagcggaagtacccaaaactatgaatgaagactcccaaaggggagtatttgcacattgacctgggagaatccctcttttgtgtgtgagcttgtagaataaaagaaatcagtcactctgagaccaaaataccttgtcctgtgttgtttgttactggatatcaaattctctaaacttctgttttttcaacttaagtcatattatgaaaaggaaattaaatgtatccatcaaatgagataatatacatcaagctatttgcaaacaaaaaacaccatacaaatttaaatgactatcatttatgtgttatagatatgtaggcgtatataacacattagaagttgatgttttttcttagaatatttgcagtgtgatagtcatatagcattcttttctgttcagggaaaggcctttgttgggccatgtggtctaatcaggctgtttgactagatttaaagactcaaagtatttatattatttaggactaacacaaattcaaaatgggaattttgaaatatgaagacattggatgctactaagccagtcatgaatgcccttttaaaacataataataacaccctggatttcaatgacagtgatcctagagctcctttatgggtgatgttctctcatgtttcttaattaccacaggtcatatagaccccatttgcaaaaagagttcatgaggctgagctgtgttatgtaccttgaccaaagtaatatcaaggaaggtcagtcctgagtctattagattgttgtgatttgctcttctgccaggtgcagctaaaggcatttttcctaccttagtcagagatgtgctggcttgaagaactaactcatgaaacctgaatacctgaagagttagtgcaatgtctggagggaggagcctaatgcttgcatgtgtctccctggcttgacccatccataaaaaaagatgtatgcagaatgtctttgctgagccaagggtgacctgcaccagctcttcctccaccttcattcattttgtgcctattcctttcatggtccatcctcctgactgcttcagcccctgcccagcttggaggttctgcttgcctgttctgtctctgacagtccatgctcacaacttgagcttctcttctcccttgacattgcttgaattgtgcccaggattttgtcttcttcctcctggcctcaggaccttgtgaacacacctgactgttgtgacctagtcactcctcagactctgcctctgaactatcaggtgctggatagcaaagccagtccagtgtccctggcatttatttgggaagcaatcatgttaaagaaaaataaaatccatcttcaggtgacctattcccaactcctgatttcatgtgctgatatgtttgtgttgtttagcaaactctcacagaaaatgttatctaaatgtcacaccgctatctcaagggtttgttggacttaatatctaagccttacactgagactagagctgagaatccagattagttttacctacgtatgttctttgtcggacctgcatgatttgattttatccaaatggaaaaaatggttcaaaatggaaaaaagttccaatactgagaatatggatgtcagtggccaaataatatgttgcattttaattttttttgcagtcctcagtgaatttttatgtgtctctctgcgtgtgtggcatgtgaaggaacacaaagttagaaataagagagggagacaacctgtggggtggccacattccagggtctgatcctctttggggatactgtgatatgctgcccagatcctcccatcagtgctaaagaagacagccaagtgggagacagtgaggcaacctaaatgttctcaatggcaggaaaccattaccagccctggaatggaaaaaatacagggggtggtgctgtcacctgcccagaagccaaggtcattagacaggagctgagaccatgaagggatgaactgtcccatgtagactggaacttcagaaaaagtacagccattgccacaggtgcccctgaaacagaaagagagaggaaaaaacacccatacatattcccgtttataaattgccaggcttctgtcagttattcatgttgtaacaggaagctacggggccatgtcaccagggacatgtgcatccctggcacacaaagccgaacagggcatggagccgagggtgaagagacaagtgacaggcaaatggcacctgctcagtcaaatctctgagagtgcagcctggaacccgcatgttcaacaagttgtccagaccattcttatgtgcaccaacatttgataacctttccgtaacatggaaaatcccttaaattgccaggctcttataattgcaaaacaattatagtcatcaattctgatggaaggaagatgttgaattttgtgagcctttccccttctctgattgttttaaccaaatatgataaataacctgtggaatatacgacaaaatgtcccttaataacaaatttctccctttcagtgtaaaattatctggaaaaaagtctcctttttgcacagccccttgggagccattaacatggcattctacagtaatccaaaatgtgcagaagaaagtgaggtacatttacttaaaattagctccacagtgtagtacaactatttccagcattcatcattgttaatgactataattgatggctgaaaatagaaccctcaaatgagaataatgtccaaattcacacacgcacactaattgggaattgttcagcctgtgagcatggcagccagatgcaccccacacttcgacttctttcttcaattcagttctacactgtacttcattaatgcttaaggctttaaaccgctgcccttgtttaacacatgacagtttttatgtgtggaaatgttctatgcatgtaggggtgtgggaagcagacacaaacattctgatttaatccactggaattctgtggcaaatcagctcaaaatgccttagggaaagatcctgtattggctttaattgttcctaatatgaaggattgagaaacgtgctttgagtgcttttgggtttatatgtaaactaggaagggaaaataagaaaatggaatgaacatagcaaagaaagatattcttaaaacagggctgttgctctttatagaaaataaaggtttaaagcagccaagtacttgatttaccaagcaggactgactcatcttcatcagtggagatccccaatacctaaggtacatttttaatataagaaattaacatcattataaatagatttctgtgttgctgttctccaaattcatctcattaaaaacgtgaccattaattgatgatcatccttgagtcactcactcttatcgtcactggtttcttggtctgatactaagaggaggccaggatgtgcagtaaactgtatttatttccagtgcttcccctttccaggtgactttgggtaactcctgcaaagtctgatcttcaggcccctcaattaaaatgataggattggaattagattatctacccagctctttgaatactgcaattcagtgagtctataacacagaaacttacctgtgtcctgtaaagttaaattagattttgccttcaccgcttactataaagcatacagaattactcgttgttatttaaacacgctgcaaaaattagctgggtgtggtggtgggcacctgtaatcccagctactcgggaggctgaggcacgagaatccctcgaacccaggaggcagaggttgcagtgagctgagattgcaccactgcactcccgtctgggcgacagagctagactctgtctcaaataaaacaaaacaaaataaaataaaataacacaccgcgtattttccagcatttgtagtttttctcaagcctaaatcccattcccaactaccaagtacctctttatttcttaaggccaagatcaaatcctatggttttcattgccttatccgttgccccggttagattcacccctctccctttgtgctgccatagcttccccatatacattgcttgcatctcatcatatacaagtctgtccagtttcaattaatttttgtttattatcgactgactcctctacttaacgaggatttcttcaatggttattattctatctaaccatctttgcaaccctgaaggttggcacatattagacactctgatgatttaaacagtttcatagatttttttgcttaaacattttgtagtaaaacattttgttttgttttgtaaaaaatgtttatttttgttagttaaacattttgtggtagccagccttaaccatggccccatgactctcccccactgacattcatggctcatgaatatcgcactcccctcccatttcaatcatggctaacgatgaggccaagagaatatggtagaagcgatgatgtttcctttttgaggctaagttataaaaggcttttgcagcttctggctggtcttgtgtacctctccctctggaggaagccaaccttcatgccattaggatactcaagcaaccctgcagacaatctcaattggagaggatccagggcctcctgccaatagccagcatcaaattctcagccatgtgaataccactttgtaaacaaacctttcaatctttgtcagtcctacagatagctgtagcctcaatatttgactaaaacctgttagccaagccatttccaaattcctatagaaactgaaagataataaataataattattaattcagtaattacttattgaaattatttattatttggcaatacataattaatacaaatttcttcctccccccttttccatgggaaccaatattatggagtcaaaaaaaatgggtttgccattgaaatcttgcctgatacttaatatcaatatgaataatgtattatgaatagtaacagctattggcattattattaatgtattagcaccattaactattatattattcattctaattaacatagccagatgattggtatgcaattaatgtagtaaattagtaataatatcattggtatgttgttaaaacactaatgtttggatgacaatactaacaataattattaatatcaattattatatctatttgtaagtgatagaataattataatattatatctacatgtatgtgaaatattatgatccctatttgaataatgaggaaactgaagcttagagcagttaatttgtccaaagtcaatcaactcgtataataatgagttatgactccaggctagattcatcttaagcatcaaaaactagcactagagctttgagtttcctcatctacacaattggtacagcaatacttaatatgcactgtgcttgtggggattaaatgagatgaaacctgtaaagttgcttgcagaatgcctagaaaagccacatgcatcaaatgccagtttatctcccttccctccacaatctgctctgtttctaagaagcccctgggaacacaggccattaggcagagctgtcagaagcagaagcctcagatcaagtccatttccacatgggaccccaggtcctgaaattgtgcaatgagggtgactcttatatttcctgtggaagaagtaaggttacaactcagtcttttgcctttctcaaactcaggctgagtatctaataatagtgacgttttaccttttgatagtactctggagattacagaactgtttccattttctacttaggagagggtaaatggatttgatgcagatgtgaatcagattggccatggaatgaaagttggaaagtatttgtggcaacaaaccccttatgactgacacacacactccttccttaaaacctttatcttctgcagaagcaatctcattacaaccaattggtggtcagttacacagaatggagtcataagagtcattatctatgggatgttttttcctttattcacaatgaaggcataatctttttagagagaaatacaattctctccagatatataacaaaatatatctactgatgttggtttagtttcatgtggttgacaagaaaaagcattcatttacctgaatacgcagctcaattttaaaataatttctgtaattttattataattcacagagctgcttttattcattttacaaattgctttcaaagcataaatgatgtattgaaagggattgactatccgtaatagctctgatgtgtgagtggctggtggacttaccactttaacatgatctggcatcaacctccatgagctgcgcagtaagaatagcaataccaaattgtggtaaacctcaagagttttcaaggaagcaatatgggtctaattgggcagaagcttagcaagtagaccacagctatttctttgtagaaagtccagttgtgtattacaaagattgtgcctataaggtttgccttgctaaatggaaaccacaaggaatgggcctttggatgtcttcttgaatcagagcattaaagggacttagctggagttcaataaggataacatttttttctttgcaaaaatatgagctgtgtgcaccagcacacatatgtacttggtctgcaggcttctctctaggttgccaagaaaataggttttgatggacagggctgtaccatgaaggatagtagacgaaaaaaaagatattaaaggaagccccctttttaacctttaaacaaagttaaacatgcagtgtttcttaatattgtttaaccataaatgccttttcaaaagtataatatgcactaagatttgctctgtggaacttgcttgggtaatcggatcttttaaaagagagagaaattctgtggagtgagacacagaaaatcttattgaatgggaccccttttctccgtgtgggaatgaactggtctctcaactttctccttagctaactgtctgcaacactacagactcgtatctacctccaacatgagcctctcttgtcctcacaagaacccctcgagggctctactgtgtcctcagtagcagacactgtatcatgttcaggtgcttgtctgtttttttgatcactagccccatcaatctgtttttttccaacttgccgcattctacacattttcctcctcaggtcaccaaagtgcagcctttcatttctacctccagaaactcaagagtttctggaaacttgatttgccccatattattaacaaaacaattttattaacatatatattggcctctgagctgcttctgaccacagacaccttaggttcctcttggttacaaaagctgtggtctatctctgatgatgtacgaaagaagctgatgcttatcctgtggttgttggtcctaacctcctgtttagtctttttgtaatttgaatctcatgcaacttttgtgatactcttagcccatcatcaactgcttagcccatcatcaattgaaaataatcagatatcctaaaatcatcagccagcgaacttttcagattgttggcacttgagtttttgtagcactaagtaggaactatcaccttaccccagtgtcataaatctatgggactaaaaattttgagaaaaactcatataccgtattatattcaatactccagagatctactcaggttaattttcttgtcaagattgggcagcttttgacctagaatatcaagctttttttttactatggggctgtggtacattccattctttccttttaatttagtaacacttggatttcctctctaataaggaacaaagtaaacaataaactcagaagctcccaatgctcttcagtgtaggagaaattatttcacattaccagggaagagaaggaagttgcttttatcctaatagtgatattctcatttcttatctttctatgcaaaatgtttaatgtttccatcttgtggagcccttaattacatccttaccagatgtgatgcaaaaattaagcatcaattagctttttctggattgcacacatccttaaattctgttttcagatcactgcaacttaactttgtgatttatattggaaagatagctttgggggttcatttcacttcattattcttcagcaattgtatttcatccccttagctatttctatggcaattgtgctctgttgagaagagattgaccagtgttgctacatcacaatgactgtgagataaaatccggtagagcacagctagattttgatgagtttttggatcccacacgcacaaaagcagcataggaaaataaaagtgataagcatcattttttgcattcaaagttgttctgatataagacagactgaaccttttaaataaatacatcaataaaatggactaatgcaactgtaagcttgtagtctggtttcatttgataaaagcatttataaaaataagaatgatttcccagaagtcagttagtataagaggtacaatggaaagcccagacagtttggaggacggctttgggtactcaactcatacatgtgtatgcatatgtaaactgtgtgcttatatatggatatgactatagatatagacatatgcactgtcttttgcccaaattatttcctgttatgtttattggtaatatttgcctcattctacatgtagaattcctatttcagcttaaatctcaaatgttagtgaaagcctaattttttatccatcatttctcaaaaaaggctccttacaatatatctcttcatgaagagaagaaacagaagcatcccttgagaggaaatatagcattacacttgtgagcaaggactatggacaagattgcccaagttcgtctctttcatcacatgatgaaccgaaccattggcccccgttctcagtggctctgtatgcctatatccttgccatggtctcattgtgagaaaagagtacatcccgattccttgactttttccttggctctgtgacttctgtcggcttactgaaaggtgacggaagtgaggctaagttagttccaaggctgggcctcgtaagaccttgtgcattttcactttctgctcttggcactgccatgagactattgacttgataactcattagtccagaggggataagaaacatgtgaaacagaattgccccagcccacctatggtacaaagcccagctgccccaactgtcatagcctaaatcagaagctcccatccattctcagtctagatttggtgaacctcagctgaccacatatcatctataagaagtataatgaaaatcccagatatttgaggggctgctttggataataacaacacaaacatatatatgaatgtgtgtagttcatatgtctatatatcatcattgtgagaatcattctgtattattatattacattgtaattttgtgattatttattatgttgcaatagctgaaaatgtgaccacctgttatctgtgtaacttcaggcaacttacttaaactttttctgcctcagttccctcatctatgaaatagaaacaagaattatctactggctcctagaattgtagcacatattaataagttaatttataattaaatttattagactaatgcctgaaaaatagaaactgataaatgaatattacctatgattattttatcattcttctatattcactcctaaaattttctgtgggaccactgtgaagtcaaactgctagagaaagtctggcactgtggccatgacagtggctcaagccaccacagaatgtctgaccagcccatgaggatttgacaagcagcagttacagcatctatccagcgaggacaataagaactactttacctgttggcagaaaacaaagaggaatattttatttcccaccacatcttcacttcccatgttatggtgagctggtcagaaattagtgccataattcttcagctttgcaacttgccggggacaacatgtgtggttggttgactccaaatttttctcagcttcccctgccctcttaaggagtggcaaaaaccaaaaagcatcctcctttaactcaaaaattgttatcaattcacaaaaaaagatcttttagatctcgacttatatttgctaataaactatggcttcaaaaaatgtcataaattatgccatgctcacctatatctacttccacagagttgaacctggatgtaaaggacaaaatattattataagcccaaaggcattgtgacatcttaaaattttattgactgtgaaataaaagaattccatgactgaagaaatggctactgactgtataaatttcttaaactagtatcaagtaaaatataaacacattgactaactctactggaaaaaaatggaagctataaaaaaattcatccataaactcttccaaggcaagctgtgaaagactccagagcatgccaaatgttacccacattagttaaattatagtaagaatccccgcgcactaagtctgagagggattgtttttgtccttatgaagaaaaataaatatgtttttcaacaagaaaaccttctgaaggctgttgaaattttaatcttttaaaaaatggttttaccacatagcaaaacctcaaagttgtatttcacttttaagactctcaaagcattccatccttgcaatttcattttatcctcatctcacatctggatatcctggtgagatggaatgtctttctctgtgtttcacatgctggccttgatcatgggtggcccacactaagttgtgagaaacagaatgagctaagcaaagggaaaacagaagggatgttaaggcagagaatgatcaagggccgtggccaaggaaatacaagcgtattttattacattttcaggcatcagcatctaatcatgatgttggggtggtccaggatgggggggtgtattagtccattctcacatcgccataaagaaatacctgagactgggtaatttaaaagaaaagaggtttacttggctcaaaattctgtaagctgtgcaggaagcatcatgctggaatctgcctgggttctggggaggccttaggaagcttacagtcatgtcagaagccaaaggggaagtaggcacgtcttacatggtggaagcaagagagcaagtgagggggagttgctgcacacttttaaataaccagagctcgtaagaactcacattgtgagaacagtatttacgggatggtgctaagacattcatgagaaatccacccccatgattcactcacctcccaccaggccctacctccaacactggagattacaatgcaatgtaagatgtaggtagggacacagagccaaaccatgtcaagggaggagacttagaatgatggtgggaggtctaggctgtggtgcttgactagaagattctggtgacagtttattaagggagaggtagtttgtgatgggttcagctagatatccacccctggaaaatagagatgcaaaaaattaaacaagagggttcagttctaccccatttcctcttatatagtaatgggacttggactgaattcaaggggtagaaaataggaagcaaagaccagggaagagatgaacaggaattgggtaggtgtgttgggcttggttggaagaggaggttgaaaagacactagacactatggtcccaagagaagagtccatgaggtgaggagtctgatgcaagactctattcctggggccatagcagcacaatccagcaagagagtgacacaaggcaacatttaactctttcttgaccctatttcttagtattaaggaccacctactgtcagggtaggctttgtgacttcccaatgccggtggagctggacctacaggtgcatgccacgtctttggggtccctaggatatacactgatggagctgttgggaaagggacagcatccagaatgtgagaataataggccacagaaacttcatattacgcccatttatttcaaagatgagaaaacagaggttcttagtggctctatgatgtatttgcagtcaggacccagaaccaatgagccaaaaatcccgagacctttcatcctttttttcatcttttttttttttttgcctctgtaagacaccaaagaaattggctaatgttaatttgcttcttctccagttcccttgcttatcacattaatgggaatatcagaaaccacaaaaagcatcatgttggttgcattgctatttgaacatcacaaataatttgttttaaattctactgttactcatttttgatgcttggattagaaagatggatgtacggatagatggttggatggggggtgggtggatggatagatagatagatagatagatagatagatagagaaatagacagacaaatctgaattgtaagtggtttggacacagtgcatataccacagctataaggcacgtaacactttacctcctttgccctggggggttgtgtcgtctctcaagaagtcaacatctggctttagttgataagctaggtgattaactttttatatcaagatccactgcccaaaataatttgactagtgataaactaaatttttatgcagaattatttagtagagtaggcacctagaaaagagacaggaaacagtagactagatttcagtcacgacccttttcctcaccacttggtggcactgagctcaccacttaaccttgctgtaccacactcacctccactctggacactatgagtgtaatagtgacttaaatgaggtaatcaacatgaaaaacactttgacaatgaaacagagttgcatgctgatgccaagtggccttgttattatatgcatttatcatcaccatttccctattcttattaactgactgggttagaacaagttcaaagaaggcaggagctcattcctggaagttgactctactttgttatttaggtaaagtgtgactaccgctttttgtaaatgtgcactgtgagcagagtgacatttttcatgtggatggtttataccagttcatgttcgtgtgttgacagttatgttaattctatgtgatattttccctccagtgcttttgcttttgaaacagcataataaagtgacttctgctaaataaataggcctgttcacaataactgatacttaagtgaatttatgcaggaggtattttggtcttgtggaccaaactaactagctgcaaatcgattaacttcaaggatccagcagagtatttaggataatttctgaagtgcaaatgtaaaagtcatggtagaattttttttggcatatgtgtagaatttctaccatgggcccatttaaaaaatcaatatcataataattacatcaaagcaaaagtaacagagcattatgtgcatgatcagaaagctgcaactgagaggaaagtccaaccactccaggaaaatgagaaacgtgtaattaacatctgcaatttgcattgctccctgacactcctgaatttttatgacaaatcatgctgtaacctttgtaagttggacatcagtaatggttgttttttcatggttttaaagtcaggaatatgaagcatcctctttcacaatcactcatccctactattgccttatatggataatctcaatcctaccccttacaacccacctcactgtagtattctctcttgccaaacatctagcatgcctgcacatatatgagtagcaaaaatgtacatttcttaaagagaaaactgtgaataggagcagaaacctagaacatgtaaatgttttgctgctgttgccaataaagggactgacagaatcactcaatgaatcaactgactaggactgcatttggtgacattatacaaattccctaggaggagcaggtctgccaagagttatgagagatgctatggtaatataattatgaactccctgcagtcaggaagcttataatccaggtgggaaatgacgaacacataaaatgtcatcatcaacctatcaaacatcctttcttcccctgggtcccggtaactgctatcatttagtgagcatttgctgtgtgctcaacacaatgcagacattaattcatttactcccccagatagcctagtgaggtaattgaacatgtaagccccatttttacggacatgaaaactgagctttagtgaggttaagcaacttgcccaagattatgcaactagtaagtggtgacagtgggatttgtaagtaagctcccagacttcaccgtacacctagtgttgtactatttatgaagggtcttatcttttctgtccaggaaagtctcctggaaaacaagacaatttctgtcgtacacatcctgtgtccttctcaacccccaccattgtttgcagaatgaatgtatacattcaacttaatatttattgagtgtcggctctatatttgatacacaatggcacataaaaggataaggaaaactacaaggcagtacaaaaatgcctcattaaagaccaggatgcatgccagctgcatatttttttttatcagaaatatcatgatgaagaatagcctttttatagaaagcataaaaatatgttgcaagaaggttattttatgaaaataacattaaactgtaattgacaattacctagaagattcataagtggcatcacacttcatggcagtctttcacatcatactctagtcagctagtgaaacaactgctgttaaagtcaaggttttggaggtatactgagttgaagagtgtgttccccctaaattcatgtctactgaaatctcagaatgtgaccctgtttggaatagaacctttgcagatataattagtaaagttgaggtcacgctggattaaggtagatcctaattccaatgactgctgttcttataagaagatcacctgaagaatctctgatcacctccataaaaatgtccaggactgaggaatactccctaaaaattctgattctcagcaccacttcaaacgcacaactcataatatctatgaagacggtcagtaactaggatgtttactaagcacactagaagttttttgctcattacagtttgaaaactatggctttgggcaggatgaagatgtagaagacgtagtgcctttctctactgggttcaccttgatcaaggaaatgagtcgtggaaagcagcatagcaaggaataatcttacttgtggcagtaaccccctgtcgaagtacaaaagaaagagaccaccatgaatgggagcaaactagataagtgtactaagaattcacaaaattttatcttggccttcaatttcagtaagcacagcaatctaaacatgtccaataatagttttgcatgcagaccaaattaagccttgataagagtgatagctaccatattttcaacagttgctatgtgataattacttcacacacatcatttctttgaatattctggacaaccctaccctacagtattggtctattattagccctatttaactaatgaaaacagagtttagagaagttaagtgattcactggaagtggccaatcccacacacaaaactgtgaccaatgaaatttaagcctattctcttgatccgaacctcctctcccacaaaacagaacacctctttttaagccatgtggcctgtctaaaacaggttttccacgtggactggatagacttgaagtcagagagtaaaaatgttatttcttctaggagcttcaattttatataaacatttagggtaagaaacactttttatcctaacataggcataaacatataaataattgggtagaattgtaaaatatggaatgcagttttaaaataaaagatgtatgttgaaggaaactttgcaattgaccagaacttctcaggctatcctccatgaactggagtgtggaagggtccccatttagaatattcagccttcgaggatacttcatggtaaacattgtgaaataatctcataggttccctcactggttttgtcccacactagactgcttgggatgtcacagactttcattagttgctttaattagttcttttcaattgattcctgtgttagtttgccccacccctccaacatagtctacaaagtgaaggcagcacacacttttattgacttgagacagcagcgattttctctcatctagttatcctgacctttctttctactgcattttcactgtgggtggcaatgatgatatggctttagtccatttttggcagaacaaaggaatttcctggttggacaccaaaaggaaaaaacggtttttccacgactaagcagtatcaagaatatgccataacaagccttacgtaagccatggctcatgcagtctagagccgtcctgttaaccaactcacacccactggctagagagaaaacatggcgaaatgtcagagctgctaactgagatagaaaacatacaggctgccacatgactagaacatatggtgacccaacatggcagcagcgagaccctcggcatcaagaaaaaacaacaaaataactccttaaaaacaagggctttttctaaagtggaccttgacatagtcaaaaaaaaaattatatatatatatatatatatatatatatatatatatatatggcttcttcacatccaggttcccaaagatgtaacttaggaactaggtacattttaaataatttgttgtccagaatgtatctgtttcacaactcagaaattaaattacatagaaaaaatagaatccttcttaaagtttttcaatgaatacatcatcagtggatctttccaaatattttttacagctgttcacagaattaaattttagctttcttctcctcaacatttccaaaagtataacgtagaggattggtttgtttttaatgaataaatcattcggctaagcccatggaacaaattcatacttaaggtagatggtttagagtggactttcggcagcattattttaggaatgtatctctctaagcaattgagtggtgactctaaattgtgccaatatgccaattccatttgcatatctttgtaatttggactcttcctctcctgctgaaagatggttggataaaacattattggatacagcacaaacgcaaataaagcatcgttttcctgctgaaatgcaaaccaaggctttattttgactggccttaaattttgacctgtaactggcattggaaacatcagtgaaaaccgagaaacagccactgcagcatttagcgtcacagatgctggagcagaatcgagtttagaaaataaacttttaagggattacagcagcagacgttatataacaagattagtataatgggtgggacatctgttggctgttttcagaaagccatcattctattaccctctactaaaataatcttagtggatacctgactgttattgttctttttttccatatacccccagtgagaaaggttgacatttagttgacatttctatgccgtagtcttctcttctttctttttatgtttttgtttttatttggttagttattcttttgtcattgttttaattgttcattttgcttaaaagggaaaaaaagactgtcttactacaaaattagtatcataattgttttttctcagttagtgttcagggtggctttaccttacacataggaaccaacatacctcagagtatagcagagaagtgttcaatagctattaattgttttctttccctttccattcccttgagaagattttgatattcataataaatgttgttttaaaacataaagcttataacactgaattttaccttaagactataatagctgaaggagaaattcttttggaagttaaaatatgttgaaacatctgtatcaatcactctctctctctctttctctctctctcccatgcaaatgtaccaatacaccatgcattctggctccatgccactaagtcatgattttccacctgtaatggattcccagcccccgtgcaggatctggtgcagtgtgccgaagagaggccaaagtcactgtacaagccagggggaggggggggtcatcttcctcaaggattagtaacgattaggaagaaaagcattgtctttatatacagccaagcatgaatattatagatactacattactaaaagaccatgtgacaaaacccaaatttaaataaaattttgtagggggcattttgggcatcatcccaagttcccgagggagacttaatagccctcaggaatatttgcatataaacatttgaaaagcacttaattaattgataagaccactggaagttgtgagttcaattttcaaaatatgaagcagacaatgttgtggaggatggacaacctacagagggtaagagggaggagaggaaaagctatttcttccgcagagagaaagccagggggcccatgtttctacctttttcctcaagtggtctttccttttggggtccctaagtcagttagtagtcataattaggtcactcagagcccactgatacagtggagagatatgacagaccttttctcatatcctccagttggctacactgattacaagctggaaagatgactaaaaaggggtgtctcctccagggatctaccgtctagctgaggggcatgttcctctatctggcatttaaagagagagatgatatgaaatagctacaagttcataaagatataaagcgacaatcaaaggtttggaacagctcatgcgtgttgggggaggtagaggctagggtggctaataggagaggcacagatgtaactcaccattttccttcctttcttttatgttcacacatgcacacacacactcacacacacagcactgttgccaccagaatgcttttggtttgtgctttcacattgtagaggacatgaacctatggaaaattactcaagggagattgttctgttgaggtttgccttttgaacgaaaagattctttcttgcaggagtgggagggacatcagcttgagaaaaacagcttttgtcctcacaaaaatgctcttttggaagatatgttaatgagcttcctttgaactgtaaatggcatctgcatgcacgtcagatgctaatggaaatgtcgagaaaacgataaggcacaggacgattgcacggttatgcagtgggccccgttccttcgagcatcgtgaccaggctgcggagccaccttgtgacttggcatagcattctcattttgagtggagatttttgtttctcccactgatggcatcttttgaaagtcaagatgtgttggctttataaagcactatcctccctgggcaacctcataagcagcaatgaatgacaattcttccttgaaatttttaattacttcaacaaagaaagtaattattaacttttgtctctgaaccacctctgcagatattcttaatcaaataaaagaaagaggaagcagagctttctgagaagcaggaggatgaaatagacaataggggtctgcagctggattgcggggtgacatgagcgctgcatgtgtgctggataaacaatggctccatggttggaagggtaatttcatgtcatagactagatggcgaggaagaagtttgagtcaagagacctattcttggcactgtcttcttcgtgtaagggtaccaagggcaccatgggagtgatggcaaagtataggcagcagcccgtaccttatcggagtgagaagatgaattacattgaattaacacttgataggctgaatgttgagagatgaagtggatatctgaccaattttctcctcacctcttgatttggattctcccaaaagcagaccctaagacaagaattagagtgcaggtagattatctgtggatcatgcagaggtgaggagagttgacacagagcatgccaccaagagcatcaccctgggaaaccaggcatttatccctctggagaactctgggatctctcccccaagggtgatcgaacagggggatttaaacatcaactcccgtcagtctttggttgaggctgccagggtgacaggcattaattttccaaactccagctcactagatatttgctcagagcctgccagcactatgaaagccctcaggcaaagaagtgcaggtgcttggccattgtctggctcacacttactacttagacccacgggaacatgaacagggcacctcagtgctgccacacctccagactgtgtgggcccgcttatcttttatggatttgctaacaaaccatcaagtaatccatttctcacatagaaggagatctgtaactcttatctagaaggatctacctagcattaggcaagatagacatctgcagagatgtgtcttggctctgggtggctttggccatgtgagatttaccctcacagctgatggcagtcactgcacggttgccctcggagccagtttcctgtcctttgaacagagtccacagagaactttgagagacacgtttcccaatggtcagtgtcggatggggccccaatctcaacaaatctgttgctgtcactttgttagggttacatgtatagcgtatattgacttcaagtgctcttttacaaaacaagtcctgacttcttaccactggtcagccaaatgctaaatatggtcactcctgaaattactagtaagcaaggagcgggtagcagtcactgttggacagagctcaggtggccggcttcatgtgtgattggctgctgccactcagaacgttggaaatgatggaaaaaatgggcatgggaagaaaagaattcagattgtcaaaaatagagcgttattgtcctaggtcaagtgtccatggaagtagactgagaggggaattgcaagtaggaagtttatcggattatgttcctgaatcatacctgggtggagaggaaacatgtgagaagcagggttgggagaagttgaactgtgatccggtcacagcaaaggcttcggctgatcccaacaggggctcaggagtggggaaagtgtcttagtctactcaggctgccatcataaagtaccacagactgggtggcttaaataacagaaatttattttctcatagctctggaggctagaaggcaaatatgaaggtgtcagcagggggcatttcttctgaggtttctctccttggctggcagatggccatcttccccctgtgtctttacatggtcttccctctgtgcatgtccgtgtccaaacctcctcttctgatgagaaaacttgttatatgggattagggcctatccccgtgacctcattttactgcattacttctttcaaaactctgtcttcaaatatagtcacattctgagatactgggggttaggacttttatgactgaatatggaggagacacactttggcccagaatagatggcccttccgagctgcatcaaattgagggaagggggtctgggccttgaggctactccgtgagtcagtcattggatgcaggctgacttcaggaagagagaagcagcgtgggtgaggtgcctgcttcagcagaacacagtcctctgagagccactccttggagctgtcagtcaccagcacctccagcaagggaaggatgatgtgcattgtcctgaagggaggggcagccaccacgagcacacggcagcttcctctttaatcgtgaaaagaaagcccattttttatctttgactggcatttcccctcagtctctcccaggatcatctctttggatacaagggcagaacaggtcatgcttgctgtgctagaatatagaacggcaggccctaagcctgtgtgtgtgtgcacgtgtctgttccacactaaacatatggagcagcttcaaggaccacgacagatgtgtcgtttgtgaaattttgatcaatatgaggcaggctcggaaattaacttgtgtgaatgagcctccagctcaagccaaaataactcttggctcctcagatgcatggccatttttcttattgagttgaagaaaagtcaagaagagcaatttatcaaaacaaaacaggaagattctgaattctgctgccacagagtaatgacagatatactggctttgcaaaaaagccccccaaaataaaggatcctttttatgcccatagaagcaattttaaaatgcaaaaatgtactttgagagtttgtggattataaatgttttccaattcacccaaacatctctgggaacatggggagaaaaattttcccattctgtaatttggagattgaagtagcaggttctgtggtgttgtgcacaagtgcgaacatggctaatactttcacgaagaagaacaatgatattcggtgacatttgacaaagatattaaaatctcagaatacggactcctatggggtcttgtgaaatctttatccgttacaccatctccactatcagcttacctgtttcccgtttatctcattggctgatatgaccagacaaaaacagagctgcttatatataccatggcctattttcatgaatgtttcttttaagatagaatttctcataaccagcctgggcaacatagcaagactctgtctgtacaaatattttttaaaaaattagccaggcatggtgtggcacacacctgtagacccagctactcaagaggttgaggagggaggactccttgatttcaggagttctaggctgcagtgagctatgtttgcaccactgcactccagccggaaggacagcatgagattctatctctaaaataataataataatagtaataataacatgattttcactataacagataaaaaaggtgcccctgatattctcatctggctatacctcgtcttaacctggcttacaaggtcagggtagaaataaaggactcagcaagtgaacactgattttatttccatgccagcaccagggtaggtgttttaggtaccttatgaataataactatgcaaacaagcaactgatgtttatggagcatttactctatgtcaggccctttgctgaggactttatgtagaatttctatgtggtcattataatcaacggtggcaggcaggattctaagatgatctttcagattcctaagtcatggtgtacacagacctcccaattttccaaaccataatactgtaaagggattttgaagacgtaattaaggtctcaaatcttaaaatagggagattatctaggtgggcctaacttcatcacatgagttctttaaatttggaacagatgtggaggaagtcagagaatcaacactgagaaggagttgacatgcctttgctggcttgaggatggaggcagaaatatggcaaggaatgcaggaggcctccaggagctgagctgtcctccagctgtcaaccagcaaggaaatgaagacccccatcctgcaactgcaaggaactgaattctaccaccaatgaaaaggagtttagaagtggatttctctcctgagcctccagacaagggctcaattcagctgacaccttgattttagcctgtaacaccctgaatagacagaacccagtcatgcaatgtcagactttagacttacagaactgtgagctaattagtaggtgtgttttaaggcactaacccccagaggtcaatgtctccattttagagatgagcagactgaggcttacaaaacttaagtaacttgttcaaggtcacaggtaaatggtaaagtcaagtagggacacaggcagctgcttccatggagggaactgcgtgggaggctgaagttcaaaacagcctccaagatgccaatatgatcgcccctaggtgtgcacatcttgttcagttttctccccttcagggtgcgtagaaccttcaaatatgatggggtagtcactctgttgattaggaaaagagatttccacagagggaataaaggtattgaatcagtctggctaattacaaacaggtggacttgactaattaggtgggcttttagaaggaacgtagaggtgggaggtagagaaagtgatagaggcacactcttgctggcgtggaagaaaaagagcgctcgtgtcctgaactgctttggggaccatatggcaaggaaatgcaggtggcctctagaagataaaagccatccctggtcaacacctagcaggaaaatggtgacctcagtcctgcaactgcaagggatcaaattctgccaaaagctctaatgggcttggaagaggattccaagcctgaggtgaggactctagtgcaactaacactttgattgcagcttttgagactcaaagcagaggacccaactaggttgggcctggactttcagccaactgtgaaactgtgagataataaagtgttgttgttttaagccattaattctgcggtgatttgtcatgtggcagcagaaaactgacatgctgggagaagagcagattgctctcttttgcctcacttggtgggagaggagggactaggacccaggcaccccaatttcttgttcttaattaatctgtagtgattgcttccctttgctgctctgtttatccctgagttactctgagtactggggaaacttcacttatcctggtcctccaacctctcaaaacctgtctttgtacaaatttgatacttaagctttgaaatttaattcacttattaagcagcagccactgttttatgaaatcatcccatccaaccctgcactggtgagactgttgatttctctttcatgaaggctgggacttaagcccagctgtccatcaggctatatttacccaggatagccctccatcagtcctcagttaaagcagcatttgcatcacaccagatctctaaatgttggttgttggggaagcaaattacattcatcagaatccattcattctcctcgtatcactgaacacaggataatcttggctgtgtcagctgccctatgactggtggctctgaaaaatggaggttggctgcagatactccaaacctgcttcgctgtgtcaccctcttcagggccagtggatatgatgctggaaaagattaatggaacatatgtcatcacatttatggggtaggaaacccccaactgtggattaatagatatcttggtgaaagacatacatctttactcctttatgcctcgatgggtgagctacagttggctgcagtgaaaatacacagagagattacctttaggaggtcagcttgtaaaggacttttttcaaccctgaggtcaacaaaaatagatttttgattgttgaccaagagagctgtaacataggacttttaacctttaaaaaaattcttattgaagtataacatacagaaaagaacacagttcctgagtgcacagcttgatgaattttcacaaactgaacacatccagggagccagcatccagatcaaaaaaccaggatcccaggcatttccctaggtctctttgcaccaaccctccaccccagggtaattgttacattaacttctaactccatcgatgattttgcctctttctataaggtttttgaactttataaaaatgaaatcatccagtgtgtcctcttttttttctgggttctgttatacaacattatgcttgtgagatttgcccgtattattttgtatggttataaattttttgttctcattggtttttaatattccattatatgagtacatcgtaatttatccattctatcatttatggacatttaagtagcttccaatttggagatattgcaaatagtgctgctatgaacattctagtgtgtgtcttttggtgaatatatttgtaggttctactaggtatctatgtaggagtgaaattgctaggttataagacatgtacatattcagctaatttactatgtactgccaaataattttccaaagaggtttccaatttttattctcaaaagcagtctatgaaagttcctgtcagtctatatctttgtcttatatcaagtataagacaatacttgatattgtcttttcattttaaaaagctgttagtttttaatacatcctagtttagagggcatcattgttgctactgtgaaacgattaagcactctatatgaaaactgggctgaagagccattgtactcaacatagtatcattggataagatgtcagttggtgacaataatgcctcatgccctttatatagtgcttttgtttttcttttttatagagtgctttgcaaaaccatctaggtttctctgtatttctgttctcagctcttctggcaaacttaaaggaaagtcctccgaaatatcttatgtttttggttctagaactaagtacccttgaaaactatctgccacatacctacattttagtcaaatctgtttgtctaaacatatactctgtggatatttacagagctcctattatgtgtcaggacctatgctatgcactggtgatgcaaagatgagtgccacctgattcttcatgaggttccagtttaagacataaagtgaactgtcagattgttagttctaaaaatattaatgttgttttttgtattattttctattacattttagactagggaatcatctgagtttattgacagcttgttcataaaagagcaaattattttaaatatacaaagttgctttaattacaagcggggatggaaactttaggaagttaaccaagaagatgggccgggaccaacaaaagttcatcgaaaaagaagtaattggaatttgagaagccttgacagattgcacacctgtaacaaagaacattgttattctttgtacttcattgctcttctctacataatattcactgaaatgatattgaagattacatcagctggagttaagtcagataagcagaatccttgaatgatatgggttaatggatttattgcagggattagatcttatacaattgtgggagaaactgggaaagtaacattccacaaggggatgattgactgaatagaaaagcttctaaccggggcccatggaatggagctggtgaagatgtctatggaagtcccttgcctgtccatctggacagggccagaagtatgtcagcagggcagatgataaaagaggaagtaggaaagctgcatgcaaagcgggagagaacaaagacaaatgaaagtcacaagggaaaactggaatccacagagatccacaggcccatatatctgtctctcactgattggaaccccaaagctgtgatgtcctgccgaaggatccagtgctcttgctgcagaacttcatgtgggcccagcccagctccaagaacatgtggcagaagaaccatcaagaactggagaagctgtggggccagctgctactccacacccatgtgataagcaacagcatgcatgatcgcccaagccctgcacccaccttcctggcacaaagtctctgactgcacttctgccctacaaatctcatggaaatttctctgtggccagccctaacccagaaccattcagagaaatgcaacttcagcttaactaacttttgacatagactgtaacagaggcatagaaagaaagaaagaaaaaaactatagagatgagataattccatcttttcttgagaaagatgtaaaaactagggtgaggagagatgatggcttgtccgatgtcacagaactagtgacaggcctagaaactcaattctgtgtgtgtgtctctaggtgatatcacagaaaaaacaaacaaacaatctctggatgtgaggttcatgcactgtctttgtatagtccaagccactcaagaggtttgcttgaccctagaaatttgagtccatcctggcaacatagcaagactccatctctaatgtatttaaaacattaaaaataaattctaaaaaagaagacacctgagtttttgccttaattgattgcttgggccttgggaaaaaaaaaatcactcgattcctggactcatgttttctataagtgaatggcatataggctaggcccaacaaattggaaatgatcactttatatctgatgaataaatgaatgaatacaatctctcaagaaccactatttcacaaaattattttactgcctaacatttaaaaaaaaatgaaacaatgctcctgggcctcaatagcgaggcattcttataggttctcatgaaatttatctggggctagtatggggcatatgggccctttttcctttgtacaagtcagatttccaatctctcagccatataacaattagactttctcctcacccactgtgacttcttttttacttattcagtctgggcttttcagtaggagtcaagtactacatagctggaaaaacaagagactctggaaaaacagttacagggagaagctggaagaatatcagatttctagttatgtattttgatggttagctcatgaatttgaaatcagcatttagcaggattgacctgtttcccgctggtgtgacattagctgggatggctcaaaggcctggagttgaaataatctaaagtctacctactttcagtgagggtagttggatccatattgtctctctgcttcctcatggcatggtggttgggtacaagagcgaggctcccaagaagaccaggcagaaactgtatcacctcatggattacaaagttatacagcatcatttctatcatagtcataggcttcccagattcaagaggtggaattacagttgacccttgaacaatgtgagggtgagtggtgactatccccagtgcagtcaaaaatccatgtataacttttgactccccaggtacttaactactaatagcctactattgactagaagccttacagataacataaagattgattaacacatattttgtatgttatatgtattatatagctgtattcttacaataaagtaagttagagaaagaaaatgttattaagaaaatcataaggaagagaaaatatatttactgttcatgagatggaagtggatcatcataaaggtcttcatccttattgtcttcacattgagtgggctgaggaggaagaggaaggggggtaggtatactttctcaggggtggtagaggtggaggaagtggaagaggaagcagaagaggcaggcatgatctgcttaacttttactgaaaaaaatccacatataagtagacctgtgcagctcaaacctgtgttgctcaaggaataactgtagatcccatttcccaatgaggggagtatcattattacactgtaagaagagctgtgggatggaaagcgcatcgcatgccatcttggaagacacagtctgccacaagcactgatcagtacccatggtgcattcataaacacggagcttgtcaactatatgagctcttgttcaacaataaccccagagaatatgtttgtgcacgcttataataaatacatacacatatacatacataataagtacttagtgaataagactaattcttggattcaccttgcttccaagacattttccgtgttatgcctaagggtaagggcagggaattgggccactcaattaatttaaactaaaaagtgtttcactgtcaccatccccgcgcttttttttttttttctgggaaaataagttgggctgctgagttttggacttaaatcatttccatggcaacagagcctaaatgataaaaggcagattatagttccttccaatatttgaaatgtctgtatatggtctgcatggctgaggcaggcagatcacgaggtcaggagatcgagaccatcctggctaacacggtgaaaccctgtctctactaaaaatacaaaaaattagccgggcatggtggcatgtgcctgtagtcccaactactcaggagactgaggcaagagaatcacttgaacctgggaggcggaggtggcagtgagctgagatcgcgccactgccctccaacctgggcagcagagcaagactccatctcaaaaaaacaaacacacacaaaaaagtacacttagcagagaataacattgccattaaccccccatacacaaacacacactcatacacactcatgcacatatttatacacactcacacaagaaacatgagtgttaaatttcataatttatattaaatgattttaagtatgggggaaatgtgtaggaatgacactgttcagccttgtcttctcagatctgcattaagccaaattttcttgttttgattttttgatcggttggttgactttagaaatattctgatcacgtaaagcctgggggaaaaaagtcaacaatcgtagatacagaagtgagaataattacgatctttggaaattccaagtagttcaatgtggcttgagagtcgtttatgtctgagggaggataatgaggctgcacagtcttatttttaattttaggatttttgattatgaagtgtttcaaatatatataaaagtatagaaaatataataatatgagagccatgtacctatccccatagttagcagctattagccatttgccatgtttttctcaaatcccctttctttctaaaggaataaagtattaggtcttcagtcaattccctacttacctcctcctttacctccccaccctccccagaactcatcattctcaaaaagttatgtgcgatattcctgaggcactttaaatttttggaatgtttttgagcagacagcgattcatgaattgggcagctccaaattgcaggtgattctgggctccactgaaggggcatgaagggcttttgtagagttgacatgaaaacaagtcaaagaaaatatatgatcactccaagtggagcaatagccttatttgtatcattccagtggaaagaccctagttagagattagttggcagtgtatgactggctaagcttaaattccttttactgtttacactttggtttgattatgtaagaatccaggatgcttaagccacctcagtctaacagcctcccaattaattatttaaacagtacttatgaatagatccctacactcttgtatctttacgttttgaaagtgtgcagaaatggtatcagagagtatgtatccttttgcaacttgttgctgtcactcaacattatgattttgtgctttagccacaggacataaacatgccatacagagagtggagatgagcattcactattgcacagtttacatttattcaactaaatttagagttcacctggggaatgagttgacaatgacaggtttagcatttatagaaaatgctaatgataggcagataggactggacaccagacacgaaagtgaacacaagaaaaaagaaatgtggttgtttgtactctagttgttccatttcccgtttcccttataatccatcctttgaaggcagttataagggctgcatggtctttgatgattacaggttagaaactgagtgattttccaagaggcagtctaccctaagtgaggtctaggcttgggcagagactaaggagccaaatctctggtcttccgtcagaaaatgtgattgtttataacccagcccctacttcttgcccctgtagatctccttttctactgggaactgtcttactagtgagatctgcatcacacaggtttggagagcagggaggttaggtgggtgacttccatgggggttctttcttgtcctgccatgtgtacacccacttccatttcctactgccacgagaaacacctcatttgatgttctatgcaacttgccagtgagtgcttttcaatttttttatgttgttaaaacaaaataactaaagggttatttatttccaggacacaaaattaagtcactgatttaatcagatatatgtgagctattatgtatactccgtgtctcttctccatttactatattactctctgaatgtttccaagaaactctttacatacagaagttccctcaaaacaaaaaagggactatgcacacattttacttttgaggtggcatttacttattcaataatatctacaaaattaaatgttatatcgaccttgcgtcactgtcagctagttactttttatttctgttgcatttccaagtgtgttaaattaaagcaagtggcttcatgccaactaaactgcatggaagctttttaggccttgttcaaatactaacaggtttgataaatatatttgtctagcaagagtaggacaatgagctctttgtttactgacatactttattgtcattctgctgtatacctctcgtgtggctgttttataggacataaagtctagctatcctgtcggaatctcagatcttatttatagcttgctgcaaagtggcttattgtcatttattatttcttatttgatttatatagcatctttccaccaaagagcccataggtttatttatatacagagtacacacacgcacacacacacacacacattcttacacacatccttgaacttcactcaatgctatgatgtagatagcagtatagaaccaaaaatctgtatgaggcctttccatttgtttttgttctacggctatgtcctggcagggcaattgccatattttttttcactttgagtgttttatcttttgcctctaggtggatcggatcattttctgtgtcttcttagaagttgacttcaaaatctacaaaaagaaaatgaatgagtttttctccgtaggtgagtaaagcaacttcttgttttctttcaaattgaggatggaagaagtggagccgtcacttctattcctattgtttttcatcttcaggactgttacacatggtgatcctgccaacttgtatcatagtttctaagaactgaacaaggtaacagaaaatctaggctgtggaactcttgccccaagaggtcactgtgttgtcttggggaagtcagttcatctcttggttctcggtgcctcacatcaaaactgaggggctaattattaataaaagatttctaaagatgcttcccctggccttaaattgcatgatgtgtgattccttctccaacttgtaagtttaccaggccccatgcctgcatctaccatgttaaataccattgttggaaattgtaagcccatttatattcatagtcagaattcaaacttttcctgcattccatccctattccttcccaagtttctcactccaaatttcaatgcctatagtagcacttctagtgcagtctgagaatggcagtcattcacacttctttttagaaaataggagaaacctcagggttattagagaaccttgagtaatgtatttacatcgattgaatgtgccgttagttggatttgggtaatttggatgtttttctccactctccctcttccagcctattaaggctgaggcttgtttaatgccttgttatttttatggtgccattaaagtcacagtgtccaaagtgctttccttagccatggcaagaatcgcttccaggaaatttcaagctactgtgagcattgttggtacttgcctttcagagagctttcttttgaggtttctgtctccgtctgaagtagtttgtcatatcacaggtgactctggcaggtgggatggagtgaatgaagggtgctgatgcatattcatcctcttaagcagtctatcagagccaaacaataaagaggatgccttgcctgtagatcagagtaggatgtgttctatccagaacagctgtagaaaaccaaaaaaccaatggagatggtcagctctctgctaatgccctaaatggactaagttcttctaagtaatttcaagttcttctccctaattttataattgaaagctggctctgctaagtgcatttaatttaaggcttcaactaaagtattcctctaactgaaacataatgtaaattcctcagattcccatgtgataaagaagaggactgtggttataatctttttctcctcttctttctctttctcctctgcctccttctccttctttcacctttcttcatttttttcaagcatctcagtgttttacagagtggaagcacataacagctatttaataattagttgttgagacgagttgaattaaataaatttttcttgccttaatctgatgacttttattgtttcaatgtccttgctccatttttccttttgacttgctttatgacaatattgagctgattggtacctgtattttgaagtattgttaaaagaaaatgctaattatatttttaaatgtgacttgccatgatgtgtgaagcaaatattctcatgtcttgtcagtatcacatcataattgataagattttataaactttagactccttgagatgtttggaaataatgacatcatattcattttcatgtattctaaaataaagtctgcaggaagccatactaacataaggtaaaaaataattgcataattatgatctaattgatattgaaacaaatatttctatcagcaggtatttccaatgatgcacagtcaaaaagcatactgcaaattttttttaaaatgagacagttttaggagggtaaaatatattaatacttatgcaaacaaattattgtttgaaaaattgctactttaaatacattttaaaatgcattgcagtacatgagcaagtgaaataataaaatcatcctcaatctcacatcaatgctttgaagcacacagtgctcatgaaattattttcagtccatatttacaataggaagtacattttaaactaaatgtcaaaatcctcaaaaattgtgatttctgcaatgttgaagcattaggtatttgaaaattctaaatatgcaatatgaaataagcgtgatgtatgatggaatgtgactactaatatacataatataccttacctgtcattaattttaacttgtgtttaattcataactataccatctttaaattaggatacgtttcttcctacttgccatgtatttccctatagtgcattattattcatgatatctctaactagtgttcataatctttcccaatgcaataatgataatagtttagaaaagaagtcatttttataatcaaacaaaatatttgtgttttggggtactttaatcccatgtctgtaaattttataattgggaatctgagacacaatgcatgataaaacaataaaagactcaaagagatcatactaaaggtatgccacatgcataactactacagttcaataataatggttcaatgataattgctattacagttcaataataatgattaataataatcataattaatatatttaataacataacaataatggttactaataattcaaacctttttgaattgctttctattagccagccacagcattcatttctttacatgggtaaatcactaatcttcatgataactctaagaaaggaggcaccgtattaaccctgtgctgtggttccattgttagggttttttctaatttggtcttaaggtttctctctcttgagaatggccatcagccaggatagtcactctccaggaaagctttgaaaagggttgggggaaaattgggttcagatatgtatgtcaggggagacacagcgaggaagtaaaaccaaaatgcacaaaacagaaggcatttattactcacaagtcccagacaggtgagggatgcccacaggagaccaacaggaagcctggaggtggcagggagcccagccagcaagtgggcagcaagagagagcaagcacctgggggctgtctttattagttctgtatgcaccaccccttaggctttcccatgggggttgtggattggctagtttaaagaaaacactcaggaagcaggaacttacttcgatgattctgacactattagatttttaccatgatcagcagttgtggagtatattgggtttggggtcagctggatgaggaacaagtggaacatatcacaactgatcacacagggagggaagtttaagtaggccaaaggtgacaggatacaactgggtttcaaacaacttatgtcaggcctaagaatggaggctggccaggcacagtggctcatgcctgtagaaggaggattgcttgaatccaggagtttcaggctagcctgggcaacatagcaagaacttggctctacaaaaaataaataaataaaaattagctgagagtggtggtgcatacatacctacagtcccagctactcaggaggctgaagtgggagaatcacttgagctcggggatttgaggctgcagttggctatgattgcaccactgaactccagcctgggtgacgaagcaagaccccatctctaaaaaatataaataaataaataaataaatattgtagagattttaaaaccaaaaggaaaaaaagaaaaaaaaatggatgccaaggcagcaactatatgaaacaaatttatgataccctatgttttaggcatgaaaaacgaggattcagctaggaagcaacagagctgtattttaaaattgagattggcatctgtcattgcccaagtgataataggttcgttttctcagagcatctttagagaaggctgagatcaacttccaggctgcatttggagtattggggaaagtcccatttcatctgctgcccatcatttttcagagatgccatgcttctcttcttctagtacctataaataccttcatggaaacttctaatatgagttgaattagtacttttatcattcatctcaaaattgaattccattcacattatagaggtattgtggtgctattacctgcagatgagcaggtaagtggtaaacgagaagcccaaaggcctttatagcatctacaggacaagatggaaaatggcttatattagtttgtcaggcctctaaaaacaaagtaccacagagcaggcggcttaaaccacagaaatacattttctgattattctggaggctagaagcccaaggccaagtggaggcaagattaatttcttcagaggcctcgctccttggcttgtagttggctgtcttctccctgtactttcaaatgaccttccctctgagtcatttgtgctgtatctttctctttgtataaggataccagtcaaatgggatttggacccactctaattaccttattttaatttaattagctcttaaagatcctatctccaaatacagtcatattctaagatatgagggttaggccttcaacataaaaattcacagggcacaattaagcccataaaattgccccttgtagaaatgctttaagaaactccagggaaagaaaccagcatcgaattttttttcaacagttttatatcttgctgtggggtaaagcacatttgactttttccttccacaagtattatttgaaagtagagtgtggcagctttatggaattatcatacactttggttgcaaataatttatagttacagtgcaccattacatggcctacagcaaataatatttgtatgattcaactcagaaatctctttgttctttacataaaagtgcttgtattttttcagtgtgtagaatttattgtgtgcagttttcactagacgtaaaaaattaaaaaaagaaaagaaaagacaattcccgatctggaatgtggaagtcattttttcttttttttctactagagtcttagtcctgctagagaactgaaggatattaattttccccgtaataacaataaagaacatacggtttataacggtattaaagaatcttgacgttggaagcttaagacttgtcatggtaaaccctccttcactcctccctttaggaaaaaccaacctttgtttactgcaatggttctcaactacgagcgattttgccctcctggggacattctgaggcatttttgtttttcacagctgagggatgggagaggttactgtgctctagtgattagaggccaggggtgctgctaagcattctacagtgcacagtacagcaccctccacaaccctccagcagataattattcagccttaaatggcaatagtgcagaggttgagaggctccatctgctggtactgtctcttaccactcaggccattgccgcagtctttgcctttggattggggttattttacagtgtttcgactgctgatgctttacccataagtaactatctagctggatttggaacatgtaccctcagcctggtctctggcttcctggattcatgaccctcctagtccagacttctggttttgcaccctctctgttcactctgtacccacagatttctatatcttgacctttgttaaccacatacacctgccacccaacccctactctccaggtcctcctgccaccaccccactcctggtatcatttatctattactgcccatgaatctagagtaataatctcagaaaatatgatcattacataggttttatatatctaataaaagtgtggaactaaaggctagtatacagagcaatgaagaacaaattcactaattattttctttatataccttaagcaagtttcattgcttcttgggctaatacttttctttttttttttttttcattagtttggtgaccattggttgataaacttaccttgtgagctcacaaaatatgttttaattttagataccttcaaccccttatcattatctgcatagtaactgattcattcacaatgaaatcacctatgactgaaaaaactaccaactactattttttaaatttgtttttcagagtcagggtcgtactctgtcatctagactggagcgcagtaacgcaatcatactgatcataactcactgcagcctcgaacttctggggctcaagggatcctcctgtttcaacttcctgggtggctgagactacaggcacactccaccatgcccagctaattttatttgtttgtttgttctttagaaacatggtctcaccatgttgcccaggtttgtcttgaactcctgggctcaagtaattctcctgcctcagtttcccaagtctttgggattataggtgtaaaccactatgcccagctctaatctctttaattttttaaccataaaaacaattaaatttgtcaattttgtttccagctttgaaatttatataacgtatacacaatacgcatgtcaactttacttaaatgtgattaacatatatatatatatatatatatatatatagagagagagagagagagagagagagagagcaatgctgggaaaactaataagataggaaaattaattgcaggatatccatgtgctcatcccaaacctgacacctgtttataagaggaagattttatttaagatgaaaaactctatttatgtctatgaaaataattttaaaactatatttaaaaaattaatagaaaaaaagctaaaatattcccaatgttcttgacataaatagtaaaataatgagctatttgacctattaatatttgggacatctatctggtacaacataaaatgataaaccttataaaattgcaagaagtttgtatgccttaaaaatgagcttgcaaaatagtagacataaaacatgtataacaagtgttttgtagttagaactaggtaaacttaatccataggagttataagtttataaattataaactttactggaaatgttttgtggtcttaaatacagattttctttttgtattatatataacataaaagcatatagatgataaagtaaaaccctaagtcaagtttgagaattatatctcgggaacttcttgaatatttaacatatctcaatgtctagctaaaatgcatacattttatttctcaaatattgacagacatgttattaattcactttacttgagtacgtgaacatatttaggttacatgtattttaccttcttagatacagatagcactgagaaagtgtagctttgcataatcatgataaagaaaattctaaattcatattttgataataatttttaatatcttaaatgcatgccaaaatttttaaaacgaaacaaatcaagaaacttctcaaccacgtttcacttattttgacctccttatagtcttccaaacatgtaataaatattattgatatgaatatatctttcgtttattttcccaatcatgaatttctgccatttatttctgtctaaactatacacactcctgcaaggcagctttagttgggttttatattattattattattattattattattatttgacctttttatcttgatctcatcaatgaaaaaataagtttctggagaacagaaattattcctaatattccattgccctttcagaatctggaaaattctaaatatatagtaggtgtttattaatgtaaataaaaacgtaccacgaacctagactgaaactgctacagttggaatgtgtatctcctccaaaactcatgttgaaatttaattgccgttgtaacagtattaagaggtaagacctttaagagtgataggccatgacggctctagcctcatgggagggattggtgtcattataaaagggtgagttcagcctcttgccctttgccttccactttgtgatgtcttccaccatgtgatgatgtagcaggaagaccctcaccagatgccagcactttgatattgggctcctctgtctccaaaactgtgagccaatacatttctgttcattacgtattacctagtctggggtagtctgtagcagcacaaaacagattaagacagagagaatatttaaccaaagtttcaggtaaaaagtcagtttttcctagaaactcttaagtattgttaacacagctagacaagggtatagcactgctttttacgtatttatcaaaattttcaaaaattggctggtcacagtggctcacgcctgcaatcccagcactttgggatgctgaggtgggtggatcacaaggtcaggagtttgagaccagcctggcaatatggtgaaaccccgtctctactaaaaatacaaaaattggccaggcgtggtgataggcgcctgtagtcccagctactcgggatgttgaggcaggagaattgcttgaacccgagaggtggaggttgcagtgagccgagatcacaccattgcactccagtctgggtgacagagcgagactccatctcaaaaaaaaaaaaaaaaaattataaaattaacatttaaagttctcaaaaattaaaaattacttctctgacaaatgggcacaaaactttaaaattttacccaggcagtatttaaattttttcctggatttcacttttaaaaatcttagctctttaaaagcaaacaaaagaaagtactcacattatgtcttctgcatcctccctttacactgattttataagtttatctcatccattatcattcattatctttctatcagttgtcaaatatttgttatgtgcctactatgttcccaaggctgctacattgaaggtactgttcttgtaatagtcctgaagggcacatatcatataaaacagttggaaaacaatattagcaaataatcaagtataacattgatacagtcatagcacccaggaattcagaggcaaatgtgtatgaggaccagattgattgggacagttttcatgaagaatgtggcactttcagtgatctttaaagaatgaacaagggtagagaagttcacgtctggtgttgggtaagcaacatagagggagaatggcagttcagattggaaaaattgtaaaataaagtatgatgcttatatccagtttgtgaagccctgactgagaaattttgacactcttgtcaatgtattatgcaattgagcctaagagtaagtccttggttgagaaataggatagattctatatttaagaaggattaactcaattcacgacttgagagactggcctttcaacaacacccatgccatggattcatcatctgcttttattgagatagtagtgaacaaaggctaaagaaaagtcagtaaattgaccaaagtcacatagttgggtatgtctgagctcaaatcctttccactccgtaatgcttcttcccttagcaatcctgaaaacatggacagttgtttgaagctacttgtctgctaaaaaagccacatattatccatttgcattagtagggctagagctcctgaaaagctagagctcctccaatcatatggtatatccacatgtcctctttccttcttcttcttatctcctctctggtcatcagttttccaagaataataatgaagcacacagtgtcatgagctgctaaggttttctttcctcttgctatgtccgaataatgattggaagatagaagcttgaagaaggggtggtgaattcctgagaaaggtagcaattgtctaataatgaggtcaacagagacaaaagcatctatggtaaaggggaagaaatgctaggcttgttattataagaaatggtctcatcttgtcacagccaccttaacactgtgtggctttgcgcatgttgtttaacctttttctgcttcagttttgtcatgtgcaaacatactaatggaccaattccaaatataaggaatagtaatataaatgaaagttcactagatatgtacaccaagcatcataaatgtttaaatatccatgtttatttcttattacaattttaaaagtaagtagttcaacttttgtaatcatctttgaaaaatatataaaacttcttatcacagaagtaagataggtttatagtgaaaaacagataagcaaaaagaaaaaaatacaaactattttctgtcctataatctggagatgaattacattttgttgcttatccttctgatctttagaaatggaaaatgcaaacagccagaaattagtcttataacttgctatatgtcatttaacataaatcatgaacatttttcacatcattatgaattcttccataacttaattttaatagacccaaagtttactcaaaaccatactattgaacttaggaattatttctgtaaattatttctctatttgcttataaataataatttttaaaaatcatctttgtagttaaatattggcatcatcctcattttaaaaaatacttttctaaaagtggaatcactttttcaaaatatatgcaaaaccaagacacttttgctagtaattgtcaaattgtgcactgtgtttgcagcactgcagttgaatgtcatgtactatacaacttacagggattaccatccacagggacagaaatataaatgcccgagcctagcagtaagcaacctgagtttacattcccatgagtggtacatgagagtttatttttttcctacctttctcagtgggttacatcctactgttttgatgttagcacttttatacatgaaaaaaaggtaattaatgggtaacaacattcatttattttattactaatgtggtttaacatttttccagttatttatctaaatttcttacacaaaattgctgatcataacccttgtacatttttatttcatctttttcttattgatttataagaactctttgtatattaaggttattaatctttcaaatatatgttgcaagtggtttcccagtttgtcatttgcctttgtgatattcttttataaccaaaacagtgagaaaaggtagaaagataagattttaaaatatataaaaaagaaagaaggaaggaaggaaggaaggagaaaagggaagatgaaaggacgaaaagtccgaaggtttaaaaatagaaagaaaagaagaaaccctttttaatgaaagagtgaggttaaaccaaaaactcaaaaatgaccttgattttaagcctatggacttcgcctcacagaaaaccattttatttctaattagattgtttctagttctcctcttcagacattttattattattattttttatttgttattatactttaagttctagggtacagtgcacaatgtgcaggtttgttacataggtatacatgtgccatgttggtttgctgtacccgtcaacttgtcatttaccttaggtatttctcctaacgctatccctcccccagcccccccaccccccaacaggccccagtgtgtgatgttcccctccctgtgtccatgtattctcattgttcaactcccatttatgagtgagaacatgcagcatttggttttctgtccttgtgatgttttgctgagaatgatggttttcagcttcatccatgtccctgcaaaggacatgaactcatcctttttttggctgcatagtattccatggtgtatatgtgccatattttctttatccagtctattattgatggacatttgggttggttccaagtctttgctatggtgaatagtgctgcaataaacatacgtgtgcatgtgtcttcatagtagcatgatttataatcctttgggtatatacccagtagtggggtggctgggtcaaatggtatttctagttctagatccttgaggaatcgccacactgccttccacaatggttgaactaatttacactcccaccaacagtgtaaaagcgttcctatttctccacatcctctccagcgtctgttgtttcctgactttttaatgatcaccattctaactggcatgagatggtatctcattgtggtttcaatttgcatttctctgatgaccagcaatgatgagcatttttaaatatgtttcagacgctttgtatacaaagcaatctgcttcctgatttaccaaatgtggtaggcggaaaaatgtcccccacaaagatgtctacaatctaaaccccagaccctgtgaatatgttaggtggcattgcaaagggggaaataagattggtggtggagttagggttgcagttagctgaccacaagataggaatgttatttgggattgattctagaggtggggtcaatgtcatcaagagagttcttaaaattgaaagaggaaagcagaagagggaaggcagaaggagctgtgactgtggaagaatgttcagagaactgcaccattgctggctttgaagatggaggaagagggccttgagctaaggaacatgggcatctctagaagctggaaaagcgaggaaacagattctttcctggagcctccagaaaggaaagcagcctagctgatatgttgattttagtctagttcaacccatttgggacttccaatgtacagaattgtaagataataagtttgtgttgttagtagaaatatgttacaacagtaatagaaaactaatacgccagtcatctatgaataagtgaaagaaacacaagagaaacttcttactcagtctgaattgtacattttccccccaaatgatacattcaatgtagagaaaaactagagtaaaagaattcagtattttctttaattatgaatgtttacaagtacatggcacatttatgtacttttaatgtgcagatcacattgatgtttagaattctgcaagacaagctctctataatgtaacataaatgagttaactgccttcttaggaaataggtgctaaccatttccacttgatgggcctcaaaagctgcaaacacattttgccttcaatgaaaatccagtgaagtgttgctgtaaccaagcaacctgaatgcaggaacaagcagccggcatagacagaaagcaatctgtcccttccaacggaggggagtgtgcagtgagtgtagcaaatgctgataaccagcagaactcatgaagacctgggaacatgagccttggctaagcagagtttgatctcattaggaagttctggtaaaacagacacaactaaatgctagttggagaagggagggaggatgttgtagtcatctttatagagaccgctgcagggtgcttttgaaaggcctttcaaacattctgggtagactggttttggttctttagttgaaaacattgaggcaaatgcaggggaaaaaaaagtctttttaggaataatatatcaataaaataattcttaagaaggcacagaagtaagagtaaagacaaaaataaacaatagggaaactaaaatttctgcaaactatattccactttatgtatgaacctgacttttattgtcagctacatgtcttttatatatatatatatatatatgtgtgtattttttttattacactgtaagttctagggtacatgtgcacaaagtgcaggtttgttacatatgtatacatgtgccatgtcggtgtgctgcacccattaactcgtcatttacattaagtatatctcctaatgctatccttccccctgcctcccacccaatagcaggccccagtgtgtgatgttcccttcctgtgtccaagtgttctcattgttcaattcccacctatgagtgagaatatgcagtgtttgtttttttgtccttgcgatagtttgctgagaatgatggtttccagcttcatccatgtccctacaaaggacataaactcatccttttttatggctgcatagtattccatggtgtatatgtaccacattttcttaatccagtctatcattgttggacatttgggttggttccaagtctttgctattgtgagtagtgccgcaataaacatatgtgtgcgtgtgtctttatagcagcatgatttatattcctttgggtatatacccagtaatgggatggctggatcaaatggtctttctagttctagatccctgaggagtcgccacactgtcttccacaatggttgaactagtttacagtcccaccaacagtgtaaaagcgttcctatttctccacgtcgtctccagcacctgttgtttcctgactttttaatgatcaccatactaactggggtgagatgatatctcattgtggttttgatttgcatttctctgatggccattgatgatgatcattttttcatgtgtctgttggtcagccacatgtctttgaagtgttgtctgtctccctcacttgctggtcactccataatccactgcaataacgtgactgtctctgccttcctactgcaaccatccttgttgaggttattagaacatttttgatggcttgagcatgggaactgaaaccattgcgtatttgatcacatgaccctttagagctcttctcactttggactgggcactctttatcctggcgactgctctgccatcttttctttctgaccgtcatctgtgtccatcccagccctctctggtgtacttgcttgcacacgtccatctccagctgggagtctctcaggcgtcttcaactgaacatatccaaaattaaattcaaaatctgtttctccactcctcaatcctcctcttcctaaatcccatatctctgtaactgatgctataatgtgcccagttgggcaagccagaagcagcagcatcaggcggtgccttttatttattgcttgatttataaagtaattagatttgagtgctcattttggccaaggatcagttgaaggaaaaaaaaaagttcccttttttttaaaagaacaacaaaatttctcctggctttatcaatcaccttcaaaaagtagatttagcaatttgttagatgcagtgagtccaggtattcaacttaatggcaggagtcctactcagggaggactctcccttatcggacattctttgcctgaagtttctgctttgtcaagtcctacaagaagtcatgaggataacgacctcttccctactacgtagaagccctaaacaaagctttatttttgctaataatatttcttttttctgcaaatccaaattgttcctagaagcttttggtaatgaaatattaaaaagatgaggagtgcacaagaagcctgtggtaagaaattaagctctaaggaagagaacttggaagcatgtgaaataaaaccacagcaggattatcgtaattgttctccttgacagacctgcccatatgtacggatgttcctgaaaatttgacaagggaattttatgatctatttcaggtgtctgtccatttttttcccttgggagtggagaggatgccgtaatagctcataagggtaacattccccttcataacaccctccttttctcatgccacccacagacctccttgaggctagtctccattcatgctcatgtctcctagccaatctaggaatcctggccatggaccatgataatcttgccactcagctgcatggtagctgagtgacttcaagcacataagaaagcatacagtatcttatgaaaagcataactgttcctcaaacccagcaaccatgtggcttgggcacctcttaccacattagtgttagtgagacatcacaagttagttcagttgaaatattggacatctactcttttgaaaggttcttcttcaacaggccaatattggtgctttggaccagtggctctcaaacttcagtgtgcatgagtgtcacctggagggtcctttccccagagctttggatgcaatagatcttgagtgggacctgagaatttgcatttctaacaagcgttcagatgatagtggtgctgctggtccagagagtacactttgataattaccttaaataaagttctacggggttttctttgcttgtttttgtttatttcacttccccaaaagactgtattaattatggtggctctaggtaatggagtaagacaaatctgaagtcattccaaaacccatagcatacttccttttccaaagaagtgtggactatttgctgttgggaaatgacaggtacctgctcagaagacaagtataataattaaaacaaaaatcattcacattaactctgtctccaataaaagaaggtgaaatcaatgttatagagctcaaagtaggttagacatttccttatgaaggggattctgaagtatataaagctagcttttacccaaaacttgttattcatgagaaactagttggttttcacatatattttgtgatcaaaataagaacttcggtcatattcatgtgtttgtgtagaatgcaacagggtaatctaacacaggagatacagtgaacaaaaacagcgtctattatgaaattaacatcaaagaggtcccgtaagattaaatggagctttagcctctgtatggtctgtgcctgggaaggaaaggggatttttctggaattggcatttctgaacacacagaacaatgccgtctgattgattgctctctatttagaaatagtatttctatcactttggtagaaaccttttatttcatttttgtcctctaacaaagaagtatgatgcttggagaactgtttaaaagggctgcaactctgtgcccatgcttcatcagtctcctaactactttcaaactttgagtggcatgactccctacttccatagactatcacctttttttaatatttttttgttcctagttttgttagaaaaattcttgctagcaatttgttgcacaaatatgactcaagcaagcacattacatagaataatgttgaactaaagtagatttcattaatatgtaatggcacattaggtgctttgtagagcaaaaggactctgtgcttgattttaatacaaataattgcaaaatattaaggcatgtgctttataattttcagtaaatttgtctcataaaaagttatctttcaaaagatggtatgtcactcctctgctcaaagttgtttaatcactctacaatttttcaaaaaaagtttgaatgcttcaaccttgtatattagtcaggtttttgcagagaaaatgaacatatattaaaatacatggaaagaggtttatcatagcaaatggcccatatgattatgaaggctgttaagtcccaagatctgcagttggcaagtgtgagacccaggagagctcatggcatagtttcagtctgagttcaaaggcctgagaaccaatggaaccaaccgtgtagttgtagtctgaatgctggcaggcttcagacccaagaagaattaatgtttcagtttgaatctgaaggcaggaaaaaaaccccaatggccaactagtagaaaggcaatgaggccggaggagttccctcttactctccaggggtcagcctttgtgttcttgttagaccttcaactgattggatgaggctcactcacatcagggagggcagtctgctccgtacccattcaaattttaatctcattcagaaacactcacagacacacccagaataatgtttgaccaaatgtttgagcactctggaccagtcaccttgacacataaaattaaccatcactcctggcatggaaggtctgtattatctagccagaacagatcgggttagttgcaatttctcagataactcttcctttggccattcatagctagttttatttccttaaaaacatcttgatgattcacgtccacatgtttttacagatgtttttccctctgcttgagtgtgattacccttgtctttgtttgagttccccaataagcagatcctgaaacaaggactgaagtagaagtatgttggggcggcgggggtgtggcagggagatgatcccaggaaacaccagtagggaagtggggaagtgagacaagcaagagcagtaggcagtgaggttaagctctaagccagttaccactggacaactggggctcaatcccagtaggagtgaggagactcagggagatagtacagaacatgctttgaattaggccacttgggaagcaagggatctggggtacttatatgcaaattgtccatcatttgagaaaggctcaaccctaaagggtgttaattctctagtattacttgaatgggattcagcaagcagagagagccctcaggcaaagagacccaggagctggtggctcaaaggcaggctggcatgcactgaattgtcaaggaacaaggagttataggcaggacatccacatctaggcatctactgtagcctttctttttccctacataactttaactcactctttaagactcagctgaagtcttgcctcttctggaatgccttcatagaccttctctctgactgagctggctcttgtatatttcccaatacaacttctgtttacctccatcagataatctgttaccttcttctctgttgttttgcttttctatatcgtccactttgtgacctccttgagggaaaagattgctaacctgtatcttcgtaatgggtacacaaggtagagctcaagaaatggttatttgactagcaaaaatagttataaaaatgacattataatgtaatcactcaatgggttattcttgcccactgcacagataaaactaattcagtgagacagcagtattgcagtagagaaagagtttaatgcagggctagccaagcagaggacagaagtttattactcaaatcagtctcccaaaaagcttggaggctacgagttttatggacaacaggcaggggtctagggatagggtgctgctgattggttggggatgaaatcacaggagtgtggaaaactgtcctcatgcactaagtcagcctctggatacgggccacaggaccagttgagtaatgaggcaaaggtcccagtggagtcagtcagttgccagaatgcaaaagtctgaaaaacatctcagaagtccaaccttaggttctagaatagtgaagttatctattagagcaattgtagaggttacatgtcttgggacctctagaacaatggctggttattgtttaaatgtgcctacgtcttagtagaatccaggcttctctcataatcatgaccttggggcctttcgttagttttacaaaggcagcttcagtcctcaaacaaggaagggatagttttgagaagggctattatcattcttgcttttaggttaaactataaactaaattccttccaaagttggcttgggctatacccagaaatgaacaagaacatcttgtgaggttagaagcaagatggagtctgctgtgtcaaatttctttcattgttatactttttctatgtcagatttctctcattgtcacaatttttgcaaaggtagtctcagtaatagcaataatcagtatttattgaatgctcattctgtgtaagcacttgacatataatcctaaccctaagaagttgataattttattatccctatttttcagatgaagaaactgacatataggttatatgttacttggaggccaaaagataacttcccctttgccctctgaaagttcactaaaagtaagctgacaaaaggcaggttaatagcagaaaaatcatacaaaattattttaacatgcataagcatgggagaatcgcatgagaatgattatccactagctaaattgggcacagaagcttatctcttcttcttcataggggagtggacagatggggaaagtagacaattttttgaggagcaataaataattattagggagaatgaatggacccaggagacagaaattaacttgtaaattattctctttggaatttgaatgagcccaagaggcaggcattatcttgtgaaaaacatctgtccaggtgtggttacattctcagctttcttttctgcaatagataatgagatttcaggcagaggatggaagacaattgtgttccttttttggggctactgtttctagatagataagggaactgcagagaaaatcttcaccctgtgctttgggagagacaagggattgagagacggtagtgaggggaaggtccctcatatttcagggtgaaatattctggtattcttcttacccaagatttgcatagttatatgtggtttgtcctggaagtaaaccgaaccagtctgagtccagactctggacagactcttaaccactgtatgactaaatcagtgcgtgaatgaagtgaatgaatgaataataaccccaagcctgatccttccacacatgggagtcattctggggatgacgttatcaggacagtctatgtagttcaaatatcagcttcagtgttatgttctacatacaagaagacttccaagtagcttaactagaagtatcaatccttcctctgacactttttaatagcattgactaccatatgttggaatgtatttgcatgtcttggtttctttactactgacaagattcttaaaaaaaaaaacaaacaaacaaaacaaaaaaaactgcttaagtttctatccatcttggtgttttctacagccccaaacataaagccttgtacacaataggctaaccaatgagtgtttgccaggtgaataacggaaatataagtgacaagcaaagggatctttgactcttcctttatttttccccagaaactgtagagactcttttttatctctctctctgagattccagagagtctgttgtcatacagattttagatggctctgtaaaataaaattatatttaaagatgttaagttcagggaagaatctatgaagtttactttgtaacattttggtaatcatttggttagaaaattatatttctaagaaattggtattcttccttccaaaactgcattcatagaatgaattttaaaaattatgtagaaaatcatcagtgtttctaaaatatttccatggtaaaaaaattacttctttaaaagttaaccatagttatcaagaattgcctttctaaaacctcaaatgaaaggcattttctctttcctctgactaataaatctctaatcatcattaataattaataatcaattcttagaagaggggcagactgagtaaatttggctgggatgactaaattacaaagcacatatataggagaaagttgtaaatcttcactgacttcccattatttacaaagtatcatatagctaatatgtataaaacacatagaaaataatataaatttaattcagtggacatttattgattctagtatataaaatgaatggcattaagtgccaaggaatatacaggaacagaagacctggtctccatctttacagaatttatgatctggagaccgatgtttgaaagagagataaaataacaagtagactgtgtgattttattataataacagctaatatttagcacttaacaatgtttcagtagctgtcctagtgctttacgtggcattatctcatttaaaccttaggaaagctctatgtagtaggcattattattatcccactatacagctgatgaacctgaagctcaggaagatcaaggtaacttctccaagatcacatgcccaggggatggatggatggaggagccaggatgcaaacctaagcccatgtgtatttaaagtccataccaagcaggcagcaaaaataaggtacatcaaagagcacatgattcattcaaacctggggaaatcagaagctatggcacctaagcttgcacttgaaggatgaaggtgaatagagagggagaagggcattgctagcaggaccaaggcaggtagacgaggctgagggagaccttgagagatcagagaagagttaagtgttgccatccatgtgggtggtagcatgcatgtaacagaggaggtgaaactgagaaaagtgtttggaaccaggtatcattggccttgagtgttatcgggaagagtctagacttttctcattaggcagagggcagtcactgaactgttgtgaaccagatcagagctgtattttaagactgatttggcagtcacgtgtaaaaggagtgagatacaggagagagaaaaagagaggagcagttaggaaactgctaaaatagctaaggcaaatggcactgggagtctgaatttgtactgcaataatgtgaggagagaggaccaaacatagaaacaggagaagatttggcgctagctgatattttagtccatttgggctgctgtaacaaaatatcatagactcagtggcttacaaacaaaagaaatttatttctgacagttctggaggctggaagtccaagatcaaggtgctggcagattcggtgtctggtgaggtccctcttcctgtagagagccatcttcttcctgtgtccatgcatggaggaaggggtgagaggtctctcttaggtctcttttataaagacactaatcccatccacagggctcctttcttatgatctaatcaacttccaaaggcctcaccttctaatcaccatcaccttggaggttaagattaagcatatgaattttggggggatacagatattcagaacatagcactggttgtggggagcataaggagagagacgacaatgtgtcagaagttcaaaagagcaagcgtgtcatctatagtgcagaggaatcacatgtccttgtccagttaaaagggattatactgggagatgatgggagctaaatgggagtggtgcaattggtgggacacttgaaagcacatgagtgaaggctgggatttccaaatgcagcaaagcagcactttccatggtgtggtgcggggatttgacatgtgtcggtctatgaccaaataatgatgtccatacttctcagatacttgaagtgagcatgcagacctttaacaaagttagaacatgtggcatttaaagtctgtgatttttaattttgagcaattgaaatgactgaagtgaccatatataatttctataagtaaaacaaacgattgcatatacagttataaatataacaatttttaaaaggaaatgtaaactctaggctttaaattgtgcattaatgtgtatactttcttcttaacttagcatgataataataagacaacagaaatgcatgttttaacagtctgttttctactgatctgttatccctttctttgattttttttaataatccatctggaacattcttgtgtttcccactttcatataagtatttctttatgttttcctattttttaacagacgataataatgaagaagaagaggatgttgaaatgaaagaagattcaggtattaaattcatacttttattattagggggtaggtaggggtcattttgttgtttatgtacacttcatattttttcaacgaaagacaaaataagattaataaaatagaaatatatgctcagtgttataaaattaaaaagtagttgttctaacacttaaggctattgcagttgctgtatttaaggaataaatttgaccttgagtttcctgacagcgaaggtaaaaatggaacatgatgttgtggttaatacagttatataacgaatcacccccaaaacttagagtaagctgaaaacaaccacttcttacgctcatgagcatagcagagataacttaatcatcctgttcacaaggtttggagctcagcaggaagattcaacagctggaagctgggaccatctgaagattcactcacttgtctgtctagtgattgatctcaactgtcagctaaaatcttagctgggacaacttcctaaaacacttgttcatggccacctttatgtggcctgggcttcctcaaagcatggcggccagcttccaaaatgagcttctcctggaaaaagggagacactgtattctcaggcttagacattccattgcatcactccatgtaattcattctttggaatagtcacaagcctgccaaaattcaagaggaaatgaaaatgaactcaatctgttttggggagtggttctatagagcgtgtaagacctaaaatattgctgtggccatctttggaaaatacactttccacatactatattttgctctcattatcagaattgagatgcatgccaactcctcaacaaagcccacttgttatgaggaaaatctagtagttaaatgcacaggttatggcctaaggtagccattcagtgtgtctttgataataaaggcataaatcagtagacctgaattcacttgtagctctatcaattattgaccttaggcaaatgtcattttctataagctgagtttacaattctgggggcaataattcttaccatatagttttctttggaggattaaatcagataacatacctaaagtttcatacagtgcttggaccatagtaaagattcagtaaattattgcttttttctttctcattctaacagatattagaaggatatagagcttaagtctatgattaaaagctccttcttcctcattttggcagtcacagtgttctgaccatgaaagaggtatctcagaggccctgattttgtgttgcttctcatttgatgccagaattccctacaaatcactgacaggctcagtctgggcagctccatcagcagggagctctttaaattctgatgcatttgatctcaatacataaggtttgatcggtgtggtccttctctatgttaagttatatctctctccctccccggactgcccactatcttcaaggggaaataacaccagtttattttcttcataaaagttcattggaacaaggattatagcttctatctactcttctccagtccaaacatgtctgattcctaaggtttccttggacttccaaatgcaatggattcagagggcatgagaagcagaagcagaatctaaaagtcaggagcaggaataaaggaggtagaagaggaactgtagcagtggctgttggtgccctacttatgtctccttggtgcttgctgttattttatagcaccaacagctttccaaagaaagtccttatgactctctgctgagcgctttacttgtcctggcagcaaactcaaagcaccagagaattaatttctctggagcagacctcaaccaataacagacaggaattggttggttaatacccacatctgactcatgttctattctaatgctgtctagtagaaacataatgtgagcctcaaatgtgagcctaatgtataattttagattttctagtagccacattgaacaaagtgaaaggaagaacgtaagactaactttaacaatattttgtataacacaataatccaaaacattatcatttcaatgtataatcaatataaaaatagtcggatattttacattcttcttttttcatactaagactttgaaattggtgtgtgttttacatacacgttccagttcaaactagccacatttcaactacttgttggccatacgtggctagtggctacagtattggacaacactgtttggaggtccccgatagaactgagtcttggttgcccacagtggaatgtgctcatgaacacacccagtattggctgctttccttttcctgtctttcttccctactcctcttgtgatacttactaaaatcatctctcaaattaactgcttaaaactcaaacccttctatgtttacttctgagagaataagacctaagacaaggactttgcttgccttttataaaacatagagctcaaggtaaaatttaaattaaaatttccattcctatacccatgtagaatgtcttattgttaaaaagaaccatatgtttaaaaaagacttgaaattgtcactctgtcttgaattaactttcatgaagttaatcttaatgcttgccattctcatttatcctgctcacatgaaatgtccttggagtatcttttagctatgaggggtactgccctttcaagcacccggtataagggccttatctcgccatggatcatttgcctaagtgctgtaagtacacatttctaagcaaagagagttggcttctcaatgagatttagatagctatccaaaccactgaatgattttaaggaaatcattattaatgctaatgcagagtccccaagtttggagtcagcatttgaggttcagcggcattaattggatcaccatttctgattttagttccaccaggtttcctgggagttttgtcaccagcagctgcatgcagctgttcaagtcatattcaatggcccaaggatgctaagccacttgggcagaatgggcttgggagctactcccaatttcctatacctgagtgctgaaatcatggaggatttttgtgctgaatggttccagctggcctcaccagacattggtgtgcatgctggcttcattcagatctcacacttaagcatgtcagtctcgaagatgagtctaaaccagcctcccaaggcctttaactgctgcctttcccccgccctgcatcaattcttctcattcaaatagaaaagctggagggatttttacaaatgcaaccgacactaatgaagggctacttgagtgaatcaactggccaagacatgctagtgaatgatagtaaataacaacttgaatacctaaacccactggggtgcttgtaaattaactctctgggtaagaagagccccagtgtgaagagtttgcagatttctatggtataaacacaaataccatggtctttttcaagcttccaaagcatgaggtcaatgaataggagagctagggagagatggtacaattagctcgtgtgagctggctcaagtcagccgcagcacagctctgctgagccagactttaattgggcatgtactttgtgccaataacgtgacatgcatgaactcatttaataaacacagcaattctacaaggcaggaactgttattattgaggcttaaaagggattagttccttgcttaaatagcagagccagaatttgaacctgagtttgcctgaccccaaaattcatgtcctttacttttttgctcctgtctccagacttttatagtaagtagaggcaggagcatttcagatggtatcagacatggtcatctgcaaggggaggctctactcccatgggaggtagaagaagcagactggcctaaatgcctagaattccttgtaagtcctttaatcatcttccttaatccttaattccttaatggcaaatgttttcccatgtcctttcatttccatgactatgcactgttgaaattagccccagtctgagccagcagggacagaaaattatcaaccacctatggaaactcaaccacatcacagctggatgcacagttgagtccctcaggggacaaagccatgctcctggcaaatctccaggtttccaccctctgccagacacagggcaagctagaaaacatgatacattgtcaaggagaagcatgggggtgcttttgaagagaagcagaagcaactctcttcttcactccctcaggccaagagggaaagttgttcctcccaagccacaagtagaaacttgggcacagaggccatatgtatctgtgactttcatttgcatgccccaaaacacttcacctgtggtatcatgaaatgatacaatactgtttcacagaacatgtttcatgttcatattcaacatgtaagcatgcccactgacccaaggagtgctctacaactttttcaaaaataaaatattagtactttagggggtgcttagatatttcaaaatgtggcacatggaagtctttttaaatagtacccactccccaggaattcccattctggtggaaaatgaagacctagaaatgtaactcacaaaaatgcaaaaagtgatttggagaaatgctggtttggagttgaattttcagcattggaaactctcttcttgatcccagttgcagacgacacattgcagtgacatagaagggttagatttttctcccagtgaggttgcaaatgtccctttgcccattgtatgaatccctttgagcccagtatttgcactcggtgagctgctccaagcatctcatttctgtttttgctgaacccattccaagggtcaacatccatcttgcacctggtgacagaagtttgggggagttgctaatgtagtcattggcaaaatttttcaccctggctgtggtaataaccttagatgtgactgacttgcaaccacagaaaacctagcctagtgcccaaagctttgcagtttataatgccaaagtttttaatagcacatctatcaaatgtggggtttttttttgttctgttccttttttaataaatgggaaatgagaaatgagtcgccatagctctgtaatgtaattttagaatcctggcacgaaggcgacagctgctaagagagaattaggcagggtccccattatatcttggccttaaagaaagggctggggaagtgaaaataaaatagaatttgaaatgaaattctcaaggcactgctaggcaccagggatacaagagggattaggaaagacaagtgcccttttctcatggaatttatgttcttggggatgaggtgaggaaggagacatacaataaagggatacaccagagagtgagataatttcacatacaagtgatgtgtttgagagagatttcctttctggtgagcctttagattaggcagtcagggaagatcttctagggagttgaatttgatctgagattcaaagggtgagaagggagcagacatatgaatatgtgtgttggaggagtgggggtgagaacagcaggtgcaaaggttctgaggcaggaaccagcctagcagtgattgaggaacacaaagggaaaggaaactgacaaagctagagccaaacacaagagggaggtgaggctagtgtggtaagcggggccccaatgacatgctgtgctaggcctggaattggatttggatcttattctaagcaatggtttttaaacaggtgagcaatgtgatctggtttatgtttcaaaagctcacactggctgctgtgttgaggatagagtgtagagagtaaagagtagaagcagggagattagaaggctagagggttatgagatgctggtctgggctactgtggtgattccaaaggttgaacacagtagatgaatatgaaatctattttagaatggagctgatagggcttatgatagaacttacgattgcttcaactggaaaagtaaatgaagaaaaatattgagaatgacatctcagtttggagtttaaatttctgggtagatagtaataccattccttgagatgtgcaatactgtggaaagaacatgcttataaacatcaagtatatgattctgtctgatttcaaatttgaaatgcctgatgaggtcctttacaaaaaaattgaaagggcctgatgggagttgagtgcaggaaaggaaattattagtgctgtgaagtgtggggcatagttaagtaccagccctgaagggacaatgggaaggaggtggctacgggagccaagaaacttagagggccacatggagaaggccaactctaagatctgtaaccttcgattgagggatacaaccagctcatgaaaaccaccaggtgcctagaaagtaaatgccctgagctccccactggctacatgaaccagggagttcattcatgcaatccagaaaattcagcctcccagagcacagcaggggtggtgaaggtggagagtggatctagaggggcaaacagatatccattcctaaatcccagacaagatgccacgtaggctgttgaagatgtaagtcatgagctcaataggaagaccagggctaaatacataaattaacacctaatgaagtgttctatatccaaatgaaataaactcggagatgctttcctgacactgtcctcagactttaatttatttgcccccaaggatagacttagagggacattgaggaaaataggaagcacagtaatttaactgggacatacagaagttgtttagaatctggattactaaaaacagtttgttaaatagaagcagggtaatttctagccccattcctttctccattcctctagccctgcgttcaggactgagtaagatgaaattgcacaatgacaattgtcaattaatctatgaagattgaaatcgaacactcttggaggaaaaaatattaacagggttcccttatggagaatttctaaatttataaaagcacatgtgtaagattttacatttgtgtgaatcactaatgttatctacaaaaatgttttagcttaagccttaagtttaagtctatgtaggttggagaaccacaagtccttgccagaatttcgctcagccatgatgacagatgaaactgcaattaagattcagcgtgtgtgtaggtttactaagaagaaaacatttttaaatttcacataattttgaaccctactggtaaatatttaaatgagaatattaaatcttcgtgattccagaggggttagagccaaaaggcctctctccaccctacaaaaagagcaaagcaaagaagccagaatgttcgaaagactctagcgagggtaagtcctgtccctccttcctttagaaaattatgccatgaaaagaaacatatttaatttttaaattatgtgtacaaacacactcatgttcagatattcctaagggttaaaatatcacagagaaattcttttatccctttctaatatgtttgaagatgaagaatcagactcaagtttattttgttaaggtaaaacccaaattttaaaagtccattttgtcagtatgttgtattttccatgtctgcaaagcaaaaaattgtaggtagtgcttaccagttacatgttccaaaattgtgcaaaagtgaaggtcaagatttgcatgtgatgaccagctttgcagctattgtcttactggggaaattgtttttctgataaatacattctgagtctttccagattcggacctcaacaacagatgctggaaatggttcctgtctttagcattgtctttcattttctaagatcctacatacctttgcatttttgcattgaatgggcaggtcccactggactcagttttatgaataaatgacacggtctctcttttacacactagtacaacatacaattcattcaaattttcttttgaaatgttgatgagatgttcttttcatgtgaacctcaaacctaagagtagtacaaacttttacacttgatcttagcccaaagacccagaagcgatagagcagtacaaaattttaaagggagcatatttacgctttgtctttcttgcctggatccccacctcctccactgggaaatgaagagtgtaataatactgatggtgtcaggttgggtcttgagggaagaagatgccaagatggaagcagaagtgcaggataaaggtgagagaaatgggcaatggagcaggagcagctgaaaggagagaagaaaagaaggaggctcagctaggaagtgcctcagtctgcagtgcagtctggaagtctggaggagtcctgcactgggcaggaatagctgggctctagggtctcgctttcccatgctcagtcactggctgcaagtagtttggcaagaaagtggccggcctcagcaggaacatgatgccacaggggttctcaacagtgtggttgctgggtgctgtcagcttacttctctcctagcagcaggtctcacttgaaaagaactcttgagctgctcacatgcaggactgcacagtatccctgttgagtgccggggcttccggtgctaagtaatgacgctgctttttcaccttcctgggagttcagaaccaatcgagaagccaaagctgaaagaaaggtggaaatcaaagcattagcttgaatactaacatgatgaggccagagcatctggctgccctgctcctagacaggcttcctaaccctgaatttcagctctaaataggaaagctttaatcactgtcccctcacaggcgagtgcaggtgtcctcagcttcctagaccaagactgccctgatcagcttgttataggatgagcagaccaggaacacgccttctctgtaggcaggtgggtctgagagagacacaagatggaactgtttccttctcccaggcttactgtaagaaaggagaggtgcagaaaggcacagaaacagatgtgacccctcctctacacaaggagcaaaggaggaatatttcctactgacaatgaagagtagaaatagcatgtgtactggcctagcactggcctggccttctgtcagtgatggctgttgttatcaatatgatgatcatggccatcgtagattatgcactgccctaattcagtgaaatgtgcttgaaagtttaaaatcgttcagaggagaacacttagaaccaggaaaaaggccagctgcaataattcacccaagatgttaagctttgttactgcctggttgggagagtagctggggcttccaaatctcctgttgtagttcggtcattttctagaccatctcttaaggccacacttgggtaatgagctggggcaaagcaatactcacctttcccctagagaaactctacctcaccaaatgattcccatcacatccataacctatgtcaaaagttgttttccagaacctgagcctgttgtcatttctgagcctcatataacagctattaagctgtagcagttcttccgcctttaattaaagaagggaattcttccaagttactccttccaatgtgtgaaaacttcatttacttcctaaatcagttgctttgtttaggaacatcattcccgaatcctaatatgactcaataatacagcttcacctcctgtaattatgtggtctaacaatctgctctgaatcataaagatgaaaatgtggtaactggatttgctagcagggacattctgtctgtggtgaaatgtgaatgtgaggcactctccagaaacataggaattgttcatttgttcctaagagggcttcaaagacaaataaaaagtaaagatagctgggcaaggagtgagaaagggagcgccatccggcaggcagcggtggatgattccatgatatgctgttgtgctgaaaccctcccaactttagaggggatgacaccaggttcgagaggctgaagaagagccccagaatcactgaaagagacatggggttttcctgggggctttcatacaggagagagggcctggtggcggcagcctgggcaggaggaccacagccgcttataaaaaacatgcaatggcaacctttacttaccccaagacaaagggcctccatcccttgtacagcctgagttccacaggatgggccgggggctcagatgttccctgtagataaggaatcaatctccgggttgccactcctggattctagttgagaactttgaaccgcattgaggtgcatccaccacatggttcattctcaggatatggttaagtgattgctatcagctgggtttaccacacatacggcacttattacttatcagagtttctattttgacaaaataacctatgtctctgaattcatgcattgtactcttgcatgtgttccatttcctgttatgatacaaagagttacaatcattctttcctagtggatatgcaaatgaaatctggtatcactggaagagggacaaattttaatgctgatcattactctcctctctagatcttcttcccagcttagagttatcaatgtttttttagcttggtcatttcatatttttttagaaagagaagctcctggtatttttatttatagatctctcagcttaatgccccaacacttggccccatctctcttttctccttctttagggttccctggcccacttcccaccctcacaggtactactgatttccaccttttaactgataatgcacattttcagaaagggttgtagaaaacaaactcacctagattttccagcatatatagtcataataactgtatttagattcagaagaaaaatttcaagaacatatggtcaaattttctcattctacagaatttttttaaagtacagactgcaaatgcttctttaacttgcccaagtccacgcagtttgttaatgtcacaatcttttttttttttttctagaaaaaacacagcttctgtaatcttttctctttctctttcctggaaattagaacaaattttttgaaggaagaaatattgtcaacattataaccttgagtgaagcattattactttagtaaatatctcgctaagatactgaacatcaaaattaaaaatcaaacaacttctaaatgtatttatttgcatttttatgctgtgtacttttgaatatagtgattttattatttttagtaaaatttcatgaactgctgtgtactttggtttcacacactcaacaccataccaataatgaaattattagtaatttcaagttactaattgattggctgtcatgtgctataaatgataatgccatctgtgaaccagcaaggcatagacagaattgtttggaaaaaagcctgattagtaccagttgcattaattctaactccccataatttagacctttttttttcttacaaaaagttgaaagaatattattgtagaaaacttagcacctttaataaagcatacttttctcacacttcttcctttgtctttcagaagtaaattatctacaggttcctttagtgaaagtctctcaggccttatttgtctgaaaatggtattattttgcattattttcttaaagcagtattggtgggtaaaaatttgagattgatggttattttcttgcaacattttgaagttttcctgtagttgttaaggaatatttccgtttgttttttgcttcttttaagcttatctgtttttcctttctgtctgttttgacaatctactcattaccttttgtgttccatagtatcactatgatgtgcctaggtatagattcatttttatatatccttcttagaatttgctgtacttcttggatctcggaatgggcatctttcattagttctgaaaaattctcacgtatcactgcaccaaatataacttctaatctattactttctattctttctttctctgttcttcatgacttttaacccatatcgcattttgtcctctgtatctcttctctctctgatgccttccggttaatttttttcaagtctgtcatttaacttgctaattttctattcaactttatttaatctgatgtttaactcttcactgtatttctaatatagttttcttttttgataggttttatttggttccttttcaaatatacatggccattttttatttaattaacacataaaatacctttaataatctgcatcataaatttaatatctctagtctgtacaagtctgattctgcagtttattgattctgcaaacttctgcacttggttatttcctcgtgtattttgcctttttgatgatcatgttccttggatttttacttatggaagcttttttgatgttgctttaagagctcatttatttacacttggttttctaagatacctgaagatattaccttagcaataccttaaagtacatatttggcttagagttttgtttttattttgttggctaatggtccttaaacccatgttagtccatgtataagatgaggaaatctcaacagagacctttttttcccttttttctcacgaccaatgctaaaactgacataggcaaatctcccactatatttatgaccctagcatgggcccctccatgcctcacacgtgtggctcattcaaatccaagctctagctagtggttctcaaagagtgttcttgaatctgcatccatcagcttcacctggaagctcatgcctataatcccagcactttgggagcccgaggcgggtggatcacttgaggtcaggagttccagaccaacctggccaacatggtgaaacccccgtctctactaaaaatacaaaaattagctgggagtggtgacatgtgcctgtaatcccagttactaaggaggctgaggcatcagaattgcttgaacctgggaggcggaggttgcagtgagctgaaatcaagccactgcactccagcctgggccacagagcaagactcagtctaaaaaaaaaaaaaaaaaaaaacaaattctaggttcacgtcccagaccttctgaatcagaaacctgaagtggggtcctgtaatctgtgttctcaaaagctcttcatctgaagatgcacgctcaaacttgagaactgttgttcttgagtctaggttacctggggttggcagatgcctcaaagcaaatactgatttcagtgcctgcttagaactcttgatcctggcactttatcatttcggtttcaagaatttcccttacaaaagcaccagctcagccatgtattcaagaagtagatagatagatgcatacatatatatgtaaatatatatagatagcacatacctactatatatatatatgcacacacacatatagtatgtatatgtgtataccttatatgtatatatgtatacacatacctatatgtgtgtgtgcatatatatatgtgtgtaggtatgtgctatctattgtatgtatgtatatatatgtacacatgtatgtatatacatgcatatatgtgtgtgcacatatatatctgtaggtgtgtgctatctatatgtatgtatatatgtatgtatgcacatacaaatatatgggtgtatatatatctgtaggtatgtgctatgtatatgtatgtatgcatctatttacttatctaatcacacagacatatatgtatatatgtatatgtgtgtatatgtacacacgtgtatatatgtatctttacatacatacagatatatacacatatgtgtgtacatatatacatatatacatatacatgtatatctatacacatacatacatttctaatacatagcctggaaagatacatatcaagttgacctcagaaattatcttggaggagtgaagaaggagcacagttgggttttggagagtttaatattgcactttctaaatttatgtgtaattgaatatgcatacacacatataatgagttattttataaaacaaacacatattttcattaaacaagaactaaatggactatatgttgctaagttcagtagcatgtttcaaacagtaattttctacatacctgagtctccaaagccttcagtggcttttggtaacaaatggcactttccatcatatttttacagaaagcactagcactttgactcttgctccacaattgcctttacatagaatattcagtaggcatacgtgggatgctcattcatcaggaaactgaacccttgcaattctaaatcaagcaaacctatattgcactttaaaatattaatgatgtcttttgtcagatgaaattatatgtggaaacattttggaaactagaaagcactatgccagtttgagggatctaatgataatattaaagttattattattattattttactaaaataaatttttctgaatacatgaaccatttatggaacgtagcttgtatttcccgagaggcagaattttctctctgccccattattttctatgcatattaaagtatcgtgtgacatgctgttttgtgagtggctggacagaagggacattctatctttcagaatgccatgcagcagttcatgcattatattcataagcacgatttttaatttaatttttttgacaagtgcagtgaagggtaaaatcaggcagtcataatttttactttgccatcactcaaatgagcttagtgattgaccagcttttaacaaaataaggatccaggaaaagcagctttcccctgaagaaaagctttgttttatcctctagactttaaaatatcaagaatttaagcaaaatgtgtaaatttccatggtgaaaaatcagaatacaataaatgcctataccaccattttgctttaatcatatttttcttatattctgcttgattccaggccattctgaactatccaccaccacaaagtagtagaaggacccagtggtctattttcatttgtactggtgctccccatgcttacccattaaacagaccacagagtcctgtttcagagtcagctctaggactttaaatgggacttagagaatgtgagtattaaggcattttccattgtgagaagggctgaatctaccaaggcagagaaaccacaggttctgtttgactgggaacgatcccaatttatgcatgttgccattggcatttgttagcaatgttccctttcactcttggaggtaacccaagtttggtgataacatatatggaccctcatacccatagagaaacagttcagtatgagtatggacagaactctcaattgtccatgttctgcttcctacttgggcagtttttctaacctaagactcagtttcttcatacattaaatggacagaagggaaactgatcttgcaggactgcagggcaatttaaataagatgatttatggaaaacaccgggcacattgagtagacagaagagctggtcagtgagtatattgaatttgaaacaagaagagctccctcccaccaaagactcccctaccttgcttattaatgcttgaaattccttttaatgtgaacaaaatacttttgcaagcagagatacatttttaaatgcattgcttgcatcgcacatctagctgggtttgtctctctcctttttcccttaggttcactcagcacactctgcatgcctccccaccccagcccccagttgcactaattccagtcccaaagggactttcttccagtctgtcttcatcttcctgatctctattccccttatcttcaagtccagattcccaagaaactacagaaggtccaccatttacaatggtttgatttaggattttttgacttgatggtgtgaaagcaataggcattcagtagaaatctttggttttgaattttgatgttctcctggactctcgatgtgatagtctttcatgatgctgtgcagtgagccacagcccccagtcagccgcaccatcacgacggtaaacaactgataccgcactctagagtggcctgtgttgtcagcagtttttggatattgttttgtgttttcacatttcatcatgtctacaaaatgcccatctgtgcaagttaggtgtattaaatgcatttttgcttacagtattttcaacctacaatgggtttatcaggacatagccccatcttaagtcaaggagcatcagcagcctatctccaatatttacacaaccacacatctcaaccatttctcaatctctacttaactgtctctaaaactttaaggagggtaccagattaggtcaggggcatgaggaaagaggtggtctctagttatcggccctcagttcagagcttgccactgagacagtcattgtttggtcctcatggtcccttgagatctgttgactctcagctatttctgtaagattctgggaccaagaatctctcttctgaggctgggctattcttactgcctgtagtcttctttccctgataagtgtttctcaaaatatggccaatggaaccctgggggaggtcccccaaagcccttccagcgatccacaaggtcaaaattagttttgcatggagctgtgctcccagaagtctccactcacatggaattcagtgtgcatgaggtcctctatagttgtgcaaaatgatgctactgcagaaacatccactgcatcctccaaccacatcagcatagctgcccaccatccagtttctccaagcactcattccacatacttttgttaatgcctaccatttgacggtgtaggtattgttctaagccctgaacacaatataatatataatatatgtattaatatattataagcccctgctttcttggggcttatattctatatataaaatagaggcctctactctcttggggcttttattctagggtatgtggcattggggattggcagataaaaaatggatacaatgtttaataaattatttatctattgctgcctgaaaatttatcctaaagcttcaaccaacgataagcaattattatctcggagtttctgtcagtcaggaattggacagtagcatatcttgaggttctgggccaccatatctcatgctaatgtgtgacagtttaggtcacaaaagatggcttctaccttgcgccctctcggatcacttgctctggggtaaggcagccgccatgtatgaggaccccagctctgtgaaaaggttctcatggcaaggagctgaggccccctgctggcagccggcgccaagatataagtcatgtgagtgaaccgtcttggagtcagatcctccagtcccaagaaagcccccagatgactgcagacgtagctgacattgtgacaacaacttcatgggagacgtcatgccaagagccatggagaaaaatcaagcaggggaggagctaggaaatgcccaagtgtgtatgagtgtgggagtgagcctgtgtgtgtggtgggggaaattaggagacagctgggttgggttttaaaatatgttagatctctctgattattaagtttctatttgagaagaaacctgaaaagcataaaggggtaagccaggcagctctctgggaaaagagtgttccagtagaggaaacagtaagtgggccgggtgcggtgtctcacgcctgtattccaagccctttgagaggccgaggcgggcagatcactcgaggtcaggagttcgaggctaaaaatacaaatactagccagacgtagtggcgcacgcctgtaattccggctacttcagaggctgaggcaggagaatcgctggaacccgggagacggaggttgcagtgagccgagatcgtggcagagtgagactgtctcaaaaaaagaaacaacaacagcggaaacacaaaatgctaaagccccaatgatcgaggcgtctgacttaccctaataaaaagcaagaaggtccatgtgacagcagcaacagagagtgaaggggaggagagtaactggagaggtcactggaggcctatcctggagaggggtgggttccgcactagagtgtgcatgagaatcaccagagggtgtgtcaaacccagatttcagggtctcacccccaaagtctctgattcagtaggtttgggggtggggctgagaatcttcacgtccaataatcttccaggtgatgccctacgatggagattatatcttgagaatcactgccttgggcattgttggccactgtaagaactttgactgcttctctcagtgaaatgggaagagagcattttaagcagagataggacgtgctctaacttatattttaaaagaaatcttctggttattgtgttgagaatagactgggctaagggaagaaacaggaaagagtttattggagcaagggatactaatggcttgatccaagtagcagcgaaaggcaggaatgataattggtcacttttggacacgttaaaggtaaagccaacagaattcacagacatgttgaatgtggcatgtgagagaaagagaggaggcatagatgggtgttttcattctctccgccactactgaatccagaatagaagttgtaccctggttatgcttaattcaaacattgcaggaaaaacagttcttcactattcatacagtcttcttgtccatcatgtcttcttgctctcctcaccccgggaaggccatagtagcgcaccccgaggccaaagttccttgttttacatttttaatttgtgtttgtttgtttttttagagacagggtctcactatgttgctgaggctggtctcgaacttctgaactcaagcgaccctccagcctcggcctcccaaagtgctgggattacaggcgtgagcaaccgtgcccagcccaaattttccaattaagcaaaagcaaaattttcaggcacaaagaaaaatctcctaaatatcaaaaagagtaaaagcacaaaaatattgacaaacaagataaactgagtaaaaagattattttatgtgatttagatagtatgatttcactatgtttctccccataaaaggtgtttttttattgtttttgtcttgttgcttttcaataagaaacttcccagttaaggaatgatcatgtaattgctgtcatttatgattgccaagctcaagaagacagtaagaaagaaagaaagaggccaggcgcggtggctcacgcctgtaatcccagcactttgggaggccgaggtggccagatcacgaggtcaggagatcgagaccatcctggctaacctgtctctactaaaaattcaaaaaattagccgggcgtggtggctggtgcctgtagtcccagctactcgggaggctgaggcaggagaatgatgtgaagctgggaggcggagcttgcagtgagccacgatcgcagcactgcactccagcctgcgcgaaagagagagactctgtctcaaaaaaaaaaaaaaaaaaaaaaaagaaggaagaaagggaggaaagaggtgggggagagggagaaaaaggaaaatagttgcaagctaatggaaagacccctgaactaggaatcagatccctgaattctattttcatcccttaggtgtacgatcatattctttacctcatgtctctcaggtccatttagatatcaaattctgtaattctacaaaccatcatattcatgaaaattgattctttatgagctcttttcttcatgctcagtaaatatttccatccttaattcaaagcacagaatcatggcttttaatggccaagtgggcctctgagaacatctagggcaacactctcgtttcacagatgaggaaactttcttttaaaactcctctgaaattgtctagaggactcatgaaaggtgatactaagttcactattaaaaaactaaaggaaaagatcagtttatcagggcatagacagtggatctttttatagtaactttaaaggtacctttctttaaatgttatagatgtctgtgagtaatttagactatgtgtttaacaatttgtctattttgatttcctaaaccaaggatgaagaatgcatcagtcagatgtgtttgcctttgttttgttgaaaactcagtccccgggtttatagaactaaagcattagagtgattgttttcaatgttgacaccatgccaataggacatttgaggacttataatattaggtactaatttttcaacagagaaagggtttattttgtcgttaaggagaggtattgctatttgaacagtgttgaattttcatgttacgattttgtagttgtatttcaaaatttcagttttctaatgtaacaaagttgtgctttcctgctataccagagagagccttaaaactgtccacctacactagaatttcctggattcacgccacactctcctaatgccttgctcaagtgtgcctgttctctcctacctcttgtcactctggagccatcagagacagtcttaggaaatgatttcatctccagggatcaccatgcctgaggaatgacatgcagaaacccagggtactgtattctccgtagacagaaaatgctagcagaaccacttgaatcatttctcaattctccatcctgagaattccccactggcttctaacaatctttgctgctggcagaaggaaagtagatatggggtttgagaggaaaggggcagagggaaggggagactggctgtagaatgtggagcgaaagtggaatgtttttgctgagtgcttagtgaacagttgcaaactgccacccttgggagaacctctcattcagccacttatggtgtatccaaaaacgcagattcctgcacctagcccaacccttcaccaaatcagaaagctgcatgctaactagatgcaatgcatctttggagcaccatttcttttgcctttgtttcttattttaaacaatctcaaacttacagcaaatttgcaagtacagtaaaaataacctttttttcctgaaccatttgggaataagttgccaatctactgtttctatccccaaacatttaactgagcattttctacaaattgggcattcatcctgcatgagcacaataaaaagatcaaaattagaacatgaatatggatatatcactactatctaattttcagatctcatttaagtttcaccagttttccaatgatgctccttgtaacaaaaaaaaaaaacgctttcaaactcaaatttctcattttgctgccacatctctttattctcctccagtctggaacagtttcccaatcttaatttgactttactgcccttgacacttttgaagattgcaggtcagttatctactcgaatgtttccaatttggattggtctgatgttttctcatggctggattcaagtgatgcatctttgaagaactatcacagaagtgatactgtgttcttctcatggcaggctatgaagggcccattatctcaatttgtcccattattgacaatattcactcgctttgattacttgattaaggtggtgtctcagaggctcctcaactacacagctgctttttcctctgtttgtaattgatgagtaccccttgtgggaaggcacaatgaaactaggtaaatggcccattcctcattaaactttcaatttattcatttgtgtacttatttatatcctcgtggactcatcatttcccattctattcaatgggttgtaataacgccttagccttggtacccaccaattcttcaaggaggtttggtttcttttagtagagaagcgtatttggaaactagatctgagtattaagtgtgtggatcacaatttgagatatgttatttaaaacagaacgatcagattatcttgatggttcaatgtggggaaccagctcacaagatcagtcaatcacatcttcctgatgaattcatccaattgccagaatggttttcttatagaccttccattatagctgtggccaagagatcaaattgtccaactttggttaagtttggcagagtacagcccaatgaggatggggagagcatggaaatctgtttggtgtttagggtttctaaaagtgttaactcaatcctgttgtcaaattttgcttgtccattatataacaccaaatcaactaattagcaaagggttaatattacatatgtaggcatgcccttgaattgtttatgcacctttttttgttctctttttattgtaagtgttaaaatacacatgagacaaaggtcacatttctacgctgatgacacggtgtgccgtgagtgtggacagtcattttgctaattcttctcattggtggttccgctagatggatgatttccctgaattagccatcataactgccatctgttcctgtgcatagatacagagatctaaagagtagaggtcaggaagaattttaaaaagggctgtgtgctcagttgcctctgtttgtctctctagaacattctctagactgctttttgcctgagacctaaggggctgcattgactggactccctcaccctcaagctttgggttggttaactaatatttctcaattttattttcatgactacactccctaaggaggcttttttagacattctttttctaattgtctccacctgaccatgaaattttaataccataaatatattgcatatctatttatgaactgtatcttttggagggtacagaccattataatagctaagagttttttgctgtgttttttgtttttttcctttttgccctgccaagaacaaatgtttgcttcccattgagaaggcatgcgctagaccagtggaagtcatttaagggagattggagaatggggggaaaagtactaaggacaaaaagacatttattctctttgacccttgctgccagacagaaatgacttcacccaaggacacagcacttgcgggtggccttctccacctccagctattgcttggtttcaggtgaccactccctttctcttctcaggcctatgggtggtaacagctcccatccactgctagtcttagacatctttactttccttgattgattcccttgactctgcccacatcttttaaaatatcccatattaaactttttacacccctttgaatgtgtcctgcttcctgctgggaccatgactagtctcttctagttggaatccatatcaccttctgtgatgtagtctccaagtcaggcagtctcatttcaactacagtctttctttatgcttctctttttcctttctggactcttacctttcttttatttcttactcagcaacagtgtctgcccattaaaatgcacctttgcggtggtggtttggttttctttatctctcttatttcttcccttcctgttgcattttcactggcattgcatgggatttttgtttggatactaagccaagcatcttatacccttgcatgcttgacatttctcttgcttagctttccaaacacccaagtcaccctgacaggctcttgaatactttcttcccacaagttagtgatcttagctggcaagagcagacaatggcttgttccaggtactagggatgtataaaacttgttggcttaaaataatgacatttattttgctcacacatctgcaagcttggcagggctcgacagggatagttgtctctgctctactcagcattggctggggtggctcagaaattgggaggctgaaatatccagggcttctcttactcacttgtctgagccctaagcttagaagactcaaacaactgaaagctggaagaactggagctctttgggcatctctctagcttgatgaagtctctccatgtaatctaccagcatggggggcttagggcagtcttacttgttacacattgacccagagctcccatagtgattatgtcaagagaaagagcttgttattcagtgttatttttaccacattctattggttgaggttaacaagtccccaggattaaggggagagaacttagaccctgccttttgaaggagaatgtcaatgtcacattgtatatttttaaaaagtggaatgagatatgtataggtacagtcatttttggaaaaacaatctgatctgcttcagtatcatacacataagtacataatacaatttttttttttttttttttttttttttgagacggagtctctctctgtcgcccaggctggagtgcagtggcgggatctcggctcactgcaagctccgcctcccgggttcacaccattctcctgcctcagcctcccaagtagctgggactacaggcgcccgccactgcgcccggctaattttttgtatttttagtagagacggggtttcaccgttttagccgggatggtctcgatctcctgacctcgtgatccgcccgcctcagcctcccaaagtgctgggattataggcgtgagccaccgcgcccggccgtaatacaatttttgagaccttgtggaagtcctttggggttcagaagaaaatactggaaattactaatggaaaacaagcagagataggaagatgtcagtaaggaggtcttaatacctactttgtataataatggggctcaggatttctgagtgagaagatcaagagtaggtacagtcaaggaaataagaactctggattcctgtctatgcagattgagtcaagcaagtctctgatctctatcaaatgaagaattaatcttatgattttgatgttctttctcaaaacccctggttctgttacgccatcatcaactcacttttctgtttcctgtttaaagtcactttctctcaaaatttgctgactccaaattctgttgcttttgctgagaagacagtcacactgctgtctatgcagctccactaaatcaagtgtgagcttcaagtcctcagtggcaccaagcgttatttcaagagttattcttcctttgtgtatgaaaatttgcattttgaatgtgtgtcatcagagaagtaatgggaaattggggattgtgatgtggccaagtcagaggacatgtgtgtgtgtgtgtgtgtgtgtgtgtgtgtgtgtgtaactatcaccattctttttctctaaaagagagttttgatggtagatgaggacgtaggaccactagattcaaaagtggaggatgtaaaagaatttggaaatagattaaacacaattctggagttgtctatgaagctctctttataaagtatcttcatatgcaacagcacatgtagtaggcactttctgacgatggtcacaacagaacgcagaatggctgaagccctgaaatgatgcacactgtatatgaaattgaacacgtcggtccacgaatgtttttaaatctgtaatttaaaaaactcccaaggtgtcgccaatgtgaaaataagtgagaaccacaagcaacctaccacatggtttgtagaggccaagattctctcagattcaaggatagaaaagccactcaaaactgttttaagcaaacttgtatctgaaaagtctatttgatacttaattagctaatttaccagttgcatcagaactaggttcctctacccatctctgtgctctgcctccctctgtattggctctatttcatattctcacctctctgggacaaagatgaccactaactgctctctcatcaaccctggtataagtggcatacttctttctcaatagctcccatgaaagatctgaaattgtttcattgtctccgattggctagactctgatctagcatctgcccttgaaccaatcactgtggccatggacatgtactgccctgactaggtctaggacacatggcaactctgggaccgggaggtgcaggggtggagcaacatggttaactataattaaaactatggaccaagtaggagctgagtggttccccagaggaaaacaggggaagtatcaacagggaaaatagacggtatgccttctattctagttcgtcgtcagtaaatattatttgatcattgaattcttgtgtcttgttctttaaagacagacaataagagttaggaggacataatgtcatggctaacaatgttgctgtaaattcgttatcaatttttccctttccactctcactttattataaaagatcaaaggggattttcaggaaagcgttaacactacttaaaagccccacctcgaagactggaggtgtggagagaagctatatataaggtggacccagccaggataaatgtgaaggataggcaagaagcactggtaggtgaaggtgaatagtgcaagggtatggactgaaaatcagtgtggtgggagaagtgagaaaacaccaggggaggaaataaaagctaaacaaaagagagagtgccacctctgtatgttgttgctgggattatccataggaaacagacatgtggaaaaggatcctgtgactaagaatagggcgtacaggaagtaaatagtactgttagcctctggaaagcaatgtggaattcaacttttaaaatttgcatgttgggcgtgttggcatgtgcgtgtaatcctggctactcaggaggctgaggcaggagaatcgcttgaaccccggaggcagaggttgcagtgagccgagatcgtgccattgcactccagcccgggcaacaagaacaaaactccgactcaaaaaacaaaaaacaaaacaacaacaaaaataattgcatgtttgctttttaaaacattgttctgtgtttccaagctgttttgacagtgggtcaaaggaatgccaatagtacggattatgactggcttcattttaaatggcagccccaagcaaagttgaaatttgaacttctgtttacatttagaaattctctggattgtctggtaaccttgtctttagaagcctgatgtttatatattggcagccacagggaattatttccctttgggtgttcaattgctgtccaatttccttatctactgcccattaaattaggaaacgttgggtctcatcatctgcttcactttccaatcactttaccagcaataggcttcaataactagtgccttgcagtgttgttttgtaagccatggtgtcctcaggatgcattttaaaaaatagatacctgaagtaatgtgaagagccagtttataggtttaaaacctgattttgagattcagacatagttcttaggaggctgaaccctgaggtttttcttttcaacttactcactatacagtgtgttgtatttccaaatatgaatcttggtaaggacaggtttgaaacagtctagcttcattgaccacaaaagttggttatcggtgaaacatgatgaaaacatcacatttctcatttaccaaaaggtgccttcagtggaggttattggattgcaaagaggatgtttgttggaaccgagaataaaaaccaaataaggttataaaacaaaaggtagtgatgatttgacattgaatggtatgcccagaaacttaattaaattttaattaaaatgtaattctgcataaaatttaattatatgacaatgagtattctcatagagtaagttaggaaagttttctaaagtcagttggaaaggcaccatgcagtgtgtcataataaaaaggacagaggctacaaggccagccagatctgggtttgaatcccagctctaccactgactggttctaagcttcagttttctcatctgtaaaatgggaataaattcttactctgcttacttggcaaaaattagaagtcaaatgtattattaaaaaaaccattcataatgtttgacatttaaaaatatattaggcattcaaaaatggtagctattatcactattattattattatttcttctggagaatagatatccattgtccctcttctcttcatagaaaaaaaaaatccagaaaacaaatgcctttttaaataacctggttgtagaattcaaactggctctgtccaacaaaattatgtttaaggctggagagagttttgctagtttcccagaaaaagtattgtcaaattacttttttcttgttgtgtgtattttttccctaaattctttttttataacttttactttcatctgtgtggaaatattcttggccatctctctgttgctatcccttcagtaagtctgcaattattttttcaagaggtgccagcccaaagaatcataagcccttatgagctaacagtgaagtctcagccaagaaaagaaatttaaaaaaccagtttcctgaaaattgtaacatacataagtttggaatgtgcttgtttgtttgtgtctttcttttttagtttatagaatgctttgctctttatgttgaaaaactgtccattattactggctgttggccattttttcatctctagggtaatatatttctactataaaatttcaactctggtcaaagcagacagtgtgttataaaaaaatatactgagcacaaatgcagtcgtaaagtctcatatttatttacctctcaaagtgaaagtgcttatagtattttagggacacagcattttttaaatactaggcactcagtaaatatttgtgggtggccaagtgaatgaataaacgaataagcaaatgaacgatgggaatttaccatgactgcaaatcatttctcctaagtgaaatatactgtttgttttcctgtgtgtgcatggagggggcagtgaaattgagataaatctcattgtttaaagagttctttagggactaccagagtagtggacatggtaataaaacattgttctccaaagcagaatatggtagttacagttacaggaagactattaacccctttctttttctagaatggctgccctgtatgtaatttaggttttgaaatcttccttttcctggacagagaatcggtcccagaatatcagacctgtgtttattggaaaacagctctatctatcgcagagcaatttctgttgtccttattaacaaagatctttgggaggtgaaggtcatttcaggccagtgctgaacagcaatgaatttgttaagttgttttccgaatgctgaaaggagatggacgtcagaacctggacatgaacctaaggcagttgggccaggtttaaacctcgcatgatcagtgggaatttgtgtactttatttaatgggaagcctcaattgccttatataaaaagtgaggcaagtgtagcatacacctttcagtatttggggtgaggattacatgagataacacgtggaaagcatttaccataatgcgtaaggactaccactactatgatctgtttctactcataatacttctaacatcaaatatgtgttttttccctcacactaagcaattctctagttctccagacaccaattagttgttctacaatttaagtcaagccttacactatctagagtgagcatcaggtggcacagattaaggactcagtcccacaagactccccccacttcaagatacccatggcaagtccaggcaacctgtacttctgacagacaagctacaaagtcataaagttgaggggttcccatgactctttcttgggtttgataatttgctggaatgggtcacagagctcagggaaaacaatttacttactgctaccagttaattacaaaggatgttggaaaggttgtaaatgaacagccagatgaagcagtgcatagggtgagatctggaagggtcccaagcgcgggagcttctgtccctatggagttggggtgtgccaccgtcctagcatgtcagtgcattcatcaacatggcagttctcctactcctgttgtttaggttttctatggaggttccgtgacattggcatgattgatgaaatcattggccagtgatgactgactcaatccccagcacttctctcctctccataggtcaggaaatggggccaaaagctctagctctgtagtcgcaaggttgggtgccctggcaattagccccaccctgaagctatcgaggggcccaccaagaaccaccttattattaggcttaaactcaggtacgattacaagtgacttatgaaacaaaagatgctcttatcactcaggaaattacaagagttttagaagctctgtgccaggtactaggatgaagactaaatatatatttcttatttatatcacagtatcacactaaagcataggaagttctcaataaatggaaaataaatagtggtcaaacccacctttacatattttgatgccaagtgtcaagaaggattatttatgaaactcttctcacacaagtttccatttcttcctttgtacacatgagagggcctgatcaggtcagaagaaatcacatttcacacccatggttttttgagccaaaggcacaggggtgtgggggtgtagggaggcaggttgggatgcttcctgctggcagtggtgtctcaaagagcacaaggcagggaaaataggggatgggtggaagaggatagctagggtagaagcaaaggaaaataagtacagaggggaggcagagagaaagggagaagggagagtgccatggtgaagagtttgacttgccagagctaattctttgtaggcaatattagggtttcttggaaggaaatcccccgttatggacttggaaggtaaaaatcagtttccataaaagagggagtattagatacactaagctggatcatgaagaggtaaaatgtatgaagattaaaaagaggatgcagaaaagaaaaggacaaaaatatattaaaaattagttcaactcctgctgggttcttcacgctcacagctgattagaaggtgggatatatctgtgtaacatatttgtggagcctgcttagctggaagtcctcatataccccctaccccaccacccaccttcccacacacaccctacttttggggagcctggctctgggctttttctcactgattcttggccagagacagcactcccttgccatgggggctctctatagaggatgcgtgtcctcatgagatggcagctggcttccctgagagcaaggcacgggggagagggagagcatgtcctggcttgaagtggcagtcattttatagcctaatctcaaaaaggacatagcatcactttggctgtgttctgttcattagaactgagtccctaaaccctgcatacacgcaagaggaggagacttaaaacccatctcttgaagggaggaatctctatgaatttgtgggcatatttttaaaaccaccatcatcccaaacagcattctctttagtttcttgttccaagacttcctgcatcccgactatgtctctgtctctgcttttggattatttgagatctctttaaatattaaattccatttactgacttaagttcgaaagtcctttccaataccatctgaagtcttggaatcagtgaaaacatgtcagacacgggcactttgctgtcttgcagaaagtaatgactttggtggacaagaggcagttggaggttatcttaacagaggatcaagccaattcctacactacaagggtaatcactccgcaatgagttcaggtatgcggtttcctaggctgagtcatctcctgctatttcgtcaggtctccccaaaacaggggtcagtacacttctgtaaaggaccagatgggaaatatttttggctttgtgggccacatgtggcctctgccacatattttcttcatttttattacaaccctttgaacatataaaaaccattcttagctggcaggctgtaccgagacaagcctccaggatgtagtttgcagacccctgcgctaaaataatcatagagaggtgcttgtcgtgtccttggaaatattttagatatgcttttccataccacccagccatggtaagagtcttctttctgtgtctctcaaatttcctaaaagatccaatttatcttacttcagacaaagagctgggagtccttttatcaggttggatacattttacataggatttctctcattccttcagggagacagaaacaggttcaaaaattaagtcactaaaatgactaatgtggtactgtcagagaagaattatgaacctgcagggttatggtctcagaaaattcatattgcgtttctatgcctcacgtgaataacaataaccttctccaacaagcagagtgaaaaatgtgaggactgccagtaagtattccttactgctggctaaatgctggcaccacacaggctttctatggcaatgggaatttgtgtcagagttggcttttaatgtggaaaataatccagtttcatactttggcttttatgtctttgctgttttctagaacgtcagcatgcctcgtgaatgacattgaacactccacaaaccaaaccaaaacaaaagccttttctgtgtgtctttatcagcaagtgaaatcaaaattgttggatgagaattctcaaaaccaaaaaaatctacgttttatttttaccagggcattagtaagaaatgtattacttagcccatgagttgacaaaagaaaatgtattaacatgtatgtgtgattaatgaattcatactaaaagagggaaaaaaggaaaaaaaaaaaagctgaaggaagaaactaaaagctgttcatcatattaatgttttgtagccccagataagtagtgctgctttcttattttactcccatgcccaaacctgtagtactgcaaaattgctgactcgaggtcctacatgaaaactgtgcagagacttgaaaactcttgcaagagtggggagttctatgaataaataaattgtttaaagggtcaatgaatcaggtataaacctcgttttgtaatcataaaatctgtggtctcaagtctgtttaacgctcttaaggtttacctcataggactcactattagttgtaattaaaactgaccaaaaaatcataatttaattggcgttaataggacagactttgaagggtcatattttattttggatacataatgtttcttcctgaaattatttattcttgtaaattattctgatttaaaatttattagccagttgttgaagaaattatttacttgccatttatttgaatggttcaagtagtatatgcgtatatttaagtatttatcctaacattttcatgtgatcgggaaaacttttgctctaacttgacatgttttaattggcgttttatgtcacaagacagcatttgttacaataccattatttgggggttttcataagaaaacctattacagcctaaatgttaaaaactaagatcatttagacacttctagaagcaaaaatcttctgggttccataaaacagggaaattgggtttatcaagtccaagatcatctgacattagtaatgagatatgggagaactagaataatttattcttataagcaaactgctgagaagatagaaagacctgaaaacctttctcaagctgttgctgtaagattgttctcctgcagtctgccttacgggtagtgtgctctatcatccctccaccatcggactgtttctgtctactgctgcctgctacatccactgcctcctcatggggctccacctgtttagggaggaaggggctctgcatattaaatgactgatcctagaaccaatgaggggctctgcatgttaaataactgaccccagaaacaatgaggtgctctgcatattaaatgactgaccctggaaccaatgagagggatgaggcattagacagaccgattctcattttcaatgagtgcagtcacttgcagagatctctcttttcatagatcacaaggctgcctgatatattttttaccaaacatatttctgtggagaaaaggcagctggaattcctttacatttatccaaaaaaaagaacatttgataagggcaaacttctgcaaattgaccgatttggcagaaagaacaaagaacatgctagaatactccttagtgagggattcatgtgtcgttttatgtctgtaccattgtacatactggcaatgcataattgtctgtggcctactctgccaccaggagagaggaaacagatgttcctatctgtcttttgatgtggcttctgatacttacattgatttgtctaaaatagcatcagctaccctagaaaatttttttcctagtccttgagttggttggctaattgtttcaggtgactattaataatgtgggccaggcacggtggctcatgcctgtaatcccagccctttgggaggccgaggtgggcagatcatgaggtcaggagttccagatcagtctggccaacatagtgaaaccctgtttctactaaaaatacaagaaattagcgggtgtggtggtgtgtgcctgtaatcccagctactcgggaggccgaggcaggagaattgcatgaacctgggagacggaggttgcagtgagctgagatcgcgccactggactccagccaggatgacagtacgagactccatttgaaaaagaagaagggaaaaaaaaggaatgtgattatcatctcaagacgatccactgtcagcgggtattgccctgttacagggaaaagacagagaccattgggaagtggacttacagaaaaaaaaaatcacacagtattttatttattcaaagtggagtaagaccccagtaagactttttggaatagatctaatgaaaaattgagggtaaatttaaattcaacatcaggaggtcttagcactccctgctccatacagtaattatagaactgtggttataggtaggaagactagataattagagtgttatcagtagtcatgggagaagtgacaggttcattactaaataaaagtaatttaccctaaattgaaaatgacagctgatgccttctaaaagcacagcttgattagaaagaaaccatgaggatattggatatatgtaggagaagaaggaatggcaatagatctgaaatcacaaaatatatgcagaaaggagatgacgggggttagagttctccttttgcttaggctggtcccgagggcccacaataggctatattcttatttatgacataaggagaacagatattggaagcaactgtctcagaccatcagtcaaaatgtacaacgcagacaagatcacgaaaggaaaaaataagctaacagggggtatcaggaagtagcataactatattaaaattgactgttatatgcacattttacttaagaaaatcttatacaaaatttctagaagttattctagagggatttctactgggctaattttttttctcttcatctatttgacctcattttttattaaaagacctctgttgcatttctcatggtcactgtaagccagaatgtcccccttgttcccagactccacaacatgcagtttttccaggctgtcagctagggtggaatgcagggtggcatcaaagcgtggtgactgacagcttgcctttagccggcaaatgatgaaggctcaaatcgtaattctgctccctgctagctatgggtgctttggagaattgcagagactagaacaacatttctccacctaaaaaatagaatattcattatatctgtattattaagttgttaagaatgttcttcaggataattcagagcttttgcagtagaggtcgacaccattcctcattcttcgcacctccgtccaaccactcaccaaagccagttggttcaatctcttgaatctcttttcagtccatcctgttctctccctcctcacctgctgcccctttatctcaggcttctgctatctcttgtggagtatttcaatcaatttcaagtgggtctttcatgctattacatattcctaccccacaaaacagccaggtgagagagaacccacccatggctcccagctgcccccgtagacatgcctcactcccagcaaagggcacaaagccctttctaatgtgaccacggtcttcacctggcttcaatccttccccactccattcgttgtctgctccagccgtactaaattactgtgactccccaaatgtacatgcttcctctcacctctggggcttgctccccacccagtgaaacattccctctttcctcaactcatcctacttcatttgcgtgaatatttcccacttagatccatcgtgaagcaccggccatcggcactcccgccccataggcccctcgtaagtctttgaagatgccaaagcctttctcacataagagttcctggacgtgctcttcactccacctggagcgatcatccctctctctccttttaccccattcattcctactgattaattttgcttcacaagtgccttaggcttatcagctcaaatgccacttctacagggaagccctctccaatactcttgtttgttagaagccatcttagccacctacaacctacatttcccttcgttagcacgtatcatgactgaggatactatatttgcgtaattatttggtttaaaaatctctgagagcagatccctccaagcacatgctaagacaaagattcaagggccagcagttgatctggggagtgattcccaggaagggccagtagagaagcggtgaagtgagatagagaaggggaggaaacaaaaacaggtgcatgaacaagtagattgtcctgtgggcagctgagacttagtcctgcgggaggactccgggaaatagtgtggatgtgcctctgaggagtcccactccaggggcatggatgccagggtaggggtatttgttcgccccctcctgtccgtcattggttgagggctgcttctgggatattaactccccagcacctcagtattggcaggacaagcatcctgttgagaccagaaaaagccctcaggccgcatattcaagagaagaagcctctggtgcatgcagaaatcagaggtaagtgccagggacgatggccagggctttgacagctgtggctacaatatccatctgtcccactggactcagctccacagctcttttccccactagttatctctagagcagcactgttcaacagaaatatagcatgagttacaaatgcatatgttgttttacatttttcagaagccacatttataaaaaaggtgatattaattttaacactatattttacttaacccaatagatcaaagtagtatcatttcaacatacaaccaatatgaaaatcgttccttagatattttacattttttcacactacattcaaaatctgacatatatgtaacatttatagcacatctcaatgtggacttgcctcgtagtccgtggagtgcccatagccatgtgtggctagtggctatcacagtgggcaatacagctttaaaggacagagtctgggagagactgagacctcaaaaaatactcagtgacaaaagtctccgctggggcagtgcctcccctgagcaaatttcactgactgcctccaggactggaattaggtgcttaagagcacctgctgccctccctgcttcctccagcacaatgttagctgtacctaactgggtcttgtattcactcatctgtctccccagcatgcttctggagggggtgggcccccaacttgttcattcctgtgtctgcagcacctggtgcaatgtccagaacagagggagcttccccaaagttttgctcaatgatgaatccattttaagataaggtgattacattatcatctttagtgaaattttagtgaaaaggtaaattctatacattgattttatgaaaagtctatttttgtctacaaatattagtatagccatgagggattattcaactcatggctacagagattcagaatttggacaatgaacaatgcagtaataaagtgggcgttcatagccacatgtaattaacaaaaataaatcgcagcatactttctacttttacctgttaatactctagagcctagaccaattgtattagtctgttttcacgctgctgataaaaacatacccgaaactgggaacaaaaaaaggtttaatttgacttacagtttcacatggctggggaggcctcagactcatggcgggaagtgaaagactcttcttccatggcggtggcaagagaaaatgaggaagaagcaaaagcagaaacccctgataaacccatcagatctcatgagacttattcactatcatgagaatagcacaagaaagaccggcccccatgattcaattacctccctgggtccctcccacaacacatgggaattctgggagatacaattcaagttgagatttaggtggaggcacagccaaaccatatcaccaatcattctcaaagagtgtggccacactcatagcagcagcatcacccaggaattgattggaattgcagtgctcaggccctgtcccatctccgctgaaccagaacccagctatttgtgttttaacaagcccttcaagggcctctaatgcacagtgaagtttgaggaccagtactccagatagagtaatttccaagttactcctttagaaggaaagcaggagatcttagacaagagcttcctgtgcctaaaattccacacaaacaaaacatttggtttatctgcctaaaggtgtgtggtttctctacttgcaaattaatttcatatgaagtaaagagaatatgttgagatttattctggtacaatgtcaaatagcgattagcaaaacatttggctaaacaaagccattattggaaatctgtaatttttaaagagagattaaatacacatagaccaccctcttgtttttatacttgtcagtcagctttggggtggttgttgagttttatcatctatgggatcatactgagggcaagagcacatttttggaaaaagttcatacaaaatcatgggaaacccatatattgctttcatcctgaacttcaaaattccaaatcaacatctttaaagttttattcctactacttgaaatagcatgtctcaacacggaagaaacaagtattttaaaggaagaaagtggtagaaacacagaattggtttttgcttcccatgataatatggggctgcccacaacctcagatatatgtgtattgaattataccttggagagaaaataaattaggctattcagaaagcaggagactttccctttgtgagttgccccagacagacacttgcactcacacatctacatcttcaatcgttgacttcccaaagagccatttggacaatgccaagtggagaactgaagcagttactcctttcatccagcaaaaatacccaacatttattcatatctacatagaggaaacaacttttttttatttttctctggatgatcatctctagcctcagtttcactttgtgcaggcagacacatctcatgaaacctttccattcctctcccttctgtcaactcctaaagggaaaggcttttgtcttctgaatagcctaatttattctctctccagcatcttgaacgttgtaggtactcaacaaacattaattgatgacaaagctatataacagcttttgaatttattcatgggatgattcttctatttaaagaacatctttatatactttccattcttcagcaaaaaaaaagcaaagaaaaaaaatgtttcatcttgccagttctgtatttaacatctgcacagagcacagtgtgtgcctgttttaaacaaatgtgtaggctcactggttatctagattcaggaatgtaaaggacaatacagagaaatgtaatttttagaagaaaatttaaacttagggcttaatgaaaaaaatgcagttgctgttttatcagagagagtgagaaagggagagaacaaggaaatcccattgtaatgctattatgctaacctcattttggccatgattttcccagttatagagtggacaccaggttatgtgcatatctgagaactggcataatttatcatcaatttgcgagcacagaacaactagtagaataactgtgtcagtataagttgatttctaacctcagttgtaccatgaagtcattggaagactttgggaaagttacttaattctcatttgttagttacttttaaaaaacagccacatgaatatatttcttattattgtcattccttaatagttattgattgtgtacaggatgctttgtatctctgcaaggcactgcaacttccccagggaagcccacattaatgaatagtgtttataaagtacttggaaatccttggattaaaaactaacggtatcaaagtatttgtattaacatgccatatgggagaaccgtatgttatttattaagaggctatgtgtggtattgaaaatagctctctggtgcatcactttgtgctatttttatatcaagatatgccacggcaagttttggtacgcttgggtcataccttcaatgttgaaatgcctcaaaattcaatccttccacaggtatttgttgagctccttattgagcacttgactctctgcttaccattacacaacacatatggaaggcccagtggcacctacagtttcatgcatttcgtctctttgaacacgtgttattaaactgaagtccccgttaacagacacacgggcttaaaaaattacaggttccatttttcctcttccttctacatggacaatgctgttttgagacacaatgatagagatagggctgacacgattgtcttgtctgtcctaatggttgaagactaacccatgaagcttgcaccccttctgttaatggggcatggatgcagcactatttgagtttattttgggtagaactggcagccaggagagcactgcccagcatttccccaaactggctacacatgctgcaccaccttcccagaaggctgtaagtcattagtctggagaactatattgtaacgagttccatacaaaatctgcccccgcctggggaggcaattccttctcttagctagttgctctaataaggagacgatggcaatgggtgtattatcacaaggtcctgagatcttatgtcggggccagcatccttgaaaaattctgttctaaatgacatgtggaacctcatgcttcataagtaactgaaagatcctggaatagaagataatctacctctttttttcctgattcatttgtgaactatccagacaaggccaggtaaggcaagagcgtatttcattaactggagaatatttattgaacccctaccaggtacttaggaaacattgtttcacaaagcagacaaagacccttgcctccgtggagcttacattcaaggaggggcaggaacacataaacaatgaacatgatacctacctaaattagaggatatgatatattagaagatgatggacaattgaagaaccaaagagaaaaagttgatcaggataagaaggatggagtgtgtgagggtggggagatgatgcaattttaaatggaaggttcagtacagatctcattgaaaggggacatttaagcagtaacttgaaggagctggagagaaagcactccaggtggaggggtcaggcaatgcaaaggcctggggagaggagactccaatgtgctggaggaacagcacagaggccagcatggctgcagcgactgaaccagcaggataccaggagagaatgaatgaagacagagaaacaacgagggtctccaccacgcagggtcttgctgccatcagagcattcaagcaggggagtggtatgagctgcctcacactttaaaacaaaccagctagtaggctgagaagaggtgttgagaacaagaactgaagcagcaaaacacatcaggaagccattgccaccacccaggatagaggggatggaggatggccccagccggcactaaccattaactaactattaatacttgtgctccccacacttcaccatttgatttttgggaaccattagttgagatcaaagacacatgaaatgtttaaacaaatccacaatttaatgaagttcaagcagaagctgagatagatatcatacttcatctgcctagagaactgaaatacgattcaaggaaaaaataataatgctttgggggaaaatgaaatttccctcctaatcccttgacatgtgtttatggagcccttaacagataaggcactgtgctgggtgccaaggacaccacagaaaaaagagacatctctctgcagagggcttatggcttagctcttgcaggtgagcagaggtctcaggaatctgcaaggcaagaaagagagactccaggatttggcatgatctggacctgtgtttaagtctcagctctgccacgaactgtgtgacttcagggaagtgactttgatctcccacagccttgatttcttcatctgcaaaaatggagataaagtcgaatacgacggtatgacgttcatggttatgtgtgtgaggtgtgtgagcgtgtaaaggcctggtgcaaaggagacatctgtaggaagcggcagctatgactcctgctaggtggagactattcactgcacacctttttatctgcactaaaagatgcacatgaggctcttcattaaaacaatgaggcagccaacatggaaacttttctaagagtaagctattaaaatagatcaatcagctaatgacacctccagacaaaatttgtaaaggtttggaactaacattccctccctcctttccttccttctttcctttcttcctaaagccattaagcaggactgagaaaaataggtgtttgcattggagagaggatggtgctgaggggtcacagggtttggacagagtcggaagggcttctctgtcccagactactgtgaactaaagagacacaacaactgaatgctgtatgatcctagattgctattaggttattcttgaaaagtggcgaaacacagatgtgatctgtagcttagatagcaggaatgtcatctatgttaatcttttgatctggatggttgtattgtggttatgaaaaagaatgtccttgtttgtagaagatatatactaaagtattcaaggctgatgggcatgattaggacatgattatgtctgcaacttactctcaaatggttcaggaaaaaaaagttcttgtcctgttcttgcaacattctgttgcttaaaattattccagaataaaaatacctttagcaataaacacaaaactttagagttgtagcactgcactcacttgatatgagtgccagaggggtttgattctcaatatttgttgtgttcaatgttaattgagttaatccagatgagattatcatttcccacatttttgctgattcataatttacatatcttacccagacaataaatagttacatttctaagtaggcagtagtaggccccaacatcagctaaggctgggttgaaactgtcccctgctgccatcacttgctagctgtggaatcttaacacgcctgtgtctcagttgtctcatccatgaaatgcagataataaaacctgcctcatgcagtttttatgagaatgaagtttgataacctttgcaaagcatttagacactgagtggaacatatgcaatattcaataagtgttagctggtattagctaatattctgttgctcatagagctctatagttaaataaaccataaacatcattatattgatggcagtgcagactctttaagagcattcctctgttatatcagctaattttacttttcaaatatgtaccttctagagaattttggaacatatgagatgaaaatatagatggggaaatacaaaattaaagactagatttttttataaaagagtgctaattttttttaaagttaacttaaagccttcctgagctgacaaaaataaacatgtgtattaatcagctattgccataataatgctgtgcaataaatcaccccaaaatgcagtcccctacaacaaaaatatttattctcatgctcacaggtctgtaagatgactatggttcagctgatgtaggctgggctcagtggggtggttctactgcaagctgtgagttgcttgggcttggttccagactgtgacttgggttcaaacttgctccatgtatctctcatcctccttaagccaagagctacaggggcatcttcttgtcatggcaaatgtcaggaacacaagcaacaaatccttttatgcagtgcatgtaaatcctttgctcacattctctccactagcatttcattagctaaattaagtcccatggtcaagtccaacatcaatggcatggaaatattctctgctcacagtgggaggacactgattttatatatatatatatacacatatacacacaatcttattataggggactgaagaattaagaccaataatctaatctgcaaagcactggttttgaattgtccgtagtctgtctgtgcccagaaatctatagacctttagaagaaaagacagcagtataccagcaggaagtacacatcagattgtttccccagtatagcgatggatttatttagacttacgtcttgtttatcttcctgtcaccatgtagcgttcacaaaaggaactacaaatatcaggatagcaatccgtgatcatgttgttgagattttgcccttacaaaactctcccatgtagagtcaaacatggactgctttcttatcatagtcacgttgcagcaggagcctcttattttatttctataaaatttctgaaatgttcttgcaaacagtacacatttgataaatattggttgaaagagtaggaggcagagtactaatatgggagaaattagaaggacacaaccagtagaattctcacaggtttctgtgctttttcagcatgggaaagtaaagtgttatatcacactcgacatgaatgctatggaaatttatcatctgaaataaatatgtgatcttaaaggaatattaactgagaacatttagcttctatgtggcattatttaagctaacaaaatagcctcgcacttccctatatttcttcaccgttattgtaaggcttttaaaatcccttctggaaacctcaagtttacacatccctctacttaatttttcattgtttatgtgcttcctgtgacgatagctagacagacaaggctgataaaaaagaaagcttgtccttatcaaagacttacgggtaactgtgttaatgtgccttgctttttctaccagtggaagccccctatttcactaagaactcacccatttgcagcatttaaaatggatggaaagttataagccagccaaaatgtccttctaaaagaatgaaatgaatactaatctaattgcccaagaatgcatatgctgggcttggaaaataagccttctacattggttccccctgctggatttgaggatgcactgtcttggaaattgatgaaagcaatatacctggaccgttttatctgaggacatgttactggaatggcaaatccagcattcttctagaaagcatttgctctgtgataaatgtgccaagtgtttcttgagtttgcttccccagggcagaaatactgcaaatagaaaacagtgccgctgagactcaaagagaaaacaaaagcatgccactcagatgtctgttctagggaggggggtagcacacaaggaactaagggtaaaaacccagaagcagtagactaggtaaactgccagactggttgttactattagaaagctggatttcagggtctgaccatggatttccttcttatgcatttacaactattagaaccaattcctcacctttctgtaatttaactgctgtttttctttcccttcttatcttcctcacttcataagtaatctccctacccctactctgtagaagatgtggtaaccagagtactttcaaaggaagcttgtcacctgcaaacttcatggctattgtgaaatgtgttaaaaggtctgtcttttgagggagacagagaagctggcagatttttcctgcttgactcagagtccatttggtgggaggaaagggacagatattggctaagtttttggcacatgctcctgcaccaacttggccttgttaagacagcaagaacagcagaagtgactatttcctccctagagcaaaggccaatgctgtttccttcatggagaaccagaacagggaaaatatcagataatcatgtagtacttgtaaatatgccatttagaacactgaatttaagtggcatgcagagccaccccaggttctcatattatattcaggccaggtgtggtgtcttatgcctgtaatcccagcagtttgggaggctaaggtgggaggattgctttaggccaggagttcaaaaccagcctaggcaacaaagcaagaccctttctctccaaaaaaataaaaaatcagtcaggcttggtggcatgtgccttgtagaccctgctactcaggaggctgaggtgggaggatcgcttgagtccaggagttaaaggctgcagtgagctatgaacatgccactgcactccaggctggacaacacagcaaggctctgtgtctattaaaaaaaaaaaaagtagttatattgtgtccaccgtcacaaacggcacagggctaacccaacacagggggtcctgtacgtatatttattaactgcattcttcgccaacctcagagtatcattcttttttctttttttgtccttctattataaactttttttccccatttaggtcaaatctaaatgtttccccatctgaaactttcttcagtaggtcgttttccagagctgcaggtaaaatgcttccccactgcttctgaggcttttgtttcagctctgctactagtggcctcctcttgggaggattctcttgcctcggaattaagagttggtaggaggaggagatggcgggtcaaagcactcaagcaagacaacgttaagtgattcagtcctgcttgtgggtcaggaatttttaaagggctcagctggatgtctcttctgctccttgtgacactggctgaggtcaccgctcagctgcatttggttggcagctggcagggtggaaaggttcaagaaggcttggctcacaggtctggcccttcatgctccccacacatcttttctccctctctccatgtgtctccctccatttggcaggccagcttcaacttctttacagcatggggattggcttcccagggggagaaagtagaggctgccaggtcttgcagggtagcttgtaggtcccagaatatcacttccaccatatttcattggtctaaagaagtttcacagccagtcaggacttaaagagaaggaatgggctccactccttcagagacaaagcatttgtggccatctttaacccacatgaatataggttggtaacttctgcttctgttttctgtacttcactatatgttttatactttattcttatgtctttgtataaattcatcatttttatttgcttcattttccaaaccaaaagcaatttggagaccctcccagcaatgagttataaaaccatgcctatacttaaccttcaaaaagcttattatttctacagataaatccacagatatagtagctattttaagaaaaaagaaagtttcagatagttgctaatatacagccttcattgcacctgaccagttatttttcagatagctatatatgatagcataaactcaaccaacataatctgttcaagacaaaatattttatagcataggtatgttagactgccatatggaagttaagtgaaaattgaccttttttttgcagcatatatcatacagagaaataaagggcgagaaacttagccaaccttccttacacagtgcatgttacttaagtcaagggagaaaagtggactggagttgaagtttctattatattttgggaaatgccgagcaaggagagacttgttaccgggactgctgagtgaattttgtttactgcggttaaacatttcatctagcaaatcatgtgagaagggatgagtataaatgcacttatttatgtaggtaatttttctgtttcatgcctctgattcatctctctgcctggctttatggggagtcatgctacattggttacaattaatttcagtgctgcatattagccgtaaagagatatttcacaaattgacttgatgcattttttttcctctgtggttttcttgaaagatgagaacggtccagaggagaagcaaagtgtggaagaaatggaagagcagagccaagatgcaggtaggctcagatttcttttgagaagtcacctaggcctcatctgcagaggtgaacagtaacttcactcaatgctattgtctgaaaatgcttatacatttcaccagatgaactccagtgttcattcagggtctccctcaggaagccaccatctccgataactatgagttgagtgctttcaaacagagtggcacattctcacatctcattcaccaattcaattttctgccctgtaacagtttgcctggcaaagctctaagagggacgggcggaggttgaaagtgccaaggcagagcttggctgagttaggtcaagctcaaattagtacatttagcttgagggaaaaaatgaaataaaaactgatgaaaggaaatgaagaagaggcttggcctgcacagtgagtagaatgttctttagtgtattgcattaaattttgaagagctatgcttcaggttatttctctgcatattgcaggagatggtgtgatgggcctgactaccccacacacagagctcgaagtaagatctaaacccttcctgacatcccctctgttcactaaaggacagatgtgtccattgaaagtttatatattccacaccgtagattataaattgaacattttaaaataaaatagcacttaaggctcaaaagggattgaagtcacctgtgatttattatctcttcctatccatttttgtactcagtcatgctctcctttaaaagaatgataggcacaatcattcactcaccaacataaccagcaaaaaaataaaaataaaaatccctgttccctttagtttcccagttattctcccaactctaataagccccatggaggggcacttctgaagtagtgagccctactgtttgccaagcacatcctaggccatatgctgaactcttggaattaaaccaggtagtgtgataagtttttcactgtaaacttcttacattaaccttggagattttgctagggatctggaagcttttattattaacctggaagacggaactgaagaaggccaatcagagaaagcactgaagcaaggcagcaaggactttgtgtacctgtgactgggtcggccggcgtcctttgctgcaagatagtccttgcaatgaaatgaatttctgatgcagaaaactgttgttatccaaccctcccccacccccaacccacacattctgctccatagcagatgagtgaaaagctgtcactgtttttattgtttggggctgacaagtattagtcaacaaactgctgacagctgaggccattctgtgactgttgaggtttcaaaggttttattcactcactatcgtgtcccaaactgttttttttgtttgttttttgttttttgttttgttttgttttgtttttttgagatggagtcttgctctgtcacccaggctggagtgcagtggtgcaatctcggttcactgcaacctctgcctcctgtgttcaagagattttcgtgcctcagcctcccaagtagctgggactacaggcacgcaccaccatgcctggataatttttttatttttagtagagacagggtttcaccatgttggtctcgaattcctgatctcaagtgatctgcccgcctaagcctcccaaagtgctgtgattacaggcacgagccaccacacccaggcccaaagtgtccttatcgaaaaagattgtttccatccctgtacatacatgtacacacgcacactcacacacacgtatgcatgcactcacatacacatgtatgcatgcactcacatttgcctgtgtttgatttattcatcttttccctttaaccagttgagaacaagtagtttgtagatttgagatccttttgcctgtgaggagggagtggtagaatgtcagccctcttctccagcccttgaatctgatagcgttatcaccacaataggggcacttctcaatgtgaagaagggtcctaaatgcatccctgagtgactccccttacttttccaagtgagctcgccggccggcacagaggccaatggcagagtccacctataatcctggccagtgtcaacacacatagttacgttcacactgctcatttcttatcctccctaatcagagctcagagaaatcgaagatgtggttatgggtcgttaaagctcttttgacctgctggtatttttccaaaataaaagtatcttcttttcattcaatataatttccagcttcaattttgattatatagctctgcaggcctcttacacgtcatgaaaaaacacaatcttaaaacactgtaatccagcagttttgactgttgtcatgatcaaatcagatcaaagttgtagataatattcttccaaaaaatttaacaaatacatatcaagggttcattgtgtcataggcaccattccaggcactgaagaataaaccaacaaccaataaaaacaacatctctgtttctttgaaatttatattctggtgggggttccaaacaataaacaaataaaaatgataacatcaatagtgataaatgctttgctgagaaataaggaaacatagaaggaatgcccagaaggcaaatttccattgtctgggtttgggacggactctctgaggaagtgatagttaaaatgagatctaaatgatgagatagtgacagagaattctgttccaaaggacacctgacctgcaagtaatagtacatgcatcatggacaaaagataggctagaaaataagtgatttgtgatttgcttccaaatatgtgttagttttcatgcatatatgagttatctttagttccccgaccctgctactacataaaaaactatgaatatgtatgtgtgcatatgtactatatatatagtttatatgtataaatataccatatatgtataaatatactatatataaactatagagtccatgtagtatatatatgcatatgtaatgtgtgtgtatatatatacacacatatgtaatgtgtgtgtgtatatatatagtttttcatgtagtatcggaatatgtatatataactatgtacgtaactatatatcgctattatatataagtatatagctatacatattttctgctactatatgaaaaactatatatatactatatatgtatatgtatactatatatactctataatttatatatagtatatttatacatatgaactatatatatactctatatatacacatgtgcacactataaatacttttttctatagtaacagggtcatagaactaaagataactcatatatgcatgaaaactgacacacatttggaatcaaatcacaaatcacatattttctagcccatcttttgtccataatgtgtatatgtgtgtatatatatatatatattcattttccagttatcaggtattaaacattgcaaatgattttagtaatcctgcctgtctagatttactgtttgaatgggagggagtaggctagttagctgttatcgtggaggccaaacatgactagagtcactaggggctgatgacactgaggagagaaaggtctactctaatgtagttcattgttgctgtgaggggaacagagagttccatgtccttagtccccattttcccattctgttcttgggtgacatgaaagttcctggtggcttctggtgacctgtgccgaatgctccccttcttccaggcctctgtgctgacagccatcagagctgctccctgcagtttgacagcctggcataatggagcagaagtgctgtgctaagaaaaaaacaaactttagaaacatgcacataaaagcactttgtaggaacttgcaaggatatactttctttcacaatctgttatcaagaaaaataatataccatcctttgagggatgaggaagaaacaaaatgccaaaggatactactagcaacaagtggcattcttcactaagaaatagattgtagcccattggtctctgacttaactgaaggttcctgtttcactaattataaaagagagtcccaaaccactagccccttcaaagagcattcagtgtattcaagcatgcggcaggctcatgctttctttggtggagagtggagggaggtgcagggcaggaaagccacagctggacttccggaaggatgaactctgaggcagtgtttcttttctgctttatagatggtgtcaacactgtcactgtgcccggccctgcttcagaagaggcagttgaagactgtaaagatgaaggtatgaggctactaactatatctaataattgcagactcttaaaagagactgtttgggcttgtttacatggaaaaatgaagcagcaagtcaaatataactaggttttcttaagtgtctctgtttccaatataattgactacaccacctactctcttttattgcatacctagcctgtatagaaaatttatatatatatatatatatgtgtgtatatatgtatatataacatttacatttgttcctttggaaaataactgtttatgaaatgagagaatgatcagagaaattatgtttagagatgtttatttaaaacaccagaattaatcagttctgctctttacagccactcatcaggaaaaggtttgaaagagtggcatttgaggaccaccaaccagggagcaccatttttcaaaaaagaaatgtttgaaaggcatccttagaaatgaatctttggcaagagcatcattctccattctgtcagaagttactatgagaaaatgtttctgacccaagtatttccagaaaaagtaaaaaaaaaaaaacaatttacttttctaggagacagtttgaggaaggaagaagtagggagacattgatctggggatgctacaattaaaaaaatatatatctaaaggaaaacaaaatagtgctttttcttctctctctcctggttcattggcaagtccccagatggaaaagtaatataggcttaccttgttttcttgcccttcattttactgtgctttgaaaatattacattttttacaaattgaagttttgtgggaaccctgcatcaagcaagtctgtcggcaccatctttccaacagcatgtgctcatttcatgtccctgtgtcacactttgataattctcacaatatttcaaacctttttactattattctgtctgtaatggtgatcagtgatcagtgatctttggtgttactattataattgttttggggtgctatgtactgtgcccatataagatagtggacttatttagtaaatgtggttctgactactccactgacccactattcccctgtctgtccccttttctcgggcctccctatccctaaaacacaacaatattgaaattaggccaattaatagacctacaatggcctctatgtgttcatgtgataggaagagttgcatactaaatcacactttaaatcaaaagctagctatgtttaagcttaatgaggaaggtaggtatgttgaaatctgagataggctgaaatctaggcctcttgtgcctagttgtgaatgcaaaggaaatgttcttgaaggaaattaaaagtgctactccagtggacacatgaatgataagaaactgaaacagccttattgctgataaggagaaagttttaatggtctggacagaagatcaaaccagccataacattcccttaagccagagcctagtccagagcaaggtactagccctcttcaattctactaatgctgagagaagtgagaaagctgcaaaaggaaagttggacgttagcagaggctgattcatgaggtttaaggaaacaagctgtttccattacattaatgtgcaaggtgaagcagcaagtactgatgtaaaagctgcagcaagttatcaagaagatctagctaaaatcactgatcaaggtggctacactaagcaacagattttcaatgtagacaaaacagccttctattggatgatgaggccatttagcattttcatagctagagaggagaagtcaatgcctggcttcaaaggacaggctggctctcttgttaggggctaatgcagctggcaactttaagttgaagacaatgctcatttactattccaagaatcctagtgctcttaacaattaggcgaagtctaccccacctgtgctctgtaaatggcacaacaaagtctgtattatagcatgtctctttatagcattgtttactgaatattttaagcccactgttgagacctactgctcaaaaaaaatgattcaaaatattactgcatattgacaatgcacctggtcttccgagagttccgacaaagatgtacaaggaacataatgttgttttcatgcctgctaacacatctagtgtgcagccaatgtatcagggagtaattttgattttcaagtctttctatttaagaaatatattttctaagactgtaactgccatagatagtgatgtcatcctgtaatgaagctgggcaaaataaactgaaaatatggaaagggtttactattctagatgacattaagaatattcctgagagaaggccaaaatatcaacgttaacaagggtttgaaagaaggtgattccaaccctcatggatgactgtgagtggttcaagacttcactggaggaagtaactaaagatgtggtagaaatgtcaagagaactagaagtggagactgaagatgtaactgaactgtaatctcatgaggaacttgaacaaatgagaagttgcatcttatttattaagaaaaaaaagtggtttcttgagatggaatctgctcctggtgaagacagcaggtttgagagtattgagttcaattttttgtttgtttttgagatggagtttcactcttgttgcccaggctggagtgcaatggtgcgatcttggctcactgcaacctccgcctcccaggtgtaagcaattctgtctcagcctcccaggtagctcagattacatgcatgcaccaccacacctggctcttctttttttttttttttaagtagagacggggtttcaccatgttattcaggctggttgcgaaatcctgacctcaggtgatccacccgccttggcctcccaaagtgctgggattacaggcaagcaccactgcgcctggcctgagttcaattttaagataatttctactgtgggtaaaatgccatcaaacagcattgcatgccacagagaaatcttctgtgaaaggaagagacaattattgtggcaaacttcatcactgtcttattttaataaattaccacagctacctcaaccttgagcaaccaagtggtggccgtcaacattgaatggccagtagtggctatcaacattgaggcaagaccctaaccaggagaaagattacaagttgctgaaggctcagatgatgattagcatattttagtgaaaaagtatttttcagttagagtacattaactgttttttaagacatagtgtatctaaaaatataactgatgtcaaatacccacataggctctgataggaaaccctaggtcatcttagagagacaaataaatgtgatcaaatgtgatcagagcgaaaagacagaaagtggtgttcaccttaagcaaaaattttggacataccaatcatttagtttgtgataaaaattttaaagtgtcatgaagttgagtggcagagtttaagaaacatgaaagagggataatttaatttgaatgtgaccatgtttcaggctgggatttttcctgttgagttgtttaatttggagatatcacaccttcacagaagcacactgtttgtgatgtttcttgatgcttttaggaactcacaccattaattgcttatgccaggatccatgttttggaatacttttaggattttttttaacataaaacttttaatgatggtaactccatgaaggagttctgtcatgtatcacaaatgcagttcctatgtaagactaaatgtgaagttttatgagtattactgaaataagccattaatatctattaacctatttacttagggaaaatagaaatgttttgaaatccacactagtatgcaagcttctttcaattaaaaacagaatgcctagggtatgatttttgcctttttcttctgaaatagcatgtatagaaaaccactgtttttaattgattatcagttcagagcttagaccagcttagaacaagtgtctaatgcttatggaactatcatcttgactgatagatacctagcttagaaaaaaaaaatccgttgaaatccttcaagattgaggtcaagataaggttaaaaggcagtcatatgcgtggaggattcatttcaaacattctccattattagctttcatgcagaaatatctcttctcagtgacatctgggctattttagagctctgcagttataagattgcttatagaaatgctcattacactctccaatttaagtggcagaacatttttgctgatcaaatgtcctgaagaagcccttgctctcttgagttcgttttcagactttgatcctgaccaagcatcttcttgggctttagaatcactgatattatggacaggtctttttttctctttctaataaaactcccaaggattttgaggctcattcagttatttccagctttgcttgttagtgggctggctttacatttgttacaaccttggtttccacaggaaattagcatcttctagggtgaaagtattgaaaacaaacaaataaaaaataagatggctaatgtcactttggagaccagatatttaaaaaattcgaacagtcatgggaaagttgaagaatttcaaaaggaagtattgtagtgcaggtgtcctctttgccagcagttttgttttaatgttctagacatattttccactgggaaccaggaacccatgtttgctgcctgcttacccccatgtacttgctaactgtgccagctgccaacagaaggagatgcaactgactggctcatggatcaagagctagattgtgagctacacactgatgacacctgttcccaatgagccattaaagccatagggtgggcaggagttgagctgggagcatgagatactagcaggaagaatgctgatgaataattcatccggaatgcatgccaaagatttggcaaccaggattgaattgaaattaactccaaggtaaagctggcctgggaaaagatttgtgggttggtaggcattttgaggttatttgtgaaataggatgtgtacttatctattgaggacttctttctctactggttaaaaatactctgttgatttaatggtagtttgcactttaaatccttaaaaacaaatttaggagtacaagtattaaggctatttaagttaacaaatatacaagcaatcacattaaatgggcatataaacacaggaatgtcaagtactccagatgaaacttttacaaagttattattattactatttaagatatagtcaacctctttaagataaataatatgctctgttctagttttttcaacacttccaatagctcattttcacctagagccaaggctaaggcagctttctgggggaaaataaagtgctgtttaaactcgtcttaatccacctgccttattatttaatcagtacctaatttaaatttgaaggtcaactagaccaaatcatatgctcattaatattaaaaacaaaatcaattaatactcaggtgcatacccaggcttgtattcctttggaacaccatgtaagtcatacaattgctgtttttggtatttatgaaatgggatgtcacctggcaaaggatttattaactcttgatctagtttcagacctcttagaagtcaaaattgctgtaggaaaaggggaaagctagagccaagagtcagccttgccaaagtgaacaaaagagaaagactacatacaaggaagagaattcaggagtgtgcaagagatgagagcacaaattattccaaccactgagcactgtaggcttggccagtggtgtggactcaaaattgctctggaaaacggcattgtttctgttctttgcctgaactgttgaggagaaacaaaaccaaggccaccaatgaattcctctcgagactctccaggctaatttttctttgtcctattcccattcttggtgttcaccatcccccactaagcgtcctcaccccatcactcatcagagtgaggacaaggctgtcctgtgccctggatctgcattggtagagtgtctgaatatgcttgagtatctctgagttatccctcttggatattaggagccttaagtgtagaatgaaagtggctgtcctctgctagtatactgaaggggaaagaactaagatacattgagtgtctcctgtacacaatgctttacatttataacaatgtagtcttcatttctcaaaagggtcacctgagactcagagaaggagagaggaaaagggtgtgtgtgtgggaagtgaggataagaaaatgattttattatggttaaccgccgtacctaatacctacataagcttatacaatccctttaaaaggtagtatttatcatatttttaatataaaaattatttttgcttataagaataatatatctttattgtaaaatattttttaatgtgaaaaatatacaataaaagcatatagtcattttccctttaaggattaaactgtaggaaaataaaagtctttattctattgcttcatttaacaataatactgtgaatatttgcccatgtctttagaagttcctcaaaggcatggattttattggtgtcataatattttatcatctggttatcccacaatttacatagccagtgccctaatgttagataacttagttatttatagttttcttcctattacaaataatagaaaaatgcagtgcctacattttggataaatctttgtgcatatctatgatcagttcctcaggacaaattcctggattttattgatttacgagggaaaaggttaaaacatttgtattacttacatatattttcttattttaaaagtaatgtgtgtttattacacaaaaaaaataagcaaaagaaggaaggaaaaatatcactcataaccctggtgcccagaaataagcatatgtaatatactgatatataaactctcaatgtttttctaggcaacctcatacatatatggaaggggtttttttagggtattctgcaatgcataaaagtttgaacctgtctttcaaatataacagtacattgtaaaattcttccaacatcttttgatagtctatcatcatttaattgtgtattccagtaaataaatgtttatattcttatccagtctcaattttgaattgtttctgtggtttcagttttaaattccatactgaccagaaacatccttttaactttgtaaaatgatcatgatcatttctgtaagaaaattctagtaaatgtgaatgcatgcaaatttgtgtgttttctacaatgaatagttttttaatttttttggttgtttaattagtatatttattgtataaaattcaaataatggaagagaataaaaaatattacatataatcacatcacccagagacaactaccattctcattttggagactatctatcatgcatctctttctgaatatatgaacatacacagctttatgtgaaacgtatgattgtaatgcaatttttctctttttgttgcttatgtactcctcaccattcaatcactcagagagtaaaatacatggactaagagtctaatctcttcttccaactacttgggcccagattccaaccctaccctgactaagctgtgtgatctttcgcaaattatttagtctttctactcctcaacttgagtttcctcatacataaaataagaacactaatagcacctacctaaaaaatatttagcattaaaatcattcagtccatttaaacattttcaaggtgttcctggtacacagtaggaggctcaatttttttagtcattattaaatatatatatgtttattttacaaatattgtattatattccacataccttgctaaatcttgctctgctacaggcagccaaacttggtggaagtctctgccagtcagtttgcaaagatctaattaatccattttaaagctcacatgataatccatagtttggctgtaccataatttattcaaccattctcctatgataaacaagcactttttttccactctattgccacatagactatgctgcaatagacatctttgcacacatatccttatatgctgatgcttttatttgtatggaaagattccagaaatgtgagttctgctttcagcagtatgtgtttttaatagatgttgccaaattgctttcccaataggctatagcaattcatatttctatcagcaactgttatttttgttctttctgatttttgacagttcaatggatgtaaagcaatctctcattattacttttaaaaagtcatcagtgttattatcccaattttgcagataactgaggctcagaaagtttgaatagctggatcagtttcccaaaagctagaaccagaatttggaagccaaatctgtctgaacccaaagcccatgcattttctatccaccatgctgcctcccgtatcatgaatttggagcagaggactttctttgcctgagtgggtaggatgcaggtgtgtctagagaaggcagagggtgtcatgggaaccctgcaacctgtgcaaggtgagcagggattggaaccacggcaacagggagggcagtttggagctagctgcttggtccacctcatgaccttgaccctaacctaggaactacaatgaaatgagtacacagaaacctccagtcatgcccctgactagatgtaaaacccaaagcactttgtattatattcctggtccttttgtgcttccttagaccctgcacgtgccttacgctatagcccaactcagttatttgtcctttcccaaatgccactggtctaaagcattctgccctcacgctgtcacatccattttgttctttattctgtatatgaaaatcctgatcatttttcagagtcactctcaatatctttcttgccctaactagaacctttactccatccttccctccctcccatccttccttcttccatcacaaattatctgagcaaacattacattgacagaaattataacagataatacaggtgaggggggtggtgcatgcatattttcacctttcttgatttctgttctcttcattacaattcaccccatagagtagtaactatcctgcttctcataaattcgtttataaaccttaaatgttatcatgaactatattgtatcaatattagttatatacttatctaactcagtagaatgtagacctcttaagagtaggtacaaaatctcattcatttttatgttctccacaaagctcaatgcagggggccagcccctccacacctgtgggtatttcttgtcaggtgggatgagagactgagaaaacaaataagacacagagacaaagtatagagaaagaaaagtgggcccaggggaccagcactcagcacacggaggacctgcacaggcaccggtctctgagttccctcagtatttattaattactatttccaccatctcagcaagaggaatgcggcaggagagcagggtgatagtggggagaaggtcagcaagaaaacacgtgagcaaagaaatctgtgtcacaaataagtttaagggaaggtactatgcctggatgtgcacataggccagatttatgcttttctctacccaaacatctcagtggagtaaaaaataataaagcagcattgctgccaacgtgtctcgactcccgccacagggcggtttttctcctatctcagaattgaacaaatgtacaatcgggttttataccgagacattcagttcccaggggcaggcaggagatagaggccttcctcaatctcaactgcaagaggctttcctcttttactaatcctcctcagcacagacccttcacaggtgtcgggctgggggatggtcaggtctttcccatcccacaaggccatacttcagactatcacatggggaaaaaccttggacaatacccagctttccagggcagaggtccctgcggctttccacagtgcattgtgcccctggtttattgagactggagaatggcaatgacttttaccaagcatacagcctgtaaacattatgttaacaaggcatattctgcacatccctagatcccttaaaccttgattccatacaacacatgtttctgtgagctcaaggttggggcaaagttacagattaacagcatcccagggcaaagcagttgttcagggtacaggtcaaaatggagtttcttatgtcttccctttctacatagacacagtaacagtctgatcgctctttcttttccctacactcaacacagtggcttgcacatagtaggtcctcatatttgtttaatcaaaaggaataaaatggtgtgtacataacagtttctataatgctgttgatgatttaacagtttcttggagaatttaattgagagccttgcataaaattagagacttcacatgactctagaaagtatgaatgggaaattatctggaattttttccacaagaattaactagagaattggagatagaacctatcatagaaaatgggccactttttgctggtgcatccaatgttgatgacatcgaaggcacccctcctgaggaaatctcaactgcatgacccctactatgccccaattcagcaggaagcagttagagcggtcattggccaacctccccaacagcacttgggttttcctgttgagaggggggactgagagacaggactagctggatttcctaggccgactaagaatccctaagcctagctgggaaggtgactgcatccacctttaagcatggggcttgcaacttagctcacacccaaccagtgaggtagtaaagagagcttactaaaatgctaattaggctaaaacaggaggtaaagaaatagacaatcatctatcacctgagagcacagtgggagggacaatgatcggcatataaacccaggcattcgagccagcaacagcaaccccctttgggagctctgttttcactctattaaatcttgcaactgcaaaaaaaaaaaaaaaaaaaaaaaaaaaaaaggaaaaagaaaagaaaagaaaatgggccacttttaattctaatattatagccactttcccaaatttgttttttactatgattaagattcctaataaaagaaattccctttcagaattctcttgtttcagaagtaaattttcccaaaactttcacactgcagaaatataaaagtacattcaagcccaagacttttcctatttgttcactttcagactttgatattcttcccctctaagagaataaaataaacttcttttaaggaagtacatgtttatctactatttaatatagtttaaaatattcctaagtggcaattggaaggtaagtggtagttcctttccaaatacactttaatatgcatatattacttttccttactaattaagtatggctataataatatatttgtaacagtcaattccattacatgctctcttgggacatatttctaaagatcttgtgaataagacttgtaaacaaaatcatcctagactaggacatggagattatttgaatgggtttacaattcctttgtccaacatagtgttttggacctgaatttacatccaaataggtccaaatttatatgagcatccttgtgataattttcaaatttagtggccttgtttttgaattccttgggccaagccatgaagtctttatgagtctcaatttatttcaaattcacatcaccattgctgtgtggccttaggtaatgtttttagcttgtgcctccgttttctgatgtgtaaaaaatggaattgtaatagtatttatatcacagggttgctaaaactgaaagagttaatatatttaaagtgcttacagcagcttctcaaacatagtaaactttgagttggcagcattattgttttttacaattattgttattacatttatttgctggctttaaaatcctaactaccccaggtggcacagtgatatgtcattgaatcatcaccaaatcaagaaatctattgatatgctaacgcaggttagagaggttcagtaacaggtaacattcaaaatatttaacaacagatgttgcccagcccctgaccatcaagatgagcattctccagtacaccatagggcgtgcaccagttgagtattgaaaagcaaccagagtaaactatgccagcaagcagaaacacctaagaaatctctacctagcccccattccccagtggagatttgttaactgggtatcttcgcttgaataccagacattccattggtgccttccatagatttttctgcctgctttgtgttttattctcttatagataagacctagaatggaaggtgcctagtccatattttgaaatgcttttgtgggcatcacctaataaaagtaatcatagatcttcaaaaccagcacaatttttagagtgattcgcactctactctaccagaataattataccagaattgacctgattcactaggactagagaaacccaagatgtatacttacccaaccaaaaatgcatgaagtcttttctgtctacaaattaaaatcataatatctctgactcatatttttaaatgtttaactttgactcccaaaagtgtactatttttaagagtatgtatttttctgaccctgtcatttcttgttaattagtataaaaaataatatttggagtaactctttagagtatttccacaaaaggtggtgtgtctagccaatctgagtaaacacaaaacatttactagttaagtgtagtctatttttctataaaatatcatttagactagctcagtggttctcaaactttaatgtgcattggactcaaatacacattaatatttgaatttaaaaataaatactgtaatttaagagtttttaaaagtatttccagagttaattttgaaggtatgtatttttgacactaaatagataggactgtactcagggcaggtggattctgacagcagcaggactctcatagcaggatgaggaaggagggtgtgttaacctaacaggagtggcctctgcccaggagtctccacaaggccacagaaagcccaaagatccatgtgtcaccaactgatcattgtaaataaagtggacctgcttctttaaccctgtcaaaaaagacaaaaacaaaaactaaacaaagaggtggctctactgaaaaacagaaatcatgacaatagttcatgtagaatggcacgtcattgtattttgactgggcaaaaatgctggaaaacggcacttcctttgaagtgaattcagatctataagcaacacggtggggctcttgctcagatattcccatgtttaaaattttatagcatctttgatgatattaataattgttctttgataaatgagttcagcagtcaaaacattttggaaactacgaaattaggcaaagttaagtggtttttctgtaatacagaactcagagccttcagcatgctaacatgaattgaaatgctcaggggagatggaagtatggggcgtttcccacgttaattaactaaatgtgattttgtgaaattttgtttgcttgctcgccccttttttgttggtagaactttctaaaagtcatacaaaacacagtttgggaaaccattccacatcccatctggaagaactcaagaacgcagtttaaagttttgattttaagaaatcatacccattgttataatacaaaataggcaatggtaaattaccttttaaaaatggagtctggccttcttgaatttatggttatggagtggtatcggaaaaacattctctcaagtttcagaaagggatgtagcctatcttagtttttgacaatagattttcacaagcaggaatgttttgctctgactcttttctaatgacatttgttgtcagctattctgccactgttcctaggaggatatatttatctagacacacacacacacacacacacacacacacacacacacacacacaaagagagagagagagagaaagagcacaggggaagatgtctcaactgctgcattctttaataagaagaaaggaataattggctggctagtggcaagactggaacattttttaatcaagtaaaaagacaaggtttaagcattgatggcatttaatgagaagattgttttcctatttcattttgaaattagccctgttattttgcaccagatgtgtcaaattagaatggaaaggcaaaaattgattattttcctcaggcacaaggggcaatgacactcacataaacatatatgtgtactcaaaacaacatgcaagcgcatgcatgcacacacaccctgttttgagaacaaacacaaatatgtgcaaggcgatatttctcccagcctgactcatacataaaggtctcataaagatctatggttttcaaaaagcatgtaaacccattacactgtttcaatttacgtaaatcacccgtaaatgttatctatgccaaccacacctatcttaaacacggaatgaggcagaatcagttactaaatattcactgaattctatcctaaacgtgttatgtgatatggtttggctatgtccccacccatatctcatcttacattaccacatgtagtgggagggacccggtgggaggtaaatgaatcatgggggcaggtgtttcccatgctgttctggcgatagtgagtaagtctcacaagatctgatggtattatatgggggagtttccctgcataagctctctctttgcctgccaccatccatgtaagatgtcacttgctcctccttgccttctgccatgattgtgaggcttccccagccatatggaactgtaagtccattaaacctgtttttcttcccggtcttgagtatgtctttatcagtagcatgaaaacagactaatacataatgagacaaatatttctgtcaacctcttcctcagggtggatggttaaagccttgagaccactccaagtaccaggcactgggtttccctgaatcttccttcatggtttcaggaaaatcagaaaccattttttttttttatcagtactgcatctttctgcatcctgcttctggcttccagcttcttgcttcctgcagctttctgcctaccagaatcctagtgtagaccactctagacttggatatccaaccacctgatttatcatctaatactgacatataccagcatcagcaggaggaaaagcaggtaaacaccaccaagcatccagctcaagcttaccctttcgcacgtacatctccctcttctccacagtattgtccatggtcaaagcccctcccagattctttcctgggggcttctctcaagttggagccaacagagcacaccagactttaggggaacacattagttgaagagctgccctgtatcttccagagatggatgatattgtttgtatttccctaattttctctaattttatccaaccaatacttaggttgggtaacatgcctgaagccacacaagttgaaggctgaataatagatttgcatctaccaccatgccaccctgaatgcacctgatctagtctgatctcaaaagaatagttttgagaagagacttttcgaaaactctcccatttctgtgggggtttcttttccttatgagtctgctcatgataaacatacacaatggaatattatttagccataaaaaaagaaagcctgtcattcgtggcaacatggatagaactggagaacatgatgttaagggaaatgagtcaggaaaagaaagttaaacaccgcatgttttcactcataggcagaagccaagaaaggttggtctcatagaagtaaaaagtagttcaggatactagaggctggaaaggggagggggaagtggcagggatagaaagagatgtgttaaaggatacaaaattataactagatcgaagaaataaattctagcattctatagcattataggatgaatatagttaacaataatatacattatagtttccaatagccagaaggagtatattgaatgttcccaaaacaaagaaatgataaatgttccagatgatggatatgctaattaccccaatctgatcactctatattatacgtattgaaacatcaccatgtaccctatgaatatgaacaattattttgtcaatttaaaaatgaaataaatttatttcatgtaaaaatttagctaaaaaaggaaacacgcatacacataagttaaggcttttttgaatctcagctaattcagcaaggaaaaaatgagtgataaatacttgattttgtaaaaacgtttctgttttcaaggaaaatagtatgtttcaggttgtctgctgtttttaaagtcagtgatgcctagaactaaatgatagtatgttttgatttctgcctgctctgtgttttacagcagactcactctataatttttattacattttcattatttacatccttattccaaaatcatatttgaagtcgttccctcaaaactgacacctgttatgaagcaacagggtctttacataaattaataaatgagaatgtcacaatggaggttcagatagaaccctgattcatgaatttgctcactgttttttcttgtggcagaaaactaattatatttttgatcttggagttcacacatgcatgtgttaaacagatagctggctttaatgagcccaagattaagtgtttatgtttgaaccctatataaatgagcaaacctttatataagtcaaagttcagggtcatattaatatattgcacttgaagataatttcatttcataaattgggtaaaaagtctatcaccattaccagacaaagcaaagtaaacagatcccagcacactccttcttgaatgcccataataccctcaggtttccctccaagtaaaatgcaaatagctcactatagcctgttaggtgcacctttccattgcagactttccctgtctctccagtctcatctcgcacctctcccactcctctcattgtgcttctgcctcaacacagctttctctggtcatctttttggtaaagccacctccactaaacctccatctcagcctcctatgtgttgctttataacactcactgccatctctaactatgtaaatctttttctgttgttgtttgcatgctttcctcctatccatctcccactactataatttaggtttcatgagtggaaagacagtatttatgttgtccaccattttatccctgtgattagtacacagtatggcctacagaggtaccaattaaaatttattgacatctcttatggccatcaacagatatttattgggtcttaacttttttaagacattatgcaatattaaaaagaaaatacagttcctgcctttcaaggaatttacaatctagatggaaatatgagatatacaagcatgtgctacatagctaatatcagcaacaataatatcagcagctaatatttatcaaatccttattatacatcagtttctattctaagaactgcacatgttttcatgcctactgctctcatctatgatatgaatacaattaccatcccactttacaaatgaggaaagtgaagctcacagagcaataacatagctggcctgaggccacataactaggttgcagggcagcaaagaaagtcagacagatcatggtaagtgttaaaaaaggattacattgaaacatactaaggagcttagggttgaggagcatctctgcttggggttgtctgtgaaatgtgggtagagaatatgagatttgggctgggatgtgaagggtgtgcaaatggaaggtattctagttgggaaaaagagcatctttgaaagattggaagaaggacatcagaagacctattttaggtacaatgaataaacccaattgacttaaatgatggatccatgacccactcattaattcgttgctgacacacagtcctgattatggaggactctgaatatcagactaagaaatttaggtccaatcaacataaagcaaaaattttcaaccattgggtattgttcaggtgtaaggtggtttgggtagctgttacaaatgtaccattctctttcatcctccaattccttctcagaacattctctagttaggtcttcttcccagccatttctgtcaccatttgcagatgcttctctataagccaaattagatttcctagtttctaatggatgatcctttggcaagctataattttccatcttcctaattctgcccttcaaataaacacgtatttaagtatttgtataaatcaggctaatgctaaattatctagaacagcactgtccagtagaaataaatgtgaaccacaaatgagaactacatattagtagttttaaattttcaaaaaggcacactaagaaaaaaaaggaaaataattttaattatacattttatttaaccattatatccaaatagaatatttgcaaaatgtagtcaacataaaaattattgatacatgcatcaggaagaatagctaatggatactgggcttaataccagggtaataggctgatctgtgcagcaaaccaccatggcatatgtttacctatgtaacaaacctgcacatcctgcacatgtaccccaggacttataataaaagttgaaggaaaaaaaaactaaaaataaattattgatacaatattttacattctttgtatgtgtatgagctaagtctgtgaaacttggtgtgtattttatacttacagcatatgtcattcggactcaccacgtcacaaatactcactagccacatgtggctggctggtggctaatggattggacagtgtctggatttagattgatgagaatgtgttgtaggaattgtctattacttttagtctttaagctttgttcttaaggagttcttgcctgcagagtttgatgcaatcagtaatgatatgacctgagcctttcttgattccacagattagtttgttgttcttcttcttcttatgaatgcatgccaaccaaagagtttcagatttttaacagtaagacccactaaatctaatgtgaaggagagatgctttgaaaatatctcttatatcttcacatattgatggggagctcccagattctgtcactcagagagctgtgcatccctcctcatcacatgttagaggctgctctctctgtagtggaaaatctgtgggcagtccacgtgaggatacttatccaaaagtcctactttaaatgaaagatgtcttagacacaaaaacgaaatgcatacagatagatacaaattcagtatatgctaaggcaatggctctcaaagagtgttccctggaacagcagcagcggtgtcatctgggaacttgttagacatgcaaattctcagtccctaccccagaccttcaggatctgaagctctggggttggggccccacagtctgtatgctagcaagcccttccagggatcctactcctaatgtacactaacatttaagagtggctgtagtaacaaaataataagttggagacagagtataggagagcggtgaatgttttatgtttgaaaaagaaaaaaatactattcttactcttcaaaaaagatttaccgtagaatctgctgatgtggccagccttcagagtgcaattaaaattcactttcacatgcaaaaatatgaatgaatttcacaaacgtaatgttgtgcaaaagcaagaagacacagaaaaggacaggttatgtgtcattcaatttacgtcaagtccccaaacaggcacaacttatagatgctgttgagagttagagtggtgatgattagagtgagggtagtggctggaaaggaggataatgggtagaaaggaggaaaatggtagacatgttctactgcttgagctggtcctggttatgcaggagtattcattttgtgataattcatcaagctgcacacttaagaattttgtactttaggtatgtttatattcaacatacagttaagaatttgaattttttacaaaaattatgaatgcaacttttgggaaattttttagtaatgtgaaaaacatgcactttaatttggcagtctcacagttgtttctcctaaataacaaatagaggtttacctttaaagtgacccacttcatacgtctctaggttggagcataaacatacataaccttgatgctctctcatgacctctgtttaattaagatccttccctccctcttggtccctgctcaatgccatcctctcctgttctcagctgactttggactaatctttagcaactagttattaagtcattactccaaatgtcacaagtgggatccttccaaggagctctgcattttaaaaagtctcaaaaggcattctgcccaaagaaggaagtctcctctgggaagtgtgaggggtcagggcgggtacttaggaacagatggccttatctggcccccttatatctcccaacacggtggccatcagcttcacctaccaacgaggctggcctgatctgattgcatgagttttcctctccagtgatgtagggagcagtggggtggtgtgggtgtgccaagaggcaggggatgtgctgctggcctaaagagatgtggtgttccacacagaaggactaacccaaagtttttgctggttctatttgcaatggtgctttatcagataaggaccacaaaataagaggttatcacaaatatgtttgaggattattcagtccttagattatagactcttagggaaagctacttcttattcttttcatcaatatgagaacatcagagacttacagttaatgaaatactctcattactttttggaaaatttatcaatatatttctctattatacacagaactgatattccgccagtacactctaatcctgctgcaagcatttttaaaatactgaaacatttacatagtgtccggcaaacaaagattaatgcctctcctttcaagtgacccttcccaccacctccctgccatcctaggacaccagcagggctccacggccttgccccacagctgtggacatgtgcattctgattagccaacaccctaccagttattaagtgttttgaatatctctttggattccctcatgactactttatccgtgctatacaaacactgacaatgtggtgtattttaaggatcaaatgaaaatgtgatgccagagaactgaaatggagaaagagaaccttggacttgggtaaaatcccatttccaaatctattctgaggccttcttctgatgtgcagcaggtatactaatttgaatggctgacattcaaagggaaataaaccatccaagtatccatgtgcacaaatgcatatgtcagtgctgtggacttcgtgtttgtcccctccacccccaacaaattcatatgttgaagccctaacctccaacgtgatggtatttggggataggacctttggggaagtaattgaggctagatgaggttatgagggttggtccccacgatagaattagtgtccttataaaaagcaggcacacacactgaggaaaggctatgcaggaacgtgaccagaaggcggccatctgcaagctggcaagagagccttcgctggaaaatgaactggccagcaccttgatcttagatttccaacctccagaactgtgaggaataaatgttggttaagccacccagtctatggtattttgttgtgtcaggccaagctgacaatatagtcattgcgttaggaaaatctattataataatttctagaactcatagttaagcctactctaataaaataatagcagattaaaacaaaatccttctataattgaaaataacacttttaatttaatcttaagtattcttcttaaggttcttgtaagttttttacagcattttgttttaacacgtttttctcagtttatgaggcaaaacattgttcacattatacaaatacctctgtacaccctatttcctgtaataccagatgtcccctgatttttttctaccatcagggtgatatttgaaaatgaaatttactgaacctgttttactttgtatgaccaggctgtttcgtctttaattttctgtaagttaattggcataatgcctttcagcccatgtataagtttcgtgagtactgtacagtttgaaatgactaaaaaggtgagtggtttttacaaatggatctagaataatgccaaacttcttaaagtaatatttgttttttgtttgtttgtttgtttttgagacagactcgcactgtgtcaacccaggctggagtgcagtggcacgatattggctcaccgcaacctccgcctcctgggttcaagcgattctcctgtctcagcctcccaagtagctgggactacaggcacccttcaccacacctggctaacgtttttttatatttttagtagaagcggggtttcactatgttgaccagtctggtcttgaactcctgacctcgtgatctgccctcctcagcctcccaaagtgctgggattacaagcatgagccaccatgcccggcccaaacttcttaaagtactatttgtaaaaaaaaacactttagaaatgtttaaagtacatatacacattaaagttaaataatgaacttgcaagaaccacaaagtgagttagactatttcaggttatacaaaagtgatacacactgaggttgcttggttggcaggaaagtcagagaatgaggaaaccatttcagcagccccatgaactggatcacccaggaggcaacagccattccatcagttcctctagagactcaacaactgttctagtagccatccactcaaagagctgatcaattcctttcacagttaagtgaatattaattctctcctggtatgtggagctctcatgtcaggccaccttagtgtctgttggtcaagcaagaggtgtctgcttagggcctattactcaccagtcatctgtgacccagctactagggtcatacagtgcaaaacacggtaaccctttttcccaacttgccctaattaggtggcagaaactttccctaacactccataattaaagacagcatggtgtgagagagcagcaggctagaagtcaggagaataggatgagcattctcatatttgctactaagtggtaggagccagatgaaggactatcttggttttctaagtttcggatccacaaaagcaaatcggggacaagattgtgggtgcaaaaggtgaacccactttttatttgggaggtgttctcaggaagcacaggtgaggtgtgaggaagtgggacagggaagggaggacagcccctaggggatattaatgatcaagttactgctgagggaaactgagactccgttcccctaagagatgtatagagtgcattcagaaacatctccctgaagggtgaggaagctggggtatttatctcccaaatccttgggggtccagagctgggcattaattcctggttacttctggcccatccaggacaagagtgccctctgtactggcaccatcggctccaacctcagggatagtccacagggaggtgggtggggcacgttggctacaaggcttagcttgcatgggctgtttttgttctcactactctagctctagaaagatctagcctctctagatgtcagaggtggagatagttgggaaggagtaacagaaggagaagagtgaatccagcctttgaacctttactacaacaatttataattttttagaaagtccccaaattggatttaattagaatgtccagaaatagaaacgattgtaaaatagcatgcggtagagccacacgatgagccactctgcagccacccatattttaaaattatattcaatggcatggagaaaattgaagaaagaaaaaaacagaaaaagtaagcacatgggggaatgggggcccatgatttcgcctcagttctttctcactcaggtgagtttgtggatccttctaggtgtcaggaataaattgatgttcgggagaagtcatacaggtctttgaagctcaacatagtatctcccacaaaggacccaaatgcttgtctcactctccaaacaggtgcctttacatttggaaaaaaaacccaagttctgagccaacaaggtaggttatatcttagtccttgaaattcttggatctcagcagcaacactcagccacactttccaagtgtctggctaaaagcaatctgagcccagcagttgctgcatttatgaatctggagagaaattctgtctcctgcctcaacttctccgtaaaataaaataactcagaagcagtgacccgatgccaggctgtcggttcagagctaaggccacaaaagcctttatcatttttcctaagaaggttctttcagtaatacagtcaccatgacctttcattatcagatcaaattaagccaagctgtaaataaaacacttgtactctcccagatttatagatgaacattttaacagaattccaagccctttacattcagaaccatagatacttctcacacccatggcctggtaagattttattttttaatgttatcaagagagcctgtggtgtgaggcttagtaagagagagggaggcaagatgagaaagaaatcagaaggatggaggtcaaggatactgaaataaccaagtcacagacaactgaaaataagagcagatttgcctttgtttacattgccaaatgggaaaaattaacttgattgaaagggtaattaagcatttctttttccatcatggtccaaaccagcttcatattccagctgttccgttttacattatgatgattctttgttgagtcgctgacttaaagacagccagtgtggcactggtgcacaccttactgcttctcccactatcaacctttattttgtaagtacacagttaaaatctcagtgagaacggtccaactcaggtaggcggatgatgaaggaagagtgggaacatttacaaagaagtgttgctggaacaaagagataatttgagcaaatcagattagctttgtaaggtatcttagagagattatccagctcaacagctgtagttcctaggtgcagaaactgagattatgtaaagtgcctgaatttccctagagttatgaagcttgtagctctaaattctgaatcacaaccctatgactgcatctctcatttgctagtattttcaataacaacttgcagaagaatatcaccttcaatgtaagaatgagctatttcacaccagtttattgtttgaaatttgtgttttctaatagaaatcaaattaattgtgcattatggtagttttcccagccatgtctcaaagactgttagcacacagggtgatgatccctaatttgaaaatccaaaatctgaagcccttctgggcccaagcatttcagataaggaacatcaacctgtccctgaattccatatctctgggaatgattggccatcttttaatggaggttaatgagaccgtaatgaagacaaatgaccaactatagctcatttgggtctcctgatgccctgagcaatgtcctgtctgtgggccctgttacctttcaggtaaatatagttcagccttatttatccagcttcactgggaccaagcacagttcagatcatcagcatcagaatagtctgggaatgtgttgcaggatacttttttcctatataaaagagtagccgctgcaaagtttcagtaagaacattatctgctggagagactctagtttatttagataagcacctggttcagatggaggaaaaattactttgtcctaattgctccacataataagccagagattctatagagcaggccaggataaatgttttgcatagtataatcaaatcagttaacgagaatcaaagaaaatccaggtgatggtgtttctgtgcaatttttgcatcaagctctggtactcatgtgtagacatttacgcattacagagaaagactattttatgtgtaggtttttgtgtatagcagtttttttttggttcagacccattagaagttctacgccaaaatgacctgctgtcatcactctgaataatagtcaggggcttcctctcttactcggtgcgttttttagaccacctagcttgaatagttatcttcaaagacagtgaatcatgcagttagttttatactttatattcacctctaattttggtgcaacatggttttttgccagttggattgtccctctcatttatttaacacatctctatatttgctggctatttcctcaaatcaaatctaccttaagaattcaagatttgccatcactgattaattcatggagcaggaatcaagctcagtagctaattcctcaaaactggtctggaaaatcttttgtaaaatggcaatgtcatctttcaccacagcttaaatccatacatgtaatattctgtgtagatacgtgtaattgactgcattaaaagtgacctactttttggaatttctgttttatgaagtttttcattttattttaatctattttaaatattcctttaaaccttttcaactttctgagtgagggctttttcttttttaatttatgaaagtgtttcttttttattcttgttaatcttaaaagcacatctatctacagccctttggcttgaatatttgatttaatatttgcatttgaaaaaattctttaaatatgacattgaccttaaagattttgaaagtcagaagctacatataaatttaattccagttctctgttattaaaataacattgactgaatctcagaattaggtgataactgttttacatgtttttgaacattaccaaatgataatttttagaattaagtaaaatgcaaatccaaggtgctgcaagagttgtatatgcaactacatttttcagggtagtttatagaacttacatggaaataataagttattttagtgaccatatacactggtgtcttcgtccaggctcctacaacaaaataccattaactgggtggcttataagcaaaagcaatttatttctcacagttctgggggctgggaaatcaaagatcaaggcaccagcagattcggtatctggtgagaactcactttctggttccttctaactgtgtcctcatttggtggaaagggtaaggggactctctgggacctttttaaatctttttataagggtactaatctcattcatgaagcctccacctttatgatccgatcaccttcctaaggccccaccccctagtgccatcaccttagcagttagactttcagcttaggaattttagggggacacaaatattcagaccatgaatatatgcattttctttctccatcattatgagtaaggatttcacgtacatattcaatgcagctttcatcaccccctaagcagaaaagctgcactgccacttcaaacctacaactaaatataatgtaatgagatccatgattgaaaacatacagaatcaaatctaggcctgctaaaggttatgagactagaaattcagagagccctattaataaagtaactttcgtggaaaccatcttccataggtacctgcttatttgtgaatattgtcatgaggttatatagtacttttccttctactttattgatgtgtgtggaggtagaaccatttctggagcaaagtttcacatacgtgacagtgaacttgtgggtttggtggtgggtcgtgctgatatgacatccttgtcatcacataaagacatgtatatttgtgtgcacacatcgaatatactgcaatggcatgtttctaagatgcacattctttcatatattttatttctaaagtcaggacatgtcttagaattgataatgtgttatagtgcatctggcagcattttcttctaatactacataaaataatagtgcaaagaacaactgatggtatcttggacgcaatgaaatgcattatgtagaaacatatcagaaggtgcattaataatgttaaagcaactccccaagaatattgaaattacaaagataacttatttgctaaagacacagattttggtgataaaacagatacagtctggtgagtaatttttcaaatgcttttcgcccatcttatgtgactcattagatcataaacttgtaaactcgatgtaaatcaccattgaggagacgtttcttatgtaatatttgggcagaatcataatgtttatgtaacattatgattaacaacagtgaattattattcagtgtaaatgaataaattttaactaaacataaaatcttggataattctataacattaatgttgagagaaattaatgtggtacaagactaaatatcaaataatataatttttaataaataactaaatctaaaacactttcaaatttaaaatttagcctgatctatatacctttttaaatcattgtatatttttagtgttaatgtgagaaaaatattcaaaatttttttttcaattgacatcttagctccaaaattaaaagagcatattttaatgggagctggtttaaaacaatttgacataagttagataacagtttggcaaatgtgtctgtgctcagttttgcttccaaatttggacttttagacttattgtcagcctcagaaagaaataagaagctgtgcagataattaaacatttgccttgggggaattatttgtagttaattaaaaccacacacttcgggtatatattgatacttgcttcactggttattaaatttgaatcatatgttaactacccaggtttctcacttgtccatcaaatgttgcttgtggcaggttcaagaaacaaactttctcataatattccaagccatattgtttaaagctatctcctaattttgagaggaaatgaatggagagaaacagagggagaaatgaaaaggaaacaaacaaagaatagtttattttagactccatctgattcagctctgttggggagttaaaactcaaccaagtgacacaaattcagtagagaacacatttgtaagtaatcaaggtgttgctgtaccacccccagctttctccatggtcacacgcttacaagattagcttatgacttttagatatctttggattgctttcctttcagcagcatgaaaaatatctactagactataagctccatgagggcagagatttggtgttttgtttcctgttggctccccaacatcaagtacagtgtctgggcaggtgtgatggctcacacctataatcccagcactttgggggtatgaggcaggaggatcctttgaggccaggagttcaagaccagtttgggcataattacaaaatcctgcctatacaaaaaattagaaaactaagtgggcatggtggcctgtgcctatggtcctagctactacagaggccagaacaggaggatcgcttgagcccaggagtttgaggttgcagcgagctacggttgcagcactgcatccagcctgggtaacagagcgagaatctgtctaaaaaagtgtctggcatatacttggccattattaaatgtttggaaaatgaatgagacctacttgctgtcttcctgttgatccattcacaggatcattccagtactttttaaagagcctccagggaggcctaaacatttagcaaggagccctttgtagttttgcaatagcccatagtcacagaatccttttagccatgttaaacatggatatgtttaaccatatcctataacaaaaaaagataagtgtacaacgattccatgtttaaatgtgctaagcgagggagggaatgaccttgcagagaccagaaggtctgcattccctctatgctattgttctactgttatggttcccgaggaagatgaacttaattaccactggatttcaaggttctgtatctgactttttcaaggactcaagactcccatatgtgagcaaccacagtaatggaagcattaagaacattaaaattagatagtcctttaatcttcttcattttgccttccttttatgtcctttcccatagttctaagactttccctgatgcaaaaagcctgcttttattttcttatttgttgcaaaaagacatcccagctagctacatctctacctttgtaagctttgagcagatatctcacatagtatggggggaaaaaaagcgcctatttattggcaaacatatgtatttgagtggttatttttaaaacgaataaattctatttttcctcaaacataaatctatcatgttagtgctgaaagctgctctgtttccaagttaaaaatgctgaccaaaggttttgcttgtttgttgttagattttgcaaaggatgaaaatattacaaaaggcggtgaagtgacagatcattctgtgcgtgaccaagatcatcccgatggtaggttgtgaaatcctttattagattttcttttcttctgctgggaaacagaaaaaaaaaaaaaaaaaaaacccacagacttgaatttttctggaaaaatattgaattccaataacactttattagcactgaataccagttgatcagtagctgccatctttagatgacacttttgctttccagaatcctcatcactcattacttttgtgccaggctggcttcatttattttgtttattgttacttgtctgaattctataagcactgggtttgcaaacactgagatgaatgtgttataacaatgagaataaatattttcattgaaaaacatggagaataaatgcaggggattaaatccacatagtcttgggatatcaagaagggagtacataacaaacagaaatgaaacaatctttagaaaaataacagaaaataatttcctaatgtaaaccagttcttccacccaaaacatgacagtacacattatatttataggcaaaggaaaaactcagaacagacatctgcatagcttcatggaatttctgaagataaatgataaagaaaggcttttcaagtgtagtcaaaatcaggtagtgattaaaaccaccagagtcagattagccttaaccttcttcttccacaaccctaaaagctagaagaaaatggagtcacagtttccagagctcaaaagggcacagtttccatagttaatgaagttattatttatacatgaaatcagagcaatattttctcaggaatacaaagattaagaaaacatgccacccaggtaccctttctgaataaactaacagaaggcctgagcaaaaacaataatatagaaaggaaggcaaaactcaagactgaggaaggcacattcgaaagggactatatggtaagagactaattaaatgtacaaaaatgttgaaataattgttctatcaaataattttgaaataacccttcataattaggatgaaaatgtcttacctaaatatatgtctttaactttgaaatttatagtatgtgttgtttgaaaatgagaaaaaagacagactagctttcaataatgaaagtctaaataatttagatcatttctactaccgaagacaactagacaaaaaatacatatatttatatattataaacatataatattatatattatgcgtatatatatatatatatatatatatatatatatatatatatacacacatatacatatggagagagagagagagactgtttaaaggcatcagtgagctaataagatactgaagaactgtaaagctgagctctgggaggcaatgaatctccagatatgtgagcccagaatttgaagctctttttaccttagggcatttgctgattctacagaaggtgtctggagctccattgctgaaaaaggcaatgaccccgataaactctctgttttggggttgaaaccccaaagatacgtaacctagcaggaagaatgaacgagcagtagattggcggtggactgcttcccagcttcaaatcatctcaatcctcacattaggttaagaccagtccagattgctagtcccctcaggcatctaagaaaagcaaatgtaaaatatttactaggagtgaaaaagagtgttacaggcttcaaatcatttatataaataatttgcaaaatataatgtccagcacacacataaaaaataccccaaaaaatgagggaaaaaaggtaacatgaaaaacaaaacaataaggcaagagaagttcatatgagctgaaaatattagttatgaacacaaagtattagataaatatgttgagtatgtataaggagataaagataagattggaaattttagccgagaactagaagttcaaaaccaattttacaatgaaagagtctagaagtaaatgatgctataactgaaattaagaattcaatgaatgaatttatgactgaacatcatattagacacagccgaaagaagatttgtgaactagaagttaggtcagaatatatccaaaattacagatagtaggggaagaaaggaaggcacacactgaagaaagaggaaaagatattaaggatcttatgataaagtctatcacaagtacagttggagtcccagaaaggaaggagagagacaattgggcagaagcaatagttgaagaaatgtggtgagaaatttcccacactgatgaaggacatcatgttccaaaagccctttgaactctaagcagaataaatataaataaataaataaatccacaaccaggcccatcatagtaaataaataaataatagaaataaatataaatattataaataatataaataaatccacaacatgacccatcatagtaaaattcctgaaaaccaaagataaacaaaacatctaaaaagctatcttcaagcacttggactgagagctgacttttcaatatgtataatgaaaataagaagataatacaacaaaatagctgtgaaccaagaattctaaacccagggggaaaagtatgtttcaagaattcaaggttaattaaggacattttagaccaaaaagaaaggcacagttcatcaccagagaattctggtgttctgcaagtagaaagctattaatcccagatagaaggccaaagataaaggaaggaattaagggcaaggtaaatggtagttactggataagtctagataaatattgatggtataaatcaatactgacaatgatgtcttgtggagttaagatatgcataacattaaaatataccacaataatggcatttattggaatgaggtaaattaattttaagtgttctaatgtttttccattaagatgaagagtaaaagtaccaattagtgttgaaactttgtaagtctcagtggcccctgagagtcaggaaatgaggtgagccctgtgattgcccagctggctgcctggagagtttccaggctgtggtacagagaggaggaacccagggagagcccagcaaactctccacgttgaggagacagaggtgagagtcctgggaggccaaggtagctaacgtttgcaaggtagcattctacagagaagagagctccacaaacggaatgctcagaggtctacagaaggaactcctcagtcttcaactgggtaggaacactagaaaagatctgagagagtgataactggagcttacatagggctagaagaagtgcctgttcccaccagcaagactggaaagcctcaacattcataaagaactctgaaggtttttgccttagtagcagagcaaaacaggcaatagactaaatgctcctcatgtcctccccagtagagcttaaaagtgagacttgaaaggatcagaatatttctgagtaacttaactgcattttagaatgaagctcaaaaatatttataaaaattataaatatatctcatacccaacaaagtaaaatcaacaaaattaccaggcatgcaaagaattattgcaagacaactctccatgcatctttcatatttctgcatgttttgtgagcagaggcactgcttgtatctttgaaaaggatcatgtttctcttcaaattaaagagcatacatacttattgtgcattttaaaaggttcagagaatcttgagattctctgatatggtttggctgtgtccccacccaaatctcatcttgaattgtagctcccataatccccacgtgttgtgggagggaccctgtaggaggtaattgaatcacaggggtgggcgttcccatgctgttctcatgatagtgaagaagtctcatgagatctgatcgttttataaaggggagtttccctgcacacactctcttgcctgccaccatgtaagacatgcggttgcacctcccttgccttctgctgtgattatgaggcctccctagccatgtggaactgtgagtccattaaacctctttttctttataaattacctagtcttgggtatttcttcatagcagcatgaaaatagactaatacattctctaagttcaagattcctcctctatgatatcacccactgagtgtgcaggaatcagctggtccacctatggcaccatgtgggaatcaggactcagagaacagacactaatactctggttactgtgatttctctgaataataaactgtcctttatctttgacccagaagtctttgtcttctgtcagcatccatggaactgtggctcaagcagggtaaaatctcagagtcttcatagttcttgacaggaagcaggaaagtatgatgcacaggaaaagaaaagttgataaatggaactcaacccataaatgatgcagatgatagaattaatatgaaagggcatgttaaaagttgttataactctgttccacatatttacaaaattaaaattaggactgaccatgttaattcgagacaaagaagttatagaaagacccaaattgaatttcaaggaattcaaaacacagtgcctgaattaaaaattatacttgatgagaacagtggcagattagatactatagaagaaaagattaatgaacttgaagatgaagcaatagaagctatccaaatgaaaacagaataagtgactgaggggaaaaaaaaagagcatccatgagctatgagacatcttgaagggtggttctaattacaatataaatgaatgtgaatctctgagggtgaatgtgggagaaagggacagaaaaaatatttgaagtaaaagtgattaaaatgtttcaatgtgatgaaattatcaacccacatatgcaagaagttctatgaccccaaagcataagaaacataatgaaaattacacctaagtacatcataatcaatttattcaacaccagcaataaagagaaaaatcacaaaaacaagcagaggaaaatgacaagttacatatagaagacaaagataaagataaatcaggccaggcacagtggcttacgccagtaatcccagcactttggaaggctgagttgggcagatcacttgaggtcaggagttcgagaccagcctggccaacatggtgaaaccccatctctactaaaaatacaaaaattagcaaggcacggtggtgggcacctgtaatcccagctacttgggaggctgagtcaggagaatcacttgaatccaggaggcagaggttgcaatgagcctcctgagctgagacagcaccattgcactccagcctgagtgacagagcaagactctgtcaaaaaagaaaaaaaaaagataaataaaaggtcccaatggaaactagaaactacaatgacatgcaaaaacatgatgaatctcacaaatgtaatattagagaaggtatgaaagcatatattatttattatataatctcatatatcaagttcaaaaagcaggaaaaaaattaacatttagaaaggcttgtttaggtgataaaatgataaagaagacctaggtactgatcactgtgacagtcagggttttgattaaactttggtgattggagaggagatactgccgggagggggccatgagagggctgcctggctggatggttatcataaaaatatatagtttctgtatttgcatttggttatttaattgatatctctatattttgtctgtgtttctatatatttgtcgcaattttataaaattgtctaaaagaggaagaaagaaaaagaggaaatgaggaagggaatgaagaaaggaggaaagaaaagaagcatcagtggcagaggttgtaaaactagattatagctagaagaaggaagagttgcacattagcctgactccataaataccactcaaaaactaaaaatcccagtgttatggattctgacaatatgttacctttcagaatatctctgaaaaattgtacaataatcacaaatagaattaaataataataaaattaaaagaagataccttactttctaaatttcccaaagagatcacatgacagtatactcagcaatgcaaataataacaataactagcagtgtaacaaaagcctcatgtatcaaataagatgacagaaacacaagcaaatgcttataacagtaagtgtaattaggttactttaataagtgtaaaagccactcagattgacttaaactcaataaaaaggtaaagctttaaaagtataaagttagaaaaatgtatatttgagaaaggagcatcaaaagaaaacatgaagaactacttctatttgaaccaatctattcggttagaagtctagcaaaaaaatctccagtgacaaagagttggttatttgatattgataacaatttaaattcctgatgaaatataatagtgatggggctttttgtgtcagatgatatggcaagatacaatacaaataaaaacctgttgaaaatgcaatgaggagttcccagatacaatattattagtcaatgacagaacaaatagactacggatgacatggactgtttgaaaaatgtacttagcagggtagtccttgctataggaatagacaggctgatcaatgaaacagatgaaagagttcagaaacagacccaagtagatctgggatttcagtacatattctggccgacatttcaaagacagatgactcaatcaatggcattaaaacaactagttggccatttgggaaaataaactgaatcccaacctcattcctttcaccaacataaattccagaaggagcagagatgaaacatagaaatgaaactataaaaatactagagtaaaagaaccaaaggttattattcagcactaaaaagaaatgagctatcaaaccatgaaaagacatgtaggaaacttaaatgcatattactaagtgcaaaaagccaatgtgaaaaggctacatattgtatgaatccaattatatgacattctggaaaggcaaaaccatggacacaatgaaaagatcagtggtggccaggagttgtgggggtggggagggatgaataggaggagtacagaggatctttagggcattgaaaatactctgtataatgcagtaatggtagatacatttcattatacattgccaaaacccatagaatgtacagttccaagagtgaaccttaatggaagttatagacttcagtaggagttacatgggatatctctgtaccatcctctcaattttgctgtaaacctaaaaccactctacaaaaatagtatttttaaaaaacaacaaaataaaacaattacaggctgtttttttaactgtgagcacatacttgcagacacaggatggtatgcatatgttatgaaatgcaggcatacacatatctgtaatgtgtgtgcatatgtcagtatattgcataaaagaggaaaataacaaaattgtaatagataaatgttgacataatgagtaaaggttatagtgaaattaaaaatgaaaactagtgggaaaatattctcacccaaatgacaacaaaagagctaatttttttatttgaaaaaaaagtgtgtgtgaaccagtaagaaaaaacataaacaatctaagagcaaaacggacaaaagactccattataattcacaaaagaagatatacagtcattataaatatgaagagatgccctatctctttattatataaataaatgcaaataaaatagtatcttctctttttgaactagataagattaagtggagttgaaagtacacaaaattagtggaaatagggtttccaaacacgctcgcataatattcgtgggagactgaaaggcataacctcctcatcagcaattttgggaaaacctaataaaaggtagaatgttcatactttgatggaaaaattatgcctcagagatttatcctaaactaacacccacccagagtatggagatatttatttactgaaatgttcattgcaatatgatgtttaatggcaaaaaaaaagtgtaaacacctgaaagctcacccataacgtggaatattatgtatcttttaaaaacaagatttccaaattaattgtaatgacagaggatgatgcttactaaaatatgaaataaaaaagcaggactcaaagtgtaaatatgttttgatcccaggatatatttacatatttttgcatatgtctgcatctgtgtgtgtatacacacatacaagagaaatatgacaactcacaatattaaaactggctatcccttagttataaaattatccacaattctcaatgcttatatgcatttttagcgtatccataaggaaattgcatttcttttgtaactacaaggcaaaaaataatttttaaaaataacttacaataggaaagtaagttttattggctctaagagaaaaccaaggatgtctagaagataatcaaattcacactaatctaggcttaacttttgttcttaatctgggatatttttagaaatttttataaaagtacagttttgaatattagcagcaatcaactttcaagtttaacaaaaagacacaatttacatgatttcttcaacacaagcatcaaagaaacagtctttgttcttaagaaaacttgagcatctaataatctgcaagcaataaaattatattgttgttgctattgttcagaaacagtccatttacaaagtgagttcaggtttatcccctagaaatgcttcattctagactgatgtccccagaccaatttttatgcaaattaattaaagctaaagcattagcttgagccaaacttaattaccaaggctccaagaaacaatcatgtgatctatttctaaagaaaagcgaatggatttttggattatctgttctaatggtcccctcccataagtatggctgattgagttcactgtatgaaaaatatatacataaactgtggaattctttgtgttcttttgtttcctcagccaggagggattagggcagaggacagtggggagaattcaactagtccgaatgtgaagagggaaacataaagcttgcccccatggggccaagaaagcaggatggaatgtgaaaggtctgcatgcactgaggagaaaggcagatgggctggaagccctgggaggagtcattaacacacagcaggcctgggtgcggtgcaaggcagtcaggcataccttgtctttgtgcaatacgccaaagcctgcctcgttttcaaagctggacaccttgttttgtttcttcccccatttttaattaactttatttaagaaaaatgagaaaaaaaattctatttcaagaaaagattgtcaaaatatgtaaagcacacaggtgaaacagatcaagagtagagacaggtttagagggcaaggaagagaaatattccaagagatatttgaaatagcactttatcctcaaagtgaagggtcaagccttacaagtcacagaaactccctggtgttcatcaacagactcaggttgccacctcaagcaggcccaccttttcagcagtgccccaggctctattaaatggggacctgctcattcttgattgaattcctctgaaaatttatcaagtggagcactgggaccaggggacacacaggaatacagattttggccttttcccctctctggatgctctactctttcccttcatgatatagacgaagccagatcacaaatagtacgttaaaggtccttgcaatgacctggtgcgatgattaggttcaatggccagttccctatagcaacagtgatagagaatgaagctcactcagtaaacaaacagtgaaggttccctctcagtatcatccacccaataaacaaacgtcaatgtgactggaaacttcatctgaagacatagctatgaacctaggagattatctcgttccacagccttttttcttttcaatagatgatgaaattaaaggtcaaagaggttgtgatttgcctaaaacatccagttatctttattcccattccagggttctctgcaacaaatataatgtgtggagtgcttagtagcatacaagactttaccttgttgttaaaggatgcaagagaaagtaagttatagtccttaataactatttacagaccttgatgagtactctaatacaggtccaattaaatagacattgattgatgacttcttattaaatgggtgctgggcaggaaaatatgaataaaacaaaatttctctcttaatctggtaagagagacaaagacagacacaactacatcacggtgtgatcaggatctggatggtaattaggaaaattcatgtgtatatatctaaagagtcataaagatatacacttaaggtttgtacattttactatatgcaagtagatctcaattttaaaagctaaaaagcaaaataaagacatttccaggcaaaacaaaaagaaaagagggattgtagtcaggtagagctggttatgattcttgaaagcagaactgagatcacagcacttactttccagaggtaatgtgatgattagagattacgtgtgaagtatctagggacagtctggcatttttatgggatcaataatttgcagattcacttacatcttctaggccagtgcttctcaaggtttaacttgcatgcaaatcacatggacatcttgttatacaatgcaggctctgattctgtaggtctgtgatgaggcctgaaattctgcatttttgaaaagctcccaggtaattccagtgttgcttgtccatggaccatacttttgttagggacaagctgccccaggaccacccccctccccaaaaacaatgcagctgacccttactccgaatattctgcagctgcattcctggacccttatctaggcactacagcaaggtcgccagacttgcttacagccctccgggtggcatgggggaggtcatgagaaacgtggataaacctaagttacaccctcttgtaaattcctatattgtaagctggtcacgagatgatatgtggtaaagttaaccgacaaagaaccccagggtctctctccaccatataaacccctcattttgtaagttcagggctgcctccgctgactgtggtggagcagcccagcaggctaataaacttactcgcctgaccttgggtctctctctctctctctctctctctctctctctcgttctttctctcagctaaccttacaactttgagtggcaatggggaagaatgaggatgaatgggttttttcaaaagtggaaaggtcttgatcaagttcaaattttaaaaggcctttctgctatcaaatcacaaaatagaatataggagaagaaaatgaaagatccaagagacagatgatatatccctaaatgaggaaagaaggcaggagactagaaagtgggaaaaccgaaatattttgcagaaccataaagatggcatttcattaaacgtcaggagtgatggaagaaaataatcaaaaacagcttgaggtttttatattcaatgatcaaatagataaacatgctttagttttaattattttattggatccttttgattaaaattgagctcaggaggagtggatatcacacaaaaaacataatttttcccttatccaggtcatgctagcagagaatgaatcaaggggaagtagtatcatgggcagtttaaaaataattgtatcagagaggaaactgtaagatgaggggttatataagtcagctttgctgcagtaacaaataaccccaacagtttcactgggggctcaacaacaaaggctggttgtgtctctacttagcccgggttggctgtgttccacatgctttccattcaggatctagacgaaggaacatggtttattaggagcaaaagagctgcaggcaacatacaatggatcttaaggcttctgcttggttgcagtacacatgatgtctgttccagtgccatttctaaacaagtcacatgaacaggcctgtgtcaatgtggtgggaacatacacttgtcccacaagggctgctgcgtgtcacattgtcacagacagggaaatataatcctcttttaggacgaagtagagacaagttgaaaccataatgccaccacagggatggactcaggcaaagagtccaagctcctctgaatctgctttgcacctataaccaaccctagctctagaatgttttttaaaaaattccatagttaagtatcctcagcacaaaatctttcattagcccgaggcaaaatggccagatttcaatttcctctcttaatgagcacttaaatgttttaaatgctacaggggagggtaggaggagaagccaaggggtgtggaagaaaaaccattactagataatcaacctaaaagtaatcaagagttggctgaattctctcctgacctttgctgtatttagtatgtgtcctaagagaatggttgagctgtagcaggacgagccgcagacaaaacttctcagacaccaagttgtagaaggaagggctttattcagctgggagcatcgacaagctactgccttaaaatccgagctccccgaatgcacaatttctgtcccttttaagggctcacaacactaaagatttcacatgaaagggtcgtgattgatttgagcaagcagggggtacgtggcaggggctgcatgcaccggtggtcagagtgaaacagaacagggcagagagtttcacaatagtcttctatacaatgtctggaatctatgaataacatcggtttctaagttatgagttgatttttaactactgggtttaggccaggcaggcccaggcctggtttcgggcctggtgcagggctgcctgtctttgattttacttccttgtttttttcttaaaacaggtactgagtataaaacaatataaagcgatatgggagggtctctctcttccctcatttcccccttttgagactctcactttttcttagtgggagttctcactcttatttttgctacttattttttttgttcaatagattgatagtgattcatatagtacacttgtgctgaagcattttggtgaactaaggtagcgatgaagattttttatcatttaaagaagcacaggtagcaaacaagggagcagtaagcaggtttttattactattataactcctattataagagttttaagtcctcttagtgctgggaaccaccttctaaacatggctttagggttgaatctgtgctacacttgtacaggcacatgtgtcagttttgtcatatttttaactatgtctttaactacttgcctttgattatctatgtgtagacagtaattagtaaggttaaatttcttatagacttctcttttagctgctagcaagtacttgagagctaatccattttgatagatagcatttcttatctgagttttttgccgggccagaatagtaaaggcttgaccggttttattagtgatgatttctaaaacagcttgcaaccgtatgactctgttgagcaggtaaatgggggtccagtattcctatgagccatcttgtgtctaagtggcaggcctatagtattgtataattttgtttttagtgggccatttatcatctttttaattacttatggctatgcttcgttttccgcaggaagcatagacagggaatgcctaggagttcgcctgtttttatgggcagtaaaaagaaagatggtttaatggtgccaataacacaactacctgtccactggtcaggcagcttagcgtaggctctatgtctacatatccagtataacctggtagggtcaggctagtcctggtggaattctgggtgggcctagacagtctgcaaccttggaaatttactgaatagatctctttctgtgtaattggaactccaccatgtaactgttttttgcggtatcgttatacagtttttgctttagacaactaagtcatcttacagaatgagtgaattcttttcctgtttttgttgttgttgttgttgttgtttagctatgcaataattgagacttttagaacttagaaatgatcagggtgattcttttgggctgagaatccatcaggaactgggtctgtaggcactaattctcgggcttcttatggccattgatctcttattacagtttttctacaaacataacatgaagtgatatttagagactgggttacatgcccagctaattgcaaaaaacaaatttttagtctttcctggaatcttaggtactggcacatttagttcatcctagaaagtctgaaatactggttctggagagcgtctttgaacctcctttcttattaggctgtttatgctagggtctagtctttttctatcaatgcctaatgatacatattgtttttttaattttattttgggtctgaggggtttgtgatgactaattctaaagggttacagttctcactcgtgcaggaggggctgacttttcttttttgaagcctaacaggatctttttaatcttctgttcaagtagcctaaatgacacaagaccagtattgacacattttacataaatatgattcttgacagacatactttttttttttgctgtgtaattttttttccctcatcagagaaccgcatcttattctatgctgcttactatcaatagcagcacaagcgtcaaattttaaggttacatttttggggacctctctttcttctgttctagctattactttacttgtgtcacctagaaaaggactagtccttaatcttactttaaagactgtgatcatggggggttcagaggggtcatagcacacatcgggcaggtcacttcctggattacatactttgtgctgagtgttattgtacaaacaagttctttttggagttcctaggcatttataataactataaaataataggactgtagcaatcttttgtctcacttcagtgatttgatgtatatactgggaacagttctcagtctgaggaaggtcagttgaagtctttactgtacaagtctaaattttaaggaaaatgagtcctgcaatgagtttcttcatgcttcggccatgtgtggaccagtcagcttctgagtgtgactggagcggggcttgtcgtctttttcagagtcactttgcaggggtgggtgaagctgctcctatccacgtacagctcctagtctactgatgtttaagggtggtcttggaggttgggcctactagagtaaactgagtctaacacctctacacagtttatgttaaactgggctctctgataccaggagtaaggtggcggggttagggtgttgcaaacttcaatggttatgtagggatttttacagagcaagatttggtatctagttagtctagcattcattagctaatggtgtcctttggtatttattaaaatcaccacagcatggcaggactttatgtttaggttttgcctaagagttagcttatctgcttcttgtgctaacagggccgttgctaccagggcgcttggacgtgggggccatttggaaacctcgtctagttgttttgagagataggccactggccttggccagggccttacagtctgggttaaaacttcaactgccattttttctctttctgacatatagagtgtaaagagttttgtcaggtcaggtagcctcagggctggggccaacatgagtttttctttttaactcatgaaaagctcgttgctgttggttgtaatagatgtagtttatctaatctacatttttattgactgtcatctactaaaatattgacttaaatcctgtaactatttgatttcaagctttaaattgatctggtattccttgtggggctccaattgcatctaaatagatgtgagagttgaaagacctataaggggcttctctggctttacgatgtcttattttttgtttttcctctggttgatgaaatgccagggtgaaagggatagccaaatggactaaagcacaagtgccactctagttattcagcagagtgcccagtaaaggtccaccacaataccaccacacatctgcttggggatgaacaacggctgactgattgataagctcttgaaaattcttaagcttactgcatcccttcaggtctccaaggaatgctaagtctcctccttgctgtgagagacacaaagtgaacttagtgttgggagacagaagctggatggacctcaggtgctgatctgcagggactttgggatatagcagagagagcttggcatgatttattactccaggctgtagaatctcagaaaagagctaccacgcagcctacgcctggtcgactggaggaccaccttagtggaagggggacaattagggcctctggcctgccatgtgcacaatcataacaattgcttttgtttaatgtgcagatggaatatttgatccatttcaaccaggcatttgcattcttggtatgctgtcttaattgccaaagtttgttttaagtctttaacttctatgatcctttagtaaaatgaatgtttcctttaacacctatttttattagtttttagactaaagaaagctaaatactattttatatttaataatgtttcttgtatgatttttatagtagataagttaaattttacttttatattagtgtgttattaatgttaaacttaattttaataaaaccttgtagacatatttatctaattttttatgtttgaccataaggtaagattttatagactttttttaactttttataatttttgttaaagagcaggttgatgctttaagaaaaacctgttgcatttttactttaatgtccagttcacagaaaaactgggtgatatctttttaactttagctaatatgtttacacacagaattttctttacaattaacgttttaaaacttgcttaaatttttaaaacaataatttttttaacttttaatgtaggtaaaaatccacatttttatgtccctttataatttttttactaaaggtatattttacttttcttatacaccttgcacataaactgtttctttaatggtactcaggaggccttattacttttaaattatacaacattttttgcataaatttttttataacattttttctttcacgacttttgcagacaatttttcaacatgtcttaactttttgacttattacatttttttctttaaacaactagttaatttatttcaggacaagaatttactatataacactctttttacataaattttgcctcccccccccgcccttctcttttttaaagcgaactttctttatgtctttggactagactgtctaaggccacaagattagaagttactataatacatgttacactgttaacttttagcaaacttcacttttgttgaaaaccttgtaagtttgggatttcaattatcctttgctattaataagatcttgtttagtctgaattaacttagaattggtatagatggcctctttttctctctgctggtctttccttgcctctgccagccacttatgctgctgttctcttaactgctgttggggggaagggggtctaaaactagctgtaactgtctatgtacggaaactggcctgggtgccttggcttacaggttaccttgtgccatacttttgaaacaagggacctgtccaggcttccttctgatggccaacctacctctaatgctggccagtctatttcacacaaagttctaagttttcctggtgtcacagtaacaccgtaatctcctttaaattctttcttgaaattttttaacatagttcctagtagggtgggcttacttacaccggacctgtttttgtttttgttttttctcctgagacaaaataccatgctcacaccacacacactcaccacaagacaaagaacgggtatggagggcacacacacacttttaccatttatagtaagccaaaatcacgaaattcaaaatccgagttccaaaagattcaagacaagtcaaaaccaaaaccaaagtatctagcaattcaagtcaagtcaaaaccagaacaaaagtgccaatgcaggcacactgtgggtgatcaggccactcttccactcagatggagtggggcaagttccaaagactagtcttaccaagtttcagatgtccggactccaagtgccagttccttcccagtgttcagccactgtgttaatcctccacgggggcctgctatgcgctgctctggcaaggcgttccactggggcaatttcctacccgggagtgctctttggatcctgtcactcaggctggccggagtcccccgcaggatgctccacagggcaggcctaagccgcctaaggggctgcctcggctgtccatcagttacctcgtttccccgtcagggaaccaagaaacgtagcaggattagccgcagacaaaacttctcagacaccgagttgtagaaggaagggctttattcagctgggagcatcggcaagctactgccttaaaatccgagctccccaaatgcacaatttctgtcccttttaagggctcacagcactaaagatttcacatgaaagggtcgtgattgatttgagcaagcagggggtacgtgacaggggctgcatgcgccggtggtcagagtgaaacagaacagggcagagagtttcacaatagtcttctatacaatgtctggaatctatgaataacatcggtttctaagttatgagttgatttttaactactgggtttaggccaggcaggcccaggcctggtttcggggctggtgccgggctgcctgtctttggttttacttccttgtttttctctcaaaacaggtaccgagtataaaacaatataaagcgatacgggagggtctctctcttccctcagagctgttatccccccagttcccttgtgcccacattactcaagttttttatgctctgttgatggaaaaatgaaagtgcaagtagtgttttcattttctaggaatcctcactatgggaaatatttgtatcttaaaaggaaattaaatgtagttaacccatacagcccagaaattattgtaaaatttgaaaatttccaggttgtgtcctctatccatatcctgtgcattcataagctaagtaagtatgccaattttgcatcagtttccaaaaaaaagatttttttcctaaattatcaggatatttctcagaaaataattgatataaatctgatgattagaaaaattgtatctttgccctttggtttcaaaactgttctctatctctccatgcatgattaaagcacggtttctgaaggtcaggaataaagctacggtcatgcatatcacatttcttttatttttcaatcactgttttgaacaggacaagagaatgattcaacgaagaatgaaataaaaattgaaacagaatcgcagagctcatatatggaaacagaaggtactgaaaccaaaatatattgttatcagagaatgagatgaaactgtgaatcatgacttctatatatacctgtgtgtgtgcgtggtgtgtgtgtgtgttttaggcaatgattactggaggatagcaatagtgttcaacttggtgtacctattgaaacttgaagggggaaaaaagaactctaactttctataccatagtcacagtattctctcaatgattccaactaaaacaaccctgagtgtccatctgtctcattctatttagaactttcatcaaaccaagaagatgccgtgattgtggagcaaccagaagtgattccattaacagaggaccaagaagaaaaagaaggtgaaaaaggtaggactgctcttaaattaacccatcaagaatggagagtttctttggattcctgcctagaattcaaccatcaaagttattctcatgcaattacagtttgtaaagggggaaaacgaacatttccttaaccccaaatctccgtttgaaagtagagtaaaatctagaagtagcaaaagaaaatactcggaagacttatagcaattacatatagcataaagatgtttttgttattcatttagattcaatttaaatttttaaaattacagtattgagaaagcctataagaaatcaaaactatggactagagggataaagttcatacaaaatctgaaatggctttagagcaaatagactggcctttttgtattgatttcatctgtcttccttagtatagtagtgatgaaagaaacaatttatgtaaaatatgcatgttatatgaacctaaattgcaatcttgcttgctaatattaggatgcaatcatattgaatactgttttaaaaaaagtgagcattataatgatttctgaaaactcaagaggaatgaacactccttaaatattaaagcagcatttggggcaaaaagccaatgtattggagtgaagatagaaatatttttaaaaatgtgtttaaaaaaactattctggttaatttagtgttaactgaagaacttaaagaattcaatttttaaatataaagcaatctcttaaaagaagctaataaaataatttttgttacagtatatcataaatcatactgctcttaaataaatatgtatttgcaaagcagttgcagagtaataacttgacaggccttgtttatagaacacagtgatcaattttgtttccaaattaaaactcagacatgatctcaattgtaaaatcaggtcaatagcaactacagcttccaaattatgaactcttcttggcaggggcattgacagtttaattgctaaaccatgttagagattttgacacttttaaaatgttgactgcatttacagtacaatattcttccatgtctatgcctctaataagcttttcgctattgcaaatcctagttcagactcacgactccactttcctgttaagtcaaataaagggtatattcaaagttatttcatgtctaatattgataactgagaattgaaacaacccttactcagaatcagatatatggtattgctctcctcaattgtagtttaaaaatgtgaaatagacaatgctgtgcgtgttagcttaatttctctgtagcagaaattgttggctctgtttattgcatttcaagaaatgcaaatggtaaagaggaaaatcaaacagctgtacgttttcctcttttgacttgacctataagaaaaaagctggcattcggcacattgacatgtttcccttctcccagagccttcccaagcattgaacactactctgatgactgaagaattaaatatccacctttcctctcttccttgtaaatatgccaatctttttctgataatggtggaatagcatgtgggaaaaaagcaaggtgaaattctgctacttgcttttagcaacgatgaggttgaatttctttattaaaatttgacttttcactgtaagatgactaatgctggtagtcttgaattaaccacattttctcttcccatctttatcatagatatttcacttggtcctgccttgaatatttctggtgtttaaatttgaaataattttaagtgcatcacatttgtcatcttatactttgcatccaagtgaaaagtactcataggaaaaggaggcaatgtagattcatggtgctctgcagtagctctgctccaccattgacaagctgggtgactttggacaagttacttaacctatctgcttcaggttcttcatctgtaagatgatgatggcaaaagtacctgtcacatatagttatggtgcaaatttaataagtaaaacgtgcaaagcaattaaaacaatgcatgacacatagaatgcactccataagtatttagtatttatcataatttgatacattgatgacaaagtcaagaaaatccacatgtgatttccccaagtccatttatcattcttcttcactattttgaatctgtagaaagtcacatattttacattatccttcaacaacaacaactggttctatccatttggttggcagcaccatctcaggccagcagttttgatatggtctaaactctttacattgctgcgtattttattctaaagagataaaacaactaatagaaggaagccaggtggaaggcatttctctccattcataaacacttccttgtttgtcagtatctcaatcttccatttgagaaataaacacaaccataacttctatttttttaaaaaagaaaccattgagctgttgatagatccacaaaagaaaactagtaaataaattcaaagtagcaattttttttactttctttttatttagttattaaaaagtcttgtttgaaaacatttcgaggctatagctccagattttgtattcacaaaatagtgtcttaatggaaagttgtacatatgtattaggaattatctgtaaacaaaacaaatgagtattttattacatttgtaaagatattctttatagctttagaagtattccttctcttttattttaagactccttttaaggaggcagaaagtgattcctttaaaaaaaaaaaaatccagaccaggaaaaatatataacctttttctctcttttttgtagcattttataagattagaaaatgtagataatcttcaggatacatcttctatggctcccaggtatatgggcacagatgttgcaacattaagttttgaagttagttctattaaaatatggattttgaaaagaaggaaaaatattcagcagaagttcatgctgataaaattacacaatagcacagtggacatgtccctgggagacctgaaatacaaaaatttcaacaggcagaaagtgaggtttcacatatggcagcttttctgatatagccacgttgcctcttcctaaatgagcccagttttatgatttcccagcaggacctgcaacacatatgaaatccagtcgaataacgtcatttaggttaataaccaaataggaaagtaatattatagaagatctcctctgaaaaggatctcatgttttagtataaaatataaagtcagcattaaaacatctttcttacatttgttatttgggcaaatttagaaatatttgacataaaatcttaactatatcaacatcgagttattatttcacaaaattttcatatatgttttattatgatatatattggatatttttttctctaagtgttaaacagaatgaatacatttggtcccaataatttttcatatcaattaataagtgtagtgtggaatagtaatcctttgtctgtttacctaagattgagcaaaatgttgacagagacttaaagtatactatggtttaatgttttcttagaaaaagatgcatatgggcaggcatgcaagtaaagagttaagtgcaagccagtgacaagtgtaaagtatcatgcccttaggttcatgttttgaaccaagcatggtctgaccagcatgaccttgagacatagtgtacagacagccatggcttctagccctgcctgtgtgattcctggcaatccttaaacttcgaagaatcccagtctctagggtaataatgaggggcatgaactcaaaattgcaattataaggttctccagttttataaattttcttagaaggccaactctgaagaaccacattcttggtgaaacaagagcgatggcatgggagccaatggtcagccatgctgaaagctgaaatcataggttttcctcagttttagttattgtaccctattgataaaaatatagaggtgccctaggccaggcaaaaaaaaatcagccaaatatattaggacttaccaatgattggacagctaattattccctaaagatactttaaagggggaggggaatgccttttagctcaaggtgggtttacacagaaactctgctcagaaccaagctggatttccatcaccatctttcttagtccatgtgggaaacatctttttttgcaactcctctggctacgatttcatcttttagtgaacacatagcaagtgagggactttctcttctgcttctaccaatcaaatccattagaggtttatctcatctacaaagcacccctgtatagcccttggtgttttccatttctcataggattcttacatcactggcagagccctttcttctctccttgaaaagcagagcttgcactagcagtgttgccatacacagaatacctgtgtattacacaatagcacagtggacatgtccctgggaatagaatacctaacacttgggccatcatatacagactgtgttcttggctataaagaatcattgctcaggcatatttttgattcatgcaaaatactatatacacttgcatgttgagtaacaaacttactggaacattctaccttcagaaagtctttgtatctcttttcaaatgaagtcaagtttagtaatactatattattcatattagcagcacaatcatttagttttctagggcagttttaccatttgttttcttcttttttaataatattttgaatctgaaattcaacaaccaaaattatgttttaggatatcagttaaattaaaaatgctggtctctgtttgggttttatgaatattttagtatctaatgaaattcctcatattggttaagtaccttgaacataaaaattataaagttttaagctaaattgtttaggttttctacatgtctctatgtatgcaatgtaaacatatagaaccagttcattcaaattatgctgcataactgacctataattttaaagttaaaaaacatagaagaataaaaggtatattcactgcactttgtcttgcactttgatttcttgctacaataatgatgttggtgtggatagcatatatgcatgtgtatatgcgtaaagttagattatacgtgtataaagttcacatgtatctacccagtaagaaagttatgcaggcctcttgagtttgttcaaatcctctagcttgctgcaatcatcttgtctttaaagatttagaaaaaaattgccctgaaactccatttttcatgttaggagaaatctatcattccttccaatatctctgagaattctttggtgtcaggtttatttcttctaatctcaggctccaagctcctgcctctggttctcacttcagcctttgccattccttttttcgtaagctgtctctagttctcactatggctcccactcagacaccaccaccacctctcatcccttcactccgtgcagtaccacaaactcaaggatgtgtgtaggtttaagtgaatgttagggtcaatacttgtaattaacttgtgcttgcccatctggggaattttaagagaccatctcttctaagtctccagcatccggctacatcctgtatcgccctttgtcttctttgatttcttgcacttcctaacactccagtttcatttacagtttaactttgtatcatgcctgtgtccttctggtcttgccctgaggtgtatgattctacaaccatgtggcttatcaaaccacgtggtttatcaaaataatttgcagaaacaaaagatgactcacataagtggaattctgtctttaaatattgagctttttactcctctctgccgaattagagttctacaactcaactctctgtgcataaagtacctgaatttttttcacaactaataaaaagattaatgtgtaccttcatctaaacataatattgttttacatatatgatcctgaaatacttcagaaaattaaccttctctaaagatagtgagtataattattaacatttgttccttatatttaacttccttccaaagacattatataatgctaaattgaaattttcagaaagataaaattatggctgtcatacaactataaaatcaatacaagtaaaatattttatttaaatgattaactagtaagggaatcattaagatgttaaaactggttcaaaggagaatttgaagagtgtgtgtgtgtgtgtgtgtgtgtgtgtgtgtgtgtataaaatccatctatcatctatacagtgacattttagtcaacaacagatcgtatatgtcccggtggtcccataagattatgatgctacatttttactgtaccttttctatgtttagttatgttttgacatacaaatacttaccattgtattataattatctacagtcttcagcacagtaacatgctgtatgggtttataacctaagagcaatagactacaccatataaccttggtatgtagtaggctataccatcgaggtttgtgtaagtacactctatgatgtttgcatcatgaaatcacctagcaacatatttctcagaatgtatcttcaccttaagcaatacatcactgtatattgattaggaattatggctatatggatatacacatggatccataatacacacacattcagaaacactgaatatatccatacaatcacacacaattcaggagcactgaaaatttccaaactggctaatatcatacaggacaatacaacatatcctttccttctatcagacaaaattcgttttcactgatatgaacaaatctcattttcattactacaagttttctacatgttaccttctacctgtacagatgtgtaaaatagtctagtgaatagaaagctggtcaaaggaatacaccctcatagaaccagataatcccacagagggattatctggagggtgacacccaaccttccaccccagtgacacccagggatctcttttatccattgtcaagtcttagacaatttttcttgacagtatactgaaggcaaaactgccctttttttaacctgtttaccacctcacttatttgttattgttcactatttgatacatttgatagacagtgataaaatactagggtagtatcagagtagggcagtagcttccaacttcatctgaggttgtagtttacttgctattgttttatggcaagtactgctattctacattttatatagttgtacacacactgtagatgaagttgtacttctaagatgcctcagttgtgagatgtgccattattttacatattattaataaattttctaaaatctggcttattaaagtaagacacaataattttgtatcatttaggatttttattttatgtgtttaaaaaaactcttcgaacaagatgtagaacgttttcatatatcactcttgagaatacataaaaagaaaatgttaggctaaaggaattagttatgatactgctaaaacttcatcaggttcagggtcctacttctaaatcactttcagtcaaagtcatcaatatctgtttttattacacaatattgtcctctgccaatgtctttgatggttcagaacttaagagaattcataaagaatttaaaactcattggcttgtaagtctcttaagacttaagtctgtcttgctatcatatagagagttagcctattttttcttttttgcttctacttagaggcagttaaaacactcctgactcaccacctccctccatatttattatttttcagagattttcacctaagtcattgaaactcattctgcaagtttgagtacttttggttttgatgctaatgcatatatgggtatgataaattgtatcatcgtgtcctgaccaacaaaaattttgtaacaattcactgtttcaaagatgttaagatgtgaaagcagtgtactttatattaggaaatatagtattatttatttcacagtgaaaactactacactgagactagaaaatggaaacttgattacaagtgatataattgagtatatttgatatactcaattgatatataattgagttattttttttctactaactctaatgactagcagtgggatccttactagcacatcagtgcaccctactgcacattgtataactaagaaagtcataaatggttttattcatacattccacaaatgcttttaatgcacatgtaatatgtgccagaaattatatagacactatcactgaaactgaggaaaacagacaaagccactgctgggctcatcccaagcatagagctcaggatgtaagtctttttttttttttaactttttattttattattattattttttttggagatggagtctcgctctgtcacccaggctggagtgcagtggcgcgatctgggctcactgcaagctccgcctcccaggttcacgccattctcctgcctcagcctcctgagtagctgggactacaggcgcccgccaccgtgcccggctaatttttttgtatttttagtagagacagggtttcaccgtgttagccaggatggtctcgatctcctgacctcatgatctgcctgcctcggcctcccaaagtgctgggattacaggcatgagccactatgcccggccttttttttttttttttttttaactttttaagattcctcatataaatgagatcacacagtgtttgtctgtgtcttatttcactcagcataatgccctcaagtttcatccatgttgtcacaaatggcaggatttccttctttttatggctgagtaatattccattatacatatatattccattgtatacatattatgtatacaaatgtgaggtgtgtgtgtgtgtgtgtgtatgtgtgtgtcacatttttctctatttatgcatctatgggcacttaggttgtttctgtgtcctggatattatgaataatgctgcaatgaacacgagagtgcagacatcaagctactgatttctcttccttcagatatgtaaccagaagtgggatggctggatcatttggtaattctatttttaattttttgtggaatctcatactattttccataatgctgtactaatttacatttccattaacagtgtaaaaggttcccttttttccacaccctcaccaacacttgttagttctttcttgcctttttaatgaaactctccctaacaagtgtaaggtcatatctcattgtgattttgatttccaattccctgatgattagtaatgttcagcaccttatctcatatctattgcccatttataagtcttctttggaaaaatgtctactgaggtctcggtatcaacataatgctggccccataaaatgaatttggaagtcttcccttctcttcagtttttttgaaagagtttgagtaagattgtcattaattcttctttaaatgtttggtataattcaccagtgaattaacctggtcctgggcttttctttgttgagaggtttttgattactgactcaaactcttcattgatttttggtttaatcagattttcttttttaaatcaggtaatctgttttattataattcttatatgtttaggatactaaccccttatcatataaatggtttacaaatattttctcccattttatatgttgccttttcaccttgttgattatttccttttctgtttagaagctttttagtttaatgaatatctgtttatttatttttgcttttttcacttgtgcttttgatgtcatgtccaaaaaatcattaccaagaccaacattgagaagttttttcctatgtcttttatgtgagttttatggtttcaggtcttacatttaagtttttaatctatttcaagttaatttctgtgagtggtataagacagaagtataattttattcttttctatgtgggtatccagttttcccagcatcagttatgaaagagactatcctttcactgttgtgtgttcttgacatccttgtcaagtattaattgactttatatgcatgggtttatttccgggattctcaattctgttctattggtctgtgtgtctgttgttgtgccagtaccatactgttttgattactatagctttgaaatgtagtttgaaatcagtaagtgtgatgtctctggcttttttcctctttctcaagattgctttgactatttgggatattttgtgtttccatatgagtgttaggattgttttctttttttatgtgaaaaatgcccttgaaattgtgatagggattacgttgaatgtatagatcgatttaggtatttgggcattttaacaacattaattcttttgattcataagtatggaatatctttacatttatttgtgtcttattcaattttcccatcaatattttacagttttcagtgtacagatttttcactgccttggttatatatattcctaagtattttattatttctgatgctactataaatggatagttttctttatttgattttcagatattcattgctagtgtatagaaatgcacctgatttttctgttgatttcgaattcggcaagtttaatgaatttattagttttaacagttttttgttggtgtctgtaaggtttttaataagactatgtcatctataaacagagaaaatcataattcttcctttctgatttgaatggcttttatttctttttcttgcttaattgctttgtttaggacttctagttctatgttgcatagaagtggtgagtaggggcatctttgtcttgttcttgaccttagaggaaaagccttcagctttttaccattgagtatgatgacagctgtgggcttgtcatatatggcctttattatgttggagtacattcctcttacactcaaattgttgagtgttttttttcctaatcatgaaagaatggttaattttgtcagatgctttttctgcatatattcagatgatcataagattttcatccttcattttgttaatgtggtatatcagatttattgatttccatatgttgaaccatccttgaattccaggtgtaaatccctccatccttctaaactgctgttgaatttgctagtaatttgttgaaatgttttctatctattttcatcaagggtattggcctttaatttttatttcttgtagtgtttctatctagctttggtatcaaggtaatgctggcctcataaaatgaatttggaaatgttcccttctcttcaatttgtttggaagagtttaggtaaaattggcattaattcttctttaaatgtttggtagaattcaccaatgaagtaatctggttgtgggcttttctttattgggaggttttcgattactattttgatctctttactcattactagtctattcagatattctgtttcttcgtgattcagccatgttagattgtatgcttctagcaatttattcatttcttttatgttatcccatttgttggcatataattgttcatagcagtctcttatgaacccttgtatttctttggcatcacttgtgacatcactgtttcatttatagttttatttatttgagttctctcttttttttttttttttttgagacggagtcttgctctgtcccccaggctggagtgcagtggtgtgatcttggctcactgcaagctccgcctcctgggttcatgccattctcctgcctcagcctcccaagtggctgggactacaggcacccgccaccaagcctggctaattttttgtatttttagtacagatagggtttcaccgtgttagccaggatggtctcaacctcctgatctcgtgatctgcccgtctcggcctcccaaagtgctgggattacaggcatgagccaccacacccagctgagtcctcttttttctttagtcagctaaaagtttgtaaattttgttaattttttttaaaaacctcatttttgttcatcctttttattgtttttctattctctatttcattagagatcagagatttcatgagagattagagatttcagtcctaaatttttaccatttttttcttctactaatttgggctttatttcttttttagttccttaaagtgtaaagttaggctatttgatatctttttttcttaatgtaggcattcataactataaactttctttttagaactgcttttgctgcatcttgtaagttttgttatatggtgtttccatttttgtttgtctcaagattctttcaattttgtgatttcttttttgacctattggttgttcaggactgtgttatttaatttccatatatttgtgaattttccaaaattcttcctgttattgttttttagttttatatgtttgtgatgagaaaaaatacttgacatgatttcaatgaacttaagatttgctttatggcctaacatatgatctatcctagggaatgttctgtgtgcgcttgaaaagaatatgtattttgcagttattgaatggaatgttaggtgtctgttaggttcattcactctataatgttgttcaaatctgttgtttctttattgattttctttctgggtgacctatctatcattgaagtggagtattaaagtcccctactattattgtattgctatttatttctcctctcaattctattagtatttgctttatatatttagatgctctgatgtttggtggataaatacatacaattgtacatcttcttgataaattgattcctttattattacaatgaccttttctagtctcttgtgactattttttagttaaggtctattttgtctagtgtaagtatagccaccttgctctcttctggcagcccaagctgtcaataaaagctagaatggtggtgcagaattattaaagtagaagtgatagggtgaaaacccagggttagaatgagagcatgcatagcctttctggccatgccacggagtgtggagactcactgccaactagaatgcagacaaatgatttgattcatcattgattcctttgttttccacgtcattttacagactaaagtcagtaagaacccaaaattattacagttatcgcactctgtcagcctttggtattgaattcatatgggattatatgaaataaataaagttttcttagaacatgcaaaaaatctagaacatttactacctggccctttatagaaaaatactgctgagccccagtctatttatataaagcccaatgttaccctgaatgtgaactccctcatttcatacaataactctcaaattatgaatctttgtcaacacacacagacatatacgcatccacttgagatgtttccatggaaacatggatttattctcacaatgccatgcccttctgtaagcatagtctttgctgtgtttgcatccctccccaacctgatagattggaagaaaatggtgccctctgatgtcagcctcccttaaaggggccccaaggtagcatgtcttgggcctcaagtatttcaggccataagtggaatggagtaatccctacaaccctgtactcagaagcctattaccttactttgacttggctttatctggtcagtctcattttgtttggctctttctctcttagaataatagtttaagtttcctttaagtacagttttctgccactgtacgtagagttcataaagtaaagaaggttctacctactttcccgcgaactgatctttgccttctcttagtatactacaagtcagacttgcattatgactgtgaactaaagatcctaatcataaacattcagacagaaagaccatttcagtgacagaacaagtgcaagtctaatctataatgtatgtggagtagatagtgattgtaataatatggatgtttatgtatacattttttgtaaaaaccaaaatattgtcaacccaaaatttaatttgtacatttatacagtggttggaatagaggctcaacatttacataaaaggctttattttagtaaacgaatggccacaaactattatgtgataggttttggatgacatacttactgcatttggatttagactcaaccacttcacatcaggtgcaagaacttccagatcctactgattgtgcaaaagatatatccattttgatttggatttcaaatgtaagtgctgcttttctctctgcttcagaaggaaactcaatttcttttcattgctctttatacatcaggtgccttcatttcagcacagtatgtaaaaagcaggtggtataaggagtactttgaatgttaattatttttttcatcgatttcaccatgaggatttacctttcaatgtgtttttataatcaagatggaaacaattagggaacttgctgtttgaatgtttcactacatttattttatgacatctgctgcaatgattaagaaaaaagagaaaaagggaggcaagcatttgaacaatagcaaggggtttggattgattgtatgtgattgctttatttcattgtgaaacttcaaaggaaatgttgtcgagatgaatcagtcacgtttctaaccaataatatcatcccattgtttgaatttacattttttacatagaagcacatgagttcatttttcagagatgttgtcatagtttattagccttcattttaaattgaacctaattttataaactgcagagaaatggggaaaaagggaaaaatagatatttcttctgaaagaaaaatttcaaaggagaattttttttccatttgtcatatttggtttgttcctcaaactttaaacataatttacttcatctgttcttttgtttcatatacttacaaacatagttcataaagtaaaaatattcaggattaagaggttcatttttcgtaacgtattaagatatggtcatataatttcaatgtaagggagtacttttcaaaattaatatagtcaatattttacactttgttacattactcttatttttccattaacaaaatattataggaaaccttatgcaatgagaaactaaaacttgcgtaacatctagtaattagataggataaatactagacaagataaatatagttatataatataatgtgtcttatatatatatatatacatgtgtgtatatacataaatatgtatatttcatatctccaaagtctacctgtttaagagatactcaataagtagatctcaaagttatctctgacaatacaggaacatatccagaagatatcttactattttatcacctatagtaaggaataaaaattttagtccagtcaccaaataaaatgtggggttgaagagaacattaagggttactgtttttaattgcctggagtagacagaacaatggtcccccaaaggtgtcctcatcctaatcccaggaacctttccatgtgttacattacacaggaaaagagacgatgctgatgtaattaagttggggggcttgaaaagagaagaatgtcctggagtgtccaggtgagcccagtgtaatcacaagtatatctataagcaaatagggaagcaggagagtcagtgagagggaaggagatgcgttggtagaggcagaggagagaccacaagagagcgattgagatttgaacatgctatgctgctggctttgaagatggaggaaggaggcgatgaaacaaggaatacaggtggcctctagaaaccgtagtaggtaatcaaacagatttttccccagagcctcaagaaggaacatagctcagctgacaccttgacgctagcctcataagacccatttcagacatctggcctccagaactgtaagaaaatcagtttgcattgtgtgaagccactaagtaatttactgcagcaagtagaaactagtacattacctctaccgctactctagtatttcgcatccaaatttagaacactccttttgaaaatcctagactttcccactgtcttcttttgggtggtgatgaggcaaagatgattgacagatgggtaggcaaacagagtaccctccttctgagtctcctcagttgcactttcaatgatgtttattaatttaaaaactatccagcatgaatatgtacaaggcactgggctcggggctggggcacaaacaaaaacaaaatagaaaacccacccacccacccacacacacacacacacacacacacacacacacacacacaaacaatctctaccctcaaggggaagctaagccctcagtagtgaaaacagattcatctggatggaagttcttaaaatgtgttccttggaccagtagcttcagcatcatctaggaacttgctaaaagtgcaaattcctgagctccccttcgagtatatttcttatacaataattgctgtggtttggtttctctattagaatattaggactttatgaaagtttgaaccctgtgtgtgtgtgtgtgtgtgcatctcttgtgttatatgtaggaattcacatttatatatcctagagacaagacagtgaaaacaatagaaagcaaataagcagagtttggaggctcatggtccagacttcctggcaacaggctgcgtaacactgcttagtctgccagtaaccctagctccagcaggtgtagcccaaagtgagggcagaggctttccaagttgaatgtgcatgaaatcacctgaagcctttgttaaagcatggctttcagtgccctatccctcaagtttctggtttagtagatctggagatggcaggagtcaaaatgttgctttttcttttagagacagagtctcactctgtcgcccaggctggagtgcagtggcgtgatctcagctcactgcaaactccacctcccaggttcaagcgattctcctgcctcagcctcctgagtagctgggattacaggcaagcaccaccacgcccggctaatttttgtatttttagcagagacagggtttcaccatgttggccaggctggtctcaaacacctgacctcctggtctgcccgcctcggcctccaaaagtgctgggattacgggcttgagccaccgtgcccggccaaaattttgcatttttaatgagttcccaggtgatggtggtactgctggtccagggaccacagcttgagaaccactggcaaagccctcattatccaaaccagctggctcacaactgccactgtgggagaagatgcttctttagcgtcactgtggacccccagtacctgcagctgagacacagggcattacctgtggtaaggatgaggacctcttcccgactccaacccacagtatgtcggagatcagccacttataagcctctcttcccgcatatgccctctttgtggtcattgcacaacacatttctcccacagtggcaggtgatatggacaagggaacacagagaccgcgtgcctaggttagaagagtacagaaccaaggactgtgtttgtttattggaaagcagccctgtggtacgcaaaatgcatcctgagcagcatatattggagttgtgtatacaaaatcatgtatgctactaaagggtccttgttatgccagggccacgactactccaaatgtcatgctcggggtcaggttccagccccagctgaggtctgatgggagtgggtggatgggcagatggcaggtgaaaggtagttttatttagcagctctcttatcagcagctctctcacactagctctcttatactctctgcctttatctcggctgtttgctccggctctgcggcccctgtcagcagccaactcccacacacagccgcaggaccagcctgcaaggccagctctcccttacagtgttagcagcttaactctttctctctctgggcacgagtgcgagccatggctcccttctctccgtcttgcagtactctctctctttctcttggccccagcacaagagcgcctgtctggcatcagcggggcagttatactttttacagacagtagtgactcagagccaagtgtgaacttaaacagattatataaaaagtggagtatacacctgcaccctaaactcactaagtcatgctggcctggatgtccgccttggcctattcttgagcaaagcacatccatacaccttacagtcattctttccttattttgatgaacaggatatatggggggaaaatgaagataaaaattccccatcattttcatagttctacttgtctttagacatagaaacaagaaggagtcatgtgaaagaagatggcattctctctacaagggttgaaaaaagagcaaaaataggatcgggggcataactcttgctcaacttgcggaagttccccacacaaagtaaaaataaaccctgctttagcagcccttatctgatttaagtcagtttgtcttccaagatctaacatttcctccgttgaatttgaggggcttattttaataagaaaagaaaaaaggagaagctgaacagggcctttagagcaacacacataagctgtttgccatattgaatcaacacctggggcattgatctgaaagctaaacgcaggctgttcacctggattgccaagtataacagaagcaactggctcactgacatcagagagagcgtacttcaccagggctccatctgcaattgcctttgaggaccagagataatcagaaaaaaagtacagaggttgttctgaaacctaattccaacttaggagcatttatttctcctttccgtaaactacctgtgatttctaatcaaaaatgcttttctaaacccagctgacctaattctccttttctccctcacagcgtgtctttttgttgttgtcgatctttggcttcgcttattcaccaagcacagttgttgttgcctagctctctaagcttgtgtgtcctgcctttcccaacattccaaggagtaatggtctcattaacccagtaattaaagaaatcctgtacctttccactctggctagctgccctcttccttttcccctattgttctctcagtaacaccaccagcagatggtttgagattttcaccctttcaaaagctttatgtttttcccatctcatcaagcatatctcagccaagtgtaattagcttaaggcttttgaatccttaagggagatcagttaaagacttgagcaatttcaatgaagagcttgaaaagccaatcctggaaggctaagggtaaccacaggagagccactattatttagaagcaaagaccctctcctccgcccatccctccttctttaggcactttaaattctcagaatattcatgaggcctccagggctttgggactctatttggaccattattgagtaggtgggatatttaagctcttactcatcatcgggtcagttggttccttttaattgatttcaatcaaggggccatttttggggagccttaagttactctcaaatggccaacagtttgtttgctaagtctcttagccttttcattcctttctttatcctttggttgttggaaactagctttctttgtagttcaagcagttcatatgaagtctaaattaattaactgcaacacagatttgcaccctacctttgagtgatggtgaacccccttgattcctgaatagccacatgtattgtggtagttgatcccacagcccaagccctttttccccatacttgggaaaaagcaagttgttttgagaccaaattaaactctatttttattgaaatggagtggagtagtgcttaagtgtgtgaagcacagattgttggtgggatgttaagagaggggcccaggctctccctcgaattgggtgatgtgtattttccccatgctttcaagtgggaggctcggaggctcaggtgttgggtaataggatgattaagtgtgttctcatgtctagtttctcattaccaagacttgggtaaaaggagaattacttttgtaaatctactaccatctttttcaaataaaaggaaccaatgccaaaacatttgattagaacgacctctttttgtctcaagtacactaatcagcttctgtttgaacagtgatgcataggtatggagatgtgcctgtattaaatattatacatctactgtaccattagaggacactacaatcacaacttagaggaaaattccttgtaaaacatgggatgtgtgttctgagccgtggtatgacatggaattggcttgcaaagcagactccaaatacttatgaattaatttattgctgtctgaaaaatatgacataatgtttgaagtacaaattggcttacaaaaagatataagcagggtgaacatttttggtaggtaagacagaaatgtagctgcattttataaatgtttgttttgcataggagagtgataaattacagtagagtttcactattattgctttgaatacggtaggcctaaagaaactagactatcccagccaacgtggcagttctgaaccacagaaaccagttgcattggtgcagagtaggtaagacttagaagaaagaaactgctgacaacaccttcactttataacaacatacagtgaggcagaggactattagcaaacctgataccacagtgtccagaaaatgtgcagaggtcatcttctataaggtttcttatacaacagtttcaccacggccatggtgctatgggcaggaaagcttttgtttattccatttttcaaataactgatgcttaaaaaatttttaggcacagtcaaaataatatttaaaaattttttcaaaacagcggtatctacttttcttcaaactgaaattacaggaattaagggtatgaggagtaaaatatacctgaccagggtcacacattcagtaggtggagcaaggccctgacatttattatctaacttgtgacccagcatcctttccaccctacccttttcccctctgagctgctctgaggggctgtggctaacagagtatgacactcgagagggtatgtacctaattgtaacttacccaactttatataagttgggtatagatatataaaatcacccaactttatataagtttcacagttggaacctggaggtcaccttgttcaacctcctgctgtgatgcagaaagccttgatgatttccttcccagctgatgctgtggcctctgtcaagggacatgcacgatggggagctcactatctttcgcaggagttcttttatcctcaaagattgagtgtttataaatgaactggattttcctgacgtttctgctgactcatcccagctttgctctgcagagggaactgaaatgaacctggcctgtatggcaagagtctcctaagtctttgaaggcaaagccttcctatagcgccccctatactgtcttctggttagtcgtttatctcgcctattccaaacgtctctcacgttacatggtttccaaacctttcatcatttgactatgtacttctaagcaagtcagatttgccaacttctctctcaaaccgtggatatagattgcacacagtgatccataccttcatttgtctgattcaaagctaaagatttatttttaatagaaattgcttcagcccctggcaactcagtacatgaacttctccctgggtgaggtgaagaagtatcctggcagtgaggctaacagccagcccaattctgaagccagactacctcagtttgcagacaggttgttctctaatgagccatgaacaggtcatttaacttggtttccgcatctgtaaatggggatcataatagcacctacctcagcaggttgtttatagggatgatatgatttaacatgtgtaaagttctggcagtagtgccaggcatatagtaaactctcaatcaatattaattattgtggttatcattgttctgagtaaaaggctatactccaaaccaagggaaaacctctcatttgtttgtgatgaacggtgagaaacctaagaactacaggaacactggatgaaacgttacctcctgccatataattactttgctaatctcctcccttagtctagcacaatgtggaaccatgagagacattcaagttactttcatcctctaagtgcgcccaagctagaagtccagtagttttcctgttgctgccaacatctttgatcaaaagagacctcattgaagagatgcagctgatcaagaaaaattccctccaggctttggtgtctggcagatgtgctgtgtcatgagagtgcatctgtcagagctggctctgtccccatgaagaattgacagggccatgcaaacaaccccgaaatctggcaaaaatgaacctgctaacttagggaagaaaacacgaatggaggtggatcgatgtgcacccactgcctttattcctagtcaggtaccaaagagtaaatgttgcagcatgtaccataggacagtgacagtcacagttgacatttgtatagaagcctgacaaaacagggacacaggagcatggaaacagctacccctacccctcagcttaaggatttaaagtttcgagatttatcattaattttatccccttactcatgttccctgtcttggggttttctttttactagaacttcttccagttgtttctgctgagatcaaagcataagaggggccaggcacggtggctcatgcctgtaatcccagcacttcgggaggccgaggcgggcagatcacctgaggtcaggagttcgagaccaacatggccaacatgttgaaaccctgtctctactaaaaatacaaaaattagccaagcatggtggcgggcacctgtaatcccagctactcgagaggctgaggcaggagaatcacttgaacctgggaggtggaggttgcagtaagctgagatcttgccactgcactccagcctgcgcgataagagcaagactctgtctcaaaaaaaaaaaattataaaagcataatatggagcaggagacagaaacaccgcctcctgccttgctctgtaacattctttctgccgcccatcctattgaaaaactcaacatccccaaaggagccacattctccgagagaagcagtggactaaggaaaaacagaaatttagattctggcaaatcagtaactagaagaaattgctgggagagacagtggtatgtctttataatccttgtaggtcattcctgatgtgctcaaccttagatgataatggcagaagtccaatttttctcttactgtacttgattttaaatgccagggtgagggtcttgcttcatataagcttcattataattaaagtcttaatcatttaaattattacgaaaatcacacttcagaaaaaaagaagagagaggagagggagagcatgtgagtgagtgggtcagttgggctagtggcgcatgtcctggtgcatgtgggttacctgtacagcactacacagcctaattgcaggagtgaccttcaaaggcccttggctgcagggctcccacaggaccagcatcttgtgacattttgctctgtgtacaaaatcccacaggcgctcatctcttatctctgcatatgccagtgatcacagccacagaaaccagaggacagagtataaaaggatagtactttgtctcctaccattttatcttattgtccctctagaatttatattttgtaccagacatattgtaacaataaagtcagttctaagaataggaaaaaaaataacactatgataccacaaccttattacatcaaactgctttgggctttatcctctttaaagtgtgctcaggtgttcagccacgaggtttctgacagccctcataagacctccaaggtgtggtgtgctgattctggcttccagtctttgggatccttcagagcttagagtctgtttgggagacagcatcccctccatcccttctggggaaagatttagaagcccctggcaatcactttgtaccaagcacatttcaagccctgtgaatctcgattatttaggatttggattctggcaaatcagtaactggagtaccctctcaacacagcacataatcatatatggtctattccaaaccaagacctttctccccaaacgtggtgttctccttttagaaaccaagccagtgcttttcacatggtgaaaatacatttcaaatgtgtgacaggctgtgaggaaaggctttcctgggcagactaaatgtataacacttgggacagagtatcttttcccaaatgggaaacaagatgatttgggtcaacctgtgctgagactgtgttggtgatgcagggatgttgggtgtcatagatggctttgtgagctgggaatctgaagaagcatgttctaatcgagtttctggcagtcctctccctgttgaacaatgaaattgtgagaccaaatgttgaccacgcggcacttctttgttaaagctgtcagcactcactgacgggataaaatggcaccagctgcacatggtcagagtctgtgaggccaaaacaaagccactgttctagaatgagccaattaaccacaccgtttggctgaaagtggcttctgcctgacatctctgaggtagatgcaaagtcccagttgtccagagttgaaccagtggtaaaaatgttaggccccagtggttctgagcggtgcaaattgttctaaggtgcagagtgtcagtccaagtcctgccaggagcagatgctaagatgggatttatttgggggaatgcaaggagtttattaaaggaaatgcctgtgtgagaggaaagaaagagggtgctggagttgactgggagagccatcagccccagctcaagcgcaagcccgagtaaaggagacagggaaggcagcttgtgaggtgtgcagtgtagggaagttttagcaaagcatccagatgcccttgaggcaaattaggccaagaacagccctgtcttagtatccctgctgtgatcagtccttgactgggagctgcctgtcaggggctccggccttggagcaaatgcagtgatggattccagagggtgattcgtcttgcacttttcagctccatgatcaaggctccacatctcaaaactccaggcggcacagtttattatcagtgatgcccccagtgatgtgccttgcatgggctgcacagctccacacgatggtcctgcttagggtcacttgctccccaccatggtgactgctcaggcagacccaccagtcagcaccatcagctactttccaggtcccccattcagggaatgtgggaacatgaagagattctcggagccaggcctaatgatgctgagacgccagcttctctgagcctattggcagctggggaggggtcactctcctagcacacatgttccaaatcccaaatgagaagtgggcacaaagccccttctcagtttttgacttcaccccaccttgccccacttatctacaaacctccttcctctgggtctttggccttttccccacattagagaggacacaccgtgaggtagactttccatttgcttttcctttctgaatagagctgcttctacattggtggttctcagctttgattgtaaatggaaattacctgggagtgttcaaaattccacttaggccatactcccgaccaattaagtctgacatttttgggaagggaagcagtcatcagcattttaaaaatctccctgagtgactccaatgtgtagccaagatggataaatccttctctacagtcctcttctttctcaggatgacgttggcctttcccgcttctcaatgactacaatggtaatctgttgcttaggaaatgtgatgtgtagtgtagaagaatgaagccgaagcagaataatatttctaatatattatctgattacagtttttatcatacaaatgcttagttttaacatttaggataagttattttggtttactatggttatagagcagaatgtcaatgttaccattcctgaccatgggagagcacgtgtgacagaaggcaggaagtgtaacaagagaaggaaagctagagggaaagtgtggagaacttgtaccctctaggagcattaattaaagatttacagataaccaatagaagagctagaaagttggctgggcgcagtgactcacgcctgtaatcccagcactttgggaggctgaagcggatggatcacgaggtcaagagatcgagaccatcctggccaacatggtgaaaccccatctctactaaaaatacaaaacttagctgggcatggtggcgtgtgcctgtagtcccagctacttgggaggctgaggcaagagaatcacttgaacccaggaggcagaggttgcagtgagccaggatcacgtgactgcactccaacctggtgacagagcaagactctgtctaaaaaaaaaagagagctagaaagttacgttagttatcaaaatctaggaagagaagagggtggcataagtaatatatatcaccattggttattgcaagagtcaacagctacaacctaaggcagattgaacaaaaatagcaacccaattccatgtggtgtaaatgtaagatgatgaagaacctaaaatagaaattgtaaagacttgactcgtaggggtggacctgggatagggaagatgtctgtactttaccttgtacctgtatctaaaaaaaataacaaattaaaaaatagatttgagattctatacctcagtgcatatcaaggggtagtttgggagaacacctccagtcaaggccatgttttctacaacaactgctgcatatgagaatgctgcaccctgaacccttgcctgcagcactgttaaatgcccaggtgacagtgctctgactctccatggccacgttcttccattttagtaagtaaatggcctaccacagtgttgctatatttattgtcttttaaatgttgtatcatacccaggagagagacagagaaagtaacattcatggagaatacacagagtgacattgcaatttaccacctcgcagattcctctgaccatagctgtaagtaatggcatcctattactgccagaaggtttagcagatggttttggtctatgtgccaggtgcctttaggtgttctgagaatatctgttgagataggccctgtgtaaatggagcactgtattgaatagaggaactgtgatgtcccatcctggctatatctaccatcaactggttccacatttttaactgcgacatttaacttctgtaggatcggcaaaatgaagggatccactgactcaaattaacatccagccttaacactttgcacatcaagggtttcttttagaatagaaagtgtcagtgttggactctagtctttgctaaattttttcctatcacctctattcagctttaaaatataggtctgcctgttatgcaagtgagcaacatgccttgtcttcaaatagactaggtgaaaattccagttctatcactttttggctggatgaacttggacatgttacttaacttcttcaagcctcagcttctcacctacaaagttgggattgggtgtttactattgttatgaggatttgaagctgcagtgtatattctccggttctaaaagattctcgataaatagcaacttttgttacactaaggaagaagttagaagaataccatgctcccaagattggaagacccaagatcataaatccacagggaaaagtcctatgtggatttgcagattactaggtcagatttttcccatttctctcatttgtaaagcaaccagccttctgttccactacagagtctgtgtgctagggaagactctgatcaccatctgggttcaacagaagccaagaaaaataacaggacagcaaattaaatatccacgggccatgtccccttcctgtccctggctccccagcctaagcatctgctgtggtttcaatacacctgaccttccttccatgcatgtcctttggtgagggttcctgtcagggcaagtattcctttggccaagtaaagaccccgctctcacctcccaaggtaactgattttcatcctttgaagttccttgacttgtgcaccttctctctgggttggggttagagctctcttataatccattaaatcaagtcctatattctcatcttctatctataggaaaatgagagggaggcagaagagtcaagaaaggaaggctatatcctaatggcaagtttattttgctgttggacatcacttactcttcagtttcctcttttttttaatagaagcaatatttattcagtcctgcaaaagagactttattattttagccttgtgactgtatattgtttgcccttaaagactaagaaggaatcacctgtttatatgtatagaaacctggtcatttgtttttaatttaacaatattgttataaagtaacttactgttgatttaattattaaaactaagcagacaatttaaatgtaatttaaataccatgtgttaagtatacaccaaactgaaacactacagcactcttcccagaagtaacatcctgagtagtgtaatttttttttctattttttccatctctgtagaaaataaaacagcactgatctggggaattggaggtccccacccaattgtcgttattaaactatctcacctagtcctgattcagaggctgcagctctgtttatccactttaaacaaaaggagctatctgttgaataggctctcttacagaatttccctggatatgtcaaatgtttatttttccatgtaaattttataattggtttgtcttgttctaccaaaaaaagaaatcacaatggatattttattgggattaattaagttaaatttaggccatccttacaatgagtctttcttcccaaagtagcctttgtgattaatcttttatagaatttacatttttcatttatataaacttttaatatttttgttgcgtttactgttgactaaacttttttgttatttttcctattgtatagttagcttttggtaatttaataacattatcgaagctgagtgccagaactattgtggttattcactgctatttttaacttttctttggagaattgtatgttaatattctttgtatttctagcagttattcatctttgttcttattgatttataagagtatttttaaatatattatgacttttttatctttggtttggaggtgtgagggtgtgagggaacttatagattatcctgtcctgcccatttttcctactaattaagaaactgaagtgagatgacttttccattgtcacacagaaacttagtcctgattatccaatcaggactaaaaataggtcttttgggtccttattttgaggtttttctctcaagtacttgcctccttgtctacagttttatctttttcctcttaaattgacactatcaggttacttgatttgattagaagtaacaagttggttttctacctctacaaatgaatcaccaagaactgattcatttcttggaagttattgacaataactcccaaatcttgtcagtgttggactgtgggctttgctaaattttttcctatcacttctatttggctttaaaatataggtctgcctgttatgcaagtgagcaatatgccatgtcttcaaatagactagaagaaaattccagttctatcactttttggctattgccaaaaagttgatatctcctttgaactctagatttttctaagacatctctccagttggatgtctcattgacattttcaacttaaccttttcaaaaatgaggggtttttttgtttgtttttggtttactcttgttgcccaggctggagcacagtggcgcgatctcggctaactgcaacctctgcctcccgggttcaagcgatgctcctgcctcagcctcccgagtagctgggattacaggcacctactaccacgcctggataatttttgtatttttggtagagacggggtttcaccatgttggccatgctggtctcgaacgaaactgagcttttaatatccgcttcctcatctgcaattcttagtctccttcatctgagcaatggcaattccattgttcttaatggtcagattcaaaattgtgcagtctttgactattccctttatcccaaacatccaattcatcctgaaattctattggcctattttcaaaatattgccagatatgttcacttctcccatctcctccaccctcaacctaatcaaaactacctttcacatcaatgattgtcatcactttgtatttggttcccttgctttatctgtaacttcttgtattttattgtcttaccacagctggagcaagccttttacaaaataagaatataacaatcttgaaccactgccctctttcctccaagtttctttttgttttctgatatcaatttccttaattcactcatgcctttgtttgtcttcaaacagtataagcgtactcttgcctcaggacctttgtacttactactactcctttccctgaaatgccaacctccacacatactcaaatataagcacattggctgcaaggatattttctgctttgtggcttctgtatcctcaggacctagacagtatctgacactcagcaggtacacagtatatgattgcagaatgattgattgaaccatacttactagcaatcatttttggtggtgttgtgaaggatattttgaggcatcatgtggtctttgcagaactggttgaatttctagaactaagatgatactgctcacttactgatttatttgctttagaatgaaattcaaattcctggccttgtcagtttccctcctttctctccctccttctccactctccaatcacaatggtctcttttcacctccttgaataagccaagcctttgagccattttgctggaggtgccccctaaggagaaacatctgtttctgcatcttcacatagttgactcctcagagtacatatatcaacagcaaataacttacctatcacttctaccacatattgccagaggctcacatttcatgacacatagtgggtacttacaaaatatttggagaatgaataaatgtcattagcctagcttctaaagatcatgagatgcatgcccccatgacagcaccagccacatggtgctgaaatgatatatttgtgagtctgtctcccacagagtctgggagaacctctgagacagatataatgtttaattcatagtcactgccccaccgtctcctacacctagtggcatctagtggtattccatagatgtttgctgaactaacatgaagctacagaaaggcctttagccctcttcatcaaattcatttcacttgagagatggggaatatggagcacagaaggtaaaatattaaaaaatgaatattatgagatggctcaggaaggccttatgaggaagaggacaacgcagagcaaaggtgtagagaaattaagtgcctagaattagctcccatagggagaagaaatgcagcagtgagatcatcggtttaggtactcatttcagaacaatgccaaccttctggtgctagaaatttacaaggcctttttttttcaaggctaaaaaatgatgttactgatgtgctatatgtaatggttcctgtgagtaagtcatccttttgactaccaaagcatactctttatagtagctgtttcaatgttccccattctctctctctcttttttgcttttcttctccaaaccccttttccttgcagatggtcttatctcctactttgctgagaaaatcaaggtcattaaaggggaaatctcctaaccttccatcttccccaccaaaattatctttaaccggatatatgtcccctcctcatcctcttctgtcttggcatcatagccttccaatattgaccctaatattacatctggattcctttctttttttctttaatcatctgacatactgtatcctcaattatttccagttttccagcattatacaaatcttttttttccactgattccttctcttggaccttcaaacatacacaagtctttcttgtcttgcaaggaaataattgttgccccccttcaagccaccatattttcctttgtggctaggtgtcttatatgccttcatgacttaactctctctattctttcaccatatagtccttcactatcatggaatcctcatgtttcaggtctcagctctgttaacatgagacatcccagaggcttctcttcttttatttaaaaagtcttctttaagagtttttctactctccccaataaaacaataaatctatttccaggatcactgagcacattctgagggccagacactgtttgggcatcattcatcaaacatttgaatgagtcatagaaataggacactggactagatggataaacattgaggcaaacataaatatgtttttccaggggtacaaagagaaccaaaatttgaaaaactttaaaaagaacaaaccaacttagaataaaaggtataaaatggtaccatacatatgtacacatttttttatatactgtagagggtggtagatggacaactagccgggtttgcatctgaggagccacactggtggaaataagggccatgctgggacctgcagtgtgagtagggttagctaccttaggatgggggtgggttggatgttgcaaggaaaaggaggagtacagtcaagcattataggaaaaaatgtggcacagtgtggcgcttgccatcatgcacccacattcactggagactttccttgcttgcttcatattccatgggagttctgagttggagggaggtgtgtgagggactactccacacagttattcaggaacccaggattattccttcttgtgcatcttgtaactctgtattgtttagggcttcagtaaccacaatgtggttcctggcccagcagcaacagcatcacctggtaatttgttagaaatgcagattcttaggcccaccacaaactggctgaatgacaggctgtgagaggatccagaaacaaatgttctaccaaactgtccaggtggttctaatgctcagtcacatttaacaactcctgcccaaggcccggcagaggagggtagggcacatagagatcacacaggagagttttcaggtgtcagccccagcagtagcacatgttgcttctgtccacagttgttggttgctgctcagtcctgaagccctgactgactatccaagaagctgagaaatagcccagctctgtgcccaggaagaaagggctcacctcccaactgttcttcccactgccagtctgttccccttaaattcattcacctcagctaatcatgcaaatctgtgatgaccctggctgactgaaacttccacgggtcccatggccttctgaatgacatttcttagtcccacaaaggctggttcctgttgcctctctggcttcatggtttgccatcccaccctgaccctgaactctaaactccagccgtcttaaactattacaaaaacacctggctgatctttacccagccctgtgccttctgctctgggcttttgcaccttctgctcttcccatggtcctttgctcctggccattcccattcatccttcagggctcagccggatgtaactttgtctggaaatatctccctgaagccactctctacctcccctccacccaagacagggttagatggtctctactaattcagaataatccttaattactttggcttgtaatcacatcagtctgtggaaggaagactgtttcttatatatagttgcttctttgttgcctgtaaagagcttggcacatggtagatgctcagcgaatgtctgctacgtaacgaaagcaaagtggcctactagatgtttagtgggtgcttatcgatgaggacattgattgtctatctcatactttggctaaaatttattattaacgaattcactcttccttaattaggtactgcatcttcattgcagccaagaacttcaccactgactaaaagcatgcagccacgtacaagtgggatggggggaaggaaatccatccccatggacagaaagttaactcaaagcctcgctcggctctggtcacagtcagcccatctttttcacagacaaaaatctgcatgtcttcatcttacattaatttacatatgtaatttacctaataggaaaataaggaagcacagtgtttgaagtgtaatcaaattacattgtttagaaaacagagaaaaataaagcttcctggtgctggcgggtcaacaaagatctctcagtagcttactcatccaccaactgaatcagtcccctgttcctgtcaatgcttctgccatgactcattctggtgggcaaatttttaatagaaaatgataaactcagggatattcaccttaaaaatatgacaacacttcccagggacatgaaaataagtagtattattctccaaaagttaaaataatacctgtactcagaacgtgagtagcaaccactgtcttccccttgcccacagcctccatgactcatgaccgcattctctcctggacattgcctcatcagtgactgccatctctccctctctaactgatttttgtgttggatcctccaataaggagacacctagttggagttaggagagcacagggctcactgaggaataagacatgcggaagttgaatgaagcagcagagttgtgcagggagagacagaggtggcatcgcctgtccagggtgcgcagctagtaactggaaaagccaggatcaaaaccaggcaaagcgagctccagaaaccagtggcctgaacactgccttgtactgtctgtgtcttcccctgcccagatggatagtgcattttattcatactgaaataatagctgttcataattggttattatgagcctaacactccactaagtgctttattaaatgcattacctatctatgaggtaggcgtgggttttctgacttttacctattaggaacctgaatcgcaatgaggttaaataacatgcccagaatcactcggccaataagtcggagaatcagaattcacatctcaaatttatgttctccactctgactccagggtcttttataccgctatttcttttgagttatttctattcatctttgtagttacacaatccaacaaaatataagcattgaataagagtttcctgaattaataaatgaatgaatgaatgaataaagtgcttttccagaaattctgtccagaattatgggtattgtggtcatttagcaaaaagtaggtcattttagtaagcaaatactgctcccaaagtttcagtttctttttttttttttttttttttgagacagcgtctcactctgttgcccaggctggagtgcagtggcgcgatcttggctcactgcaagctctgcctcccgggttcatgccattctcctgcctcagcctcctgcgtagcagggactacaggcgcccactaccatacccggctaagtttttgtagtttttagtagagacggggtttcaccatgttagccaggatggtctcgatctcctgacattgtgatccgcccacctcggcctcccaaagtgctgggattacaggagtgagccaccgcgcccagcctcagtttcttttttaattttagctatagcttttatgtaattaataaaatttctagttgtgaatacattaaacatgcatagtagaagaggtccaagaaccttaacattgttgttttggtgaaaagcaatcagtaagccaatgactctcaagcttttacatgtacaagaatcactagggcagcttgttaaattgcagattacgaggctctgccaatcacaggttcttattctgtacagctggtaagatgtctggaagtctgcattttataattatcctgagtatatccaatgcagatggttcctggaccacatcttgaaaaattcagatggaccagtggggctggcagttgtctaatcagcctccatgtcagacatgagaaaccttgaaacacacgtagcttttcaaaaggataaaacagtgtgatgtccgttgtttcctataacgatttcagagctatattataagacctgagacctgtagcacaaatgcatgtatgtgccaaccgaatcatacattgtgcatgaatgcatgtatgtgccaactttgcttaactggatcatgctggacagagcacttcataactatttaaaacttggtattgatctttagaagaagagctaatgactcattttgtataatcaatgtgtttatggcatctcagaagagttttatttttctactaatgatatcttactgaaattaaggtaccttccactgtaagaacaactcttctgtatatgtcactgagaaggaaaataaaaagctcaaagtggagagtttaatataagacaacaaagagcactaccctcagatgagactgaagaagatataagagatggtgccatccgggcatggtggctcacgcctgtaatctcagcactttgggaggctgaggcaggcagattacgaggtcaggagatcgagactgtcctggctaacacggtgaaaccccgtctctactaaaaatacaaaaaattagccgggcatggtggcgggctcctgtagtcccagctacttgggaggctgaggcaggagaatggctgaacctgggaggtgaagcttgcagtgagctgagatcctgtcactgcactccagcctaggggacagagcgagactccatctcaaaaaaaaaaaaaaaaaaaaagagatggtgccttggtttatggccctctaaaagcagatctataggccaaatcttgagggcaggtgggttacctgggaggcaatccgaggaagcacatgtgaggaggtggggaaatgagaccgagaatggaaggcacccattgaagtatgatcatgagcagactgtcattgttagcagttgggactcaatcccactgaggcctctgtgaagcattctgtagaacacacctcagaattgtacagtcatgggtagggaagctgggctgttacccagtgactccctttccttattggttgaagtttgtctgggggtggggcgagtagatctccagcacttttagtgaagagcagtcagtaagcaaatgattcccaaattctatgcgctcaggacccctgggctgtcctctacaagggctgaacaagctacattggtgcttttggtggagaagtagaaaaatgtaggcacttgaggagggataccatcagagtgcagagatactgtcccctgcagctgcagtggagctcagaggtgggctggggtgatggcccaggcatcaacaatagctgctccaaatagctaggagacttaggtgtcttaattgcggcattgattaatggaggtttaaaaaatgtccccttaataatttggatcacagtctaatgctaatcatgcaagtttgtgtcctaaattcatacaagtgtggttcatagaagcctcagttagggactttaagtggtttcaggttgataatgctgcctagtgtgactaacaaggaagtgcaaatcctctctgtctgaatgtggcttcaatccagattaatagcaattgtaaggctattgatcattctattcatttcaacttcttcaatgtgaagatgtagaaaaaatgtcttcaaaacaatgaaatacagtagtaacaaatagctataaaaaatacaacttccttcctacataataaaaatgtaaagagcactactttttcacccaacccatgcagccatgttcacacacacacacacagacacacacacacacagacacacacacacacatgccaactaccacatagcctctttgtaatggaggacattgactggtaaaggagagcctgccttctttctttctctcaggtctacaaccacgcaaatgatcaatattctattgaagtcagccaaatagcaaccagattaaatacgacagaaccaggaagctgaaaattgagggtagctattcgtataactcttttatttgctcaaaggaagccacagggcaaagggggagggggtgttcctgcttctagctgcattattttcaactttcaaatttttttttacgagcaaaaatgtctatgtaattctataaaaagaaagaaattaactctgctgggtttttttcctctttaaaaagcctgctcttcaggtttttatttgcagactggtctaggctttttgtttgtttgtttgtttgtttttagaaaagcattgtgccctgagatcaataaatcaaaactggattgccttcttctcaaaggtgaattgttatcttgccgaagaagttatgtgacagactctctagtttggtaaaaatacatgaacaagaaaaggattaaggtgtctttgcctgaaaggaaaattctggatgctatttttttctatgatagggaaagtttcttgaactgtctcctggaacaagaggttaaatgtcagtagctaaagcagctgtgggcccattatttggtgctcgcagagtccattctgtcattggaggtgctgttttcacacagagaatgaagtcagcttgacaactgcaggaacagctgtggcagcctgagatatgaggcaaggaggcaaagcccaaacagagggcaaagaacatctgtttgttgtcaacattctgaaaaaagcaaaagattcttgactatgggagagaccagggtacctggagataacagcagtcaagacaaaagcaattttcagcaggcagaagtcaatcaagcttgaaggaaaaggccagttaagatgcttagcacccaggggttctggaagagtgctgagccacccagagatgtcaggcctgagtggagctggtgctttgatatgaattcaggaagccgcctggggatggcgggttgggggacatcatcacagacccaactgctgtggattgacctctgccattactgctgggaccccaggccctctggtgctcaagaaaaccataaagccttgtgctgcctcatttttagaatctgttccctggcattctaaaccatgccataatgcatttctaaccacagggataagagatccaaagcaacattaatctggttttccagagcagggccacagagtgatcccatcttagagaattggccgggcatggtggctcacacctgtaatcccagcactttgggacaccaagacaggtggatcatctgaggtcaggagttggagaccagcctggccaacatggtgaaaccccatctctactaaaaaaaaaaaaaagaaaaattagctgggcgtggtggtgggtgcctgtattcccagctactggggaggctgaggcaggagaatcgcttgaacccaggaggtgaaggttgcagtgagtcaagattgcgccactgcactccagcctgggcgacaagagcaaaactccatctcaaaaaaacaaaacaacaaacaaacaaacaaacaaacaaaaacaaaggagaatcaaaccaccaagctttgatcctgaaacatctgaaggggaatgaggtccatgctacagggctctgcagatcctgcaggaggggagagcctcagtacaccaccattttactgtattcactgccacagatggtgcagatcatagtgatgtccctggcatgtgacaggaacttactgtcttcattgtgaatgagtttacttgactatgcctcccccaagaatctcaggaatatggaagatgtttgagtccattactttcaagtggattacagttgaccaggcaggcctgtgaaagaaagtttagggccacctttcaaattccagccccatttcacctgcctctgcaaggctctctcaccactgtcactagtgatggggtggaaatatcccagaagtagagttaggagaacatttggtcccaacctcattgctgggtggcctggagaagtcatgccacttctctggggtcctctgttcacatctctaaggggtttaattggactgggagacagtcaaggagttttttttattttttgaggaaagtggccctttttcagacaacaaaagacaacacttgttcataagcctaaaaagtggaataaagcccctacgaggagggtttcggcaaaggtaacatcaacatctcacaggtagctttgacttctccttagccaaagtcatctggctgagtttagtagcacttttggttgcatgtttagttaatgtgacctagacactctttcaggtgtgtgtatgtgtttgctctgggagtaattaactctcagaaggcataaaaatgtttaaacccaacaaagatcaaagattaaggcccaagtatgtgtgatattgctttgtgaaaataagctgcctagaaaatgggctttcacttaatgcagatgtgtttggaaacttctcctagtaggaaaaaaattctatcatttttctctgaagctgaaagaattggtgttgagagactgagaccggaaatggaattagcttagcagaaccgcatgcatttacttccagttcagagccctcagacagccttcctctaatgcttctgtaaaccagcaagattatttcttggatgcagcgtacatttctagtcctttggtcatggacaaaggtgatgcactagattttattaaatattcagaacaaattatgctatttaggaaaatgtgacctacaaacaggacaagatatagcgcaaataattaaagacatctataattaagaatgtataggattaagttattctttgactgaagagctagatacataatcatgcaggatttcaaccctcgccatcagagatgcttcttctgtgggccttaagtgtatgatgaagtttcaaagaattcagccttggttattttcagcactaagttccttccttgtgagatttcacataaagaaccattgaaaagacagaagttgcccccactgtggctccttacatagttaaaaccctattagagtaaaagaatcaagaaactcctctggaaaaagtacatatctctgtgttcactaggaccctgctgtgtacagatttagctggtttctgcagagaaacaaaagccacaaaaggtgcatgatggggtggaggggagtgttagagacacccaatttgcattattcctgctggaaagaccctgatctgagatcagctctggcagcccccagctgagaagggcctccttatagtcttcatttcattccagccaagccctggaggggtggagaatgcataatgaggctgaatgagaattagatgcttaattgaggcctggaaaagggaaagaaaaagccagacatgtggaatgtgatcagaatgcagctcagttaagccaaatgtgatgacacctgggaaggcttcagtggttgggaccactatacagagaagctggaactcctttgaaactgactcatccatctagttccaactcaaatgttattttcttgtcctcaaagatttttcttcatcctcacaaaaggtggctcactctctcctttgtgcatccaccatgcttggttcatatgacagtgcttgccatttggcctcgtgggtgggggatgactttctctctgcgttggctggcttgtgaactccatgagggcagaggtgtgcctcattcattttgtatcccagaacataataggcattgaagtacctggtggacattttttttttttttgctcttcttcctaaatactgagttctctgtagagtagttattctgacgatgactgatgaagcatttccaaaccattctcaaagaggcatatggaggcatattatctggccaaacataaaagtatttctatatatcaggatctcgtgctcaccctcagctatcatcactgcctttcatcacttggtaaagacagtttctgattttgattagggtagagtattcccaactaatacatgaaaatttctgttgccatggaaagggtcttttgtaaaaacaggcacaggcacattttccacaagtatgttcctgtcagtgtaatcattcactatttgactttggagagggggccaaatgtgtgtgtctacagtgtttgtccaagtgacgaagagaggttcagtggtcaagtagcagctttaggatggaggctatttggaaaaaacagactaggtgagtaacagatggcatacaatcaattgtatctttgtcctaaagaagcatggactaagtgtaaatcaagtgtatccatctgctcggctgccataacaaaataccttaggctggggcgcttaaacaacagaaatgtatttctcccagttctggaggctggaagtccaagatcgaggtgctgctaatttggtttctggtgaaaatttgcttcctgtttcatagacagccgtcttctcaccgtgtcctcgcatggcagagcagagagagatttctctcttcttctttgcataaggccacagtcctatcagattaaggtcccaccctcatgacctcatttaaccttggttgtctccaaaaggccctatttataaatacagtaacttgcaggttggggctacaacctttgaattttgggaggacacaaatactaatccatcatatcaagtctgatcagaaccatcatttgaaaaatattcttgaaaccagctgctggcaaaggccaggtgcatgtgacacccacaacgaatacctagaagaatcaagagcctctgaacacctgatcttgggtgaaagaaggtggtgtgtagtcacattttaaaaccttactctcctccaaacttaacaatatgaaggaagagaagtaaaacaggcaagcaagtatcatcaacaaaaacagtaattaaacgaaagaaagggtgggtagccagcaaaaggaaggcacctttctggaaatgtgcggaaggaacgagcctggtgttgccctaccccatccctaactctacaggctcagaaatcatcctgaataagatcacaccagctaccatttacctccctaactaggagagaaaaggccaaggaaatttccacaagagcatgaagtcagccatgaacaccttttactcagtctttccccagagaaacaagaataacctttgtaatcctccatgtcaatacctctgaaggaaaacgggaaagaaaaagcagaccaataacaaatgactagaactaattatctctagcaaaatcccgggaatttcacaaaatagaaaatttaagaggacatacataaggcaaggtctctggcgtgaacaagaaccagggaaggaggtgctagcaggccccaggtgatgcttccttgaagaaggagccaccttcgctctctgacaaggctgcagagggtttatcacctgctagggtggaaggctaagaaagaaaacagcaaaagggaacagaggaactttcagactgactctttctcctggaaagttctgagtctcatgttgaattgaaggaattatccaagccccaaagatagtgcccactatgggaagtccaagccccaaagatatcccccactatggaagtccaagatggcaactgtgcagacaaatttggggggaacctgggctgggcgtgggatatgctatatacttgctgagaaatccaacacaatgaatgtggctgctttacccctcccaaggaaaacctccaaatgaaaggcttctaggcagctgctggaggaccaaggagccacagagcagtatagaaagggagcagcttgctgacatgcatgtggcatacacatcaccctgcaagcacactgaaaccttgactgagaaagagagggaaggaaggaagagagcaagtgagcatgcaacccagtaaagggcaggtgaagaacgtactgtggaagaaaacataacccaagagaaagatccaaattccctgcaatgaccacagatgaactttgaaaaaatgttaacaagcttgaagatgcagtgataaaaataacataactgatctgaaatgtaagaactaaggagataaatgttccactcttagagaaataaatcagttaagaacagcaaagaccaaattactgacaaagaaaaaaggttgagattttcacagtgaaaatataatacatatggaagagaaaacacaaaaattgctctatgtgagaatgataggtgtcgctgaaatttagaagtcaatgtatagaacagaaaatgtcttaaaacaaagggaagctgaattgatgatctaatggtcaaaccatgttttaaaaaatcaatacagaaatctcgtcctgaaacacatctttgataagtttaacgatttttaataaagaattttatggttatactggcacatgacatgtcacttaaaaatacctaaaacttttagaagaatacatagttaaatttatttaatgtatcttaaagaaaataaaaagatgacaatccaggagaaaatattcacaatgtattagacagggaagggttaattttcttagtttagaatatacaaaaatcatggaaaaaaaacaatcaaataggaaattggtaaaatataaaaacagatgacaaaagacagggaggaggaagaaaagaagggaggtagaaagggtaatttcactcgtaatgtaaatcaaaacaatgaggacatactgttttcttccctgaaaagtttgagtatactcactgctggagattgcggagaaatcattatcgttatcattatcatgctctaagtgatctgattgatctgacctttttggaaggaaattttgtaacatctatgaagattaacagttcacatacactagatctagaaattcactcggaattcatccttgggaaatatttacaaaatctttccaaaatataagtgcaagaacattcactgaagctgtttgtaaaagcaacagtgtagaaacacatcagaagtccactgatgtgggcctggataaagaaattatgatatatctatatttatgcaatgagatattaacacagattacaatggcatgctcatcgatatatagtaaatgcatatattgaataggcactaaaatcaatgcacatattaaaatgcaatactaatcaatgcacatttgctagtacctgctaataaagtatgtacgtattataaatacatatatttatgtagaaaataaaaaggccagactgcagagaatagaaagtatcatctatattttaagtaaatgaaaactgagatgagagagggtatgaagtagggcaagagtgggaaaagagcaaagagagagaatgaaagagatgggaattgtgtgcattatttttttctgggaaggtaataggaacattttaacatggaaagagttgttcagggtcatttttcattagcatttttctgagcagtttgaaagtgttaattatgtgtaagtgtcctttctgttgttttttaatgtcactacagttatttaagggttaggtttattgaactttatctttatttctatttagaaataaacgcatgctattttaaaaagttagcatatagtatgttttcacctgtaagtgggagctaagcaatgagcacacatggaataaatatgggaacaatatacaatgtggacccttggagggtggagggagtggagtgggtgaagaaactaccaatcgggtgctatgcttaccaccagggtgacaggatccgtactccaaacttcagcgtcatgcaatattcccaagtaacaaatctgcacatgtacccctgtatctaaaatgaaacttgacattaaaaaattatatattaatatctcattaaattgtagtttgttttggttaattaaatcttcataaaacatgaaagtgtccataataataagtcttaaattcaaggaagaaaggaagaaagaggggagggaaggagaaagaagggaggcagggaaggagagaaggagaaactaggatgcaggaaggaaggtagaggaaggagggaaggagggacaaaaagaaggaagaaaagagggagggaagaaagaaaaggaaagagggatggatgagaagagggaaggagggaaaaaattaggatacaggaagaaaggtggaggaagaaggagagaagaagggaagaaagggaggagggaagagaggaaggaagagaggaaggaagggcaggaagggagggagggagggaaggggaggaaaaaagagagaaggaaggaagaaacaaaaggaaaatgaggaaaaggtaagaggaaggacaggagaggaggggaagactctggacaccctatctactaagaggtaaaaactgaaaatgcctctgaagagcagcacaatgggttaaaagcctttgacttattttgcgtgactgtgactaaagaatttaaacattacttttgactaaaaacaattattcttggcacttgttaattaaaacagcccatttccaactaaaaacttaaagactgagagtaaaatagctacatgttaataaagtttttatatggaatctgacttttaaataaagactggaccaatttacctatagtaaattgaaaagaataaatcttgttccaaagtcagaaagagagactgtgtgacattttatttttgatacttatttgttcttcatgtagatgtagaatgcaagaaagctaattatggacaaggagaaggaataaaagaaaaatacaatgccgaaaagcaacagtgctttctcctctgagatttaatctagctacatcagagctctaattcatttaactttttaaattaagcttcatacatagtaggtatgcagcacaatatgctggctgtataatagaataatgaatgaatgataccccagaggagggatatgtggtaaattattgaatgatatgaagaggtgattcagctaggtttgtgttcttaagggtcagtgataaagagatacccagaagtagccaataaatattaatcaggcatttatgatagtcagtcattatgtctttcaatcctccagttttatgagagagttatcattaactccctctacaagtgacaaaaccaagactctggaagtgagcagaacttgcccccaaatcacataaatagaaatgccaggacttggatttgaaatcagctctgcctaagtctagtgagttaaacttcatcccctttcactaatagtgacacctctgagaaagatagccagaagtaagcagacttgaggttcagaacctatcacagtagggggtggggtgggggagaaagagaaagggagagacacagagagagaaaaaatcaaaggcatactcaatgagagaaggaatttctagaagttggagttgtggtttgttgaatggcatttgttgtagggaaagtggggtaaattgctacctgttttattttgactcctttcacactggatgaattttaagagcaagtgtttaccccttgcacccctatggattttcacaaaatacctgaatatgaaacctggacattactacagctatgtgaatgaataaatccatgccattatcaaggactggaatgcttttttagaagttaaatttatttagtttatggctgttggaaccacatgatgattattttagataatgctgttgacttcattataaggagcagtttgtgggaaagcatcattacggtatagtgtaccgtggactcagcttctcttcaagctggtgttgatattgacgctgtgttattcctcattaaattggtctttgatctcctttcacttagttgcacatgcattctagacctagacagtgaactgggaagtctaggggaaaatgaaatctaattgagctcatcttttccaacaatcattagcttaaaaagaacataaattcgtgtctgtgcatatggaataatagccttcttccatccgagcttgggagttaaatgtacgtgcagatgccctaaactccaagaccagttttcttccattttagaaccataccacagtgagcacagtttattttttgtttgtttgtttttggtattatattcagttttaacactttattattattattttatttttccataagttattggggtacaggtgatatttggttacatgagtaagttctttagtggtgatttgtgagatcctggtgcacccatcacctgagcagtatatactgcaccatatatgttgtcctttatctcttgccctctcatactcttccccctaagtccccaaagtccattgcatcattcttatgcctttgcgtcctcatagcttagctcccacatatcagtgagaacatacgatctttggttctccattcctgagttacttcacttagaatcatagtctccaatctcatccatgtcattgtaaatgctgttaatttattccttttaatggctgagtagtattctatcatataactaatatataaaatataatatagaatataaaatattatatataaaatataatatgtaatataaaatattatatattatatataaaatataatataaaatattatatattatatattatatataaaatataatataaaatataaaatattatatattatatataaaatataatataaaatattatatattatatatataccagagtttctttatccactcattgactgatgagcctttgggttggttccacgattttgcagttgtgaattgtgctgctataaacatgcatgtgcaagtatctttttcaaatgtagaactcccagttaatccagcaatcccactactgagtatctacccagaggaaaagaagtgagcagagtttagcctgttaagggacttctcctttgtatacattaattcagtgtttctcaaagttatgtacactcaccatttgtagtttgatagatgattttaggtgatgtaaagattaacacattatggcatgttaaaaaattagccacaaatgaagctcaagatttcatagctataatttctatgggacaaaattaagaaaaatttagaactgaatcgattagaagtgtattattatgtgtgttagttagctatcaccacagtaatgtaatgcttcatctcaaaccatcttcaacctcaggggatttagaacagttgtctgttcttttgctcatggatattaggatcaactgcaactagtctgggccaggaagtgtatccatccacatgagctgagtcctggtctcatcctcctcggatgagctacccctaaagcatgttgtccttgcggtaaaaggtaggagaaggaaagccccaactgtcaaatgcatttcaagtctctccttgacacacttctgctaacatcccattggccaaagcaaattttgtaattaagcccagcatcaagagagagtgaagtagattcccatgagggtggcaggtaggaaggaaacatttctgaacgcattatctaatccaattacattaatagtgaagttggaacataggtatggcaaaagttgtcaaggtggttcaagaaggtttgctttcggttgataccactttaattcaatacaattgaatccagacaggccctgagctctgtacctatcatgtcacctatgcaactacagattctgccaaataattacttgtaattctatttgttgtgtgaagtttactgtcaatacacatctcaaaagaaaagcttggaggactcctcccccggccagcatctctcacgtttatatatttaaaagtctaattaactacattctgtgtgcatctcagtatcttttcttctatgatgacatctgcctcatttattactttttatgtaactccactaacctagaaaaaattgctataatcaagggtttgagcagtacagttgcagttgttgatagaaaatgaaaatagtactgaatgtcccagactttttctatttctgcatcttttatcccctgctaggagctctggaatgtacctcttgtttgtgtttcaaccagcagcaatccaaatggaaggagggacaggcaaactgtaataaataggccacagaggccatttttgtttttatcagattatgttgtctatgtgaaatggattcatttctgtagggcatccagttgcactgcccagcgatgtagaagctattaggatagtaccagttccacatgcatgacacagtaagaaatatctgtcattcctctcccactttccaaacaaacaactcacacacacatgcacgcacgcacatgcaaattcacataaacataccattgcacacatatgcatcatattcacagtgcatgtccacacatacaggaaaacctcatgtgcactcatgatattaaattaatgaacaatctctaccaaacatgatattggagtcttggaaagcagatctaacagactatacttccctctgctccaggaatatagtggtatacagagctacaactttgatttctgtttttttctctctgtttcatggatttcaaatctgccattgaatctcatactaatctatgccaatactgtggcacaacctgagatttctcacacattccattgtgaagtgaggttagaaggacaagcatagggctagaaatttaaatgtttactgttttctgatttgctatttgcattttgctttcttcaactttttcctctctctcacctaacttttgaaagtgttttgtaccctcccttatttcactaagcattgtttaatagactagaattatgcctattagatagaaagttctctgtgataccagaggggtttccccatagtaatgtaaccagggttattaccattgagagtaacaacttagaaagatatttcctgaaagaatcagctacaggtacctctagatcccatcagaaacaaggaccctaagaaaatagtcaagaaagtaatgcttagatagagcttatcaattaatttttccacagtaatcatttcatataaataataataatattatattttaaataggtctgatgatgtcccagagagttaagatgagtcagaatattttataatcattttactagtgaaaaagccaaggcttttaagtgctatgagatttggtcaaagttattgaaaaaattaaatgaccagccacaatatcctcttttgtgacacgtctgtttgtgtcttgtccactttctgttgggttccctgtcttttcaaggttattttgtatgtttatttcttatatattctgtacaggagtcttttggcttattttcctctcccttagcatgttttgataaacttattttaatggttggtgctttgtcctgtgtaagaaattttgcataatgatgtgaaggtctttgtccacattacctttcacatttatttctttttgagggtaggggaaactatttcttcagcataggtctgtggacaccaaattctctcagtcatattctctgaaaaatattttatttcaaattcaaatttgaaaatctttttttttttaacacttcaaagatgtcattgcatcatctctggcttccattatttttgttatgaatttatctataagttttattgttattttgaagttaatggatctttattcactagataactttttttttctttaatgttggttttcagcagtttcacaatgattagactgagtgatagtttttttcattaattttgcttcggaatcataacagtcttgaaacagtggtttgagatgatatctgatatctttcattaattttggcaaattatcagacattatctcttaaaatattccttttgctctattttacataggataaatcctatctcatatggttccttcactcttatctggggttttcatctgcaatttaggcttcgtatctttttccgacctagcttttggcttactaatcacctcttcaactgggtctacctgctgtcaaaatcacctatttaattcttaacttgtttttgtggggtttttttttttcggttctagaattttcatctgacttttgaaaaagtatccagctctctgataaactactttgccgtaaaaattattcaacttggcatccaatttccaaaatacattaattgttatttaagctgcctctgcaatacctggatctctgatgtctatccatatgtcatctcttttattctcttggttttcagtgacttgttcttgttcctctgaaatgccaggtaattttcgcattgaattctggacactgtttgaaaaactgtagagataacttgaggcttttaatcttcctccagagaagatttacttttgcttctgacagcagagcactataattcaatcaggaattgtattaattaaaagttagacttcaggtttttttaaagagatggtctatttcaagttcatgcttgtccccaggatataacccttcagggtaccccaccaaaaacctgaggtagttagcagggtacctctccttggtagaacccaaccttcaagttttgctccctgcccctagcctcacaaaacacctgcaggctctattcaacttcttgacacatgtgcaatgtcagcttcaccattttgcatttcctcaggtttgtcctgcattcatagcactctggggccttacaatgctattttaaataatatgttcagtgtttctagctgttcttggtagagggttagtctgaatcattacagtccaccttaggcagaatccctttctcattataattttaatttgcattccttttgttgttagcaaagtaaattaccttttcatgtgttttgcaggccatttttatatcttcttttattaactgtctgttaaatctcttgtccattttcctattaagttggtggtcttcttcatctccatttttaaaaggccttatatattaaagattgtagtaacactttgtctacgataaaaggtgcaaatattttccctcaatttgtagctttttaaacatttcttttggtattttttccattaaaaagtttattatgtttataaagtcaaatattttgttcttgctccctattacttctgtgttctaaggcataattagcaaagttttcctgctcgcaggcttaggggagttcacaaatggtttcttctgtaattgtgtgttcaaggagtatgttgatgaacaattgaaaaatgatatatttctagaataggcagtgtgagaaaggtattatatagtgttaacaagtccagttggaagttccaagttttgtttttccttttccacctcattctcaggagctagtgaaaagcactgtggacacagtgactttcatcttgtccttgaagagttgaggagaccatgagtcctttttttcccttgtgttatctttttcctgagttctttcatctactttcatactatgaatgttaccctatcttggtgtcccccaaatacccacatgttccattcataattctcttctcataattctctccccagtgctagatgcaaaacttgtttgatatctcacataaatgcccctacacttcaggctttaaatctaaaatgactttgttcttcttttcccactctgcttgttttatatgtcatcaattaatgacctctctgccattcatctacctaagctcagagcccagtcacctttgaatcatatttcttaattgtcaacctcaatacaccattaccaagagtacaaattctacctctgaagatctcttcctttgtagacattataaactggatctttcctgtccttgcttttttctcatcaataggcacatgaagtttaacatactctggacacagtaagtaatcaggtaatgaaaataaatttaatcctctctttaaaaatgtacaggaatcataaaacctttaaaattatgggttttctagcactttatgtatgtatttgtatttacaaatgtccttgctcttcaagttataaaaacttaagagagatttaactaagaagcaagaaatgattgtccttttgaatacctggaaatgtttttacaatatgaaacacaattcctttactacattgaagcatcttatcgaagcaccttgtgaagctgtgcaaatagaggccagtcacaaaggaaatctactgacgactaaattctcagcaatccgaaatggcagcatcagaggtctcctaaggaaacaactaaaccatttgtttctgtttaaaaaacaaacaacaacaacaacaaaaactctcactaccaggagaatgaatctttcagctttcagtcatgcctaaggcaaaattcattttctctttttcttcttctaaggttaaactacataaactctctctcacacccacccatgcatacagacacacttccctaaatttaaactgtaggttgttctgaggaaatcaacttttcctgctgtcatgctaccagatttctaatttgagaaactatatatgtatatatgtgatcatctcacaaattaaagagaacttagaaggccacacaaaagtattcaagcaactcaaccctctgtttcctcttttaaccttttctgcaaaagaagttgaatcccaggagtatttttgaatttaaaagggcaatggagggtgacagaaatgattggccctcaggctgttataattctctattcatcagggactgtggtctttttctcttccagctccaggcgaggacacacctaggatgcctgggaaaagtgaaggctccagtgacctagaaaatactccaggtcctgatggtaaggttctgagctattggagcccatggaaactacaaatctggcatattttctatgtgtaatctaggattaagggaactatctgttctataaagcaacatatttggttagaacacagtaaatttcaaaaacaattttgtgctacaaactaataaaaatggcaacctcttatttaaaaaaaaaacctgtttctagctgttttaaaacagcatatgtcctggtttaatcatatcttataatactgaggactcaatagatactttcaagactaaactgaactgaagtctatctagtgaactttatggaagcattacttacttctgcaaaaggtacttagcctacttagcctcctgttaccctgctccactcagcattcgggagagccctacctttggtgtgggctaagattgttcttgtaccttcatcacttcactccactgtatcacatccattgccttggttaaaaacatagtgagtctttaaaagcaccttaaaaataaattttcaaacaacctttaaaaacttacatctaattttgtaggcatctaaagagtctgagcctcaggaatattaatatcccttttcccctgcacaaagatgctaagggccctttgaaataccattacttacattagagaaacaactatttaagcctacctaatgtaataagtatttgattccactggcccatagagtttaggagaaccagaattggttaggtggtcagtcatttaagtatcttgccatttgggttattttagccaaaggaaaaaaacaaattactttgagttgataatgaccttggaaaaaatttagccaatggtggatgttatttatagttttaaatagaatttcctataccaggtattccttgttcccaccggcttatcatcacctgaattgccttccttaattataagcccatcggcttatattgcccaaattggctttttactcatgggcatgcattgcctgtgagaacaatgtttttaagccccagacccatcccttaagagccactgcttgttagttatgagcagttgaactaaacctgcttcagcttggttgtgatgctacagacatggttcttaactagttatttacaaatcatgttctgaggactatcaggcccatgaataaaagagaagtaaatgtgaaatacggagttttagtcctcacttagagattcaccatacacagcagaggattgcaggccctcagaagtctcagaggtaaagagacatgtttaacaagatttaaagttgcttttcccaaacttatttggtgatgggatgctttttattgtaccatttattagtaggttttagaactagtatcccttggttggaagaagaaacagaaaaggaatactctcctgtattttatcctgcacactcccacactgagaagggtgaactcacaataactttgcagagcaggatggacggtggatgaatgcttatacttacatagggttgctgcatctggggccagtttatttatggggtttaaaatgagttcacacatcattagaaactcagggcagtttgcaggtgagaacactgagacctgcttttaaaaccttccttattgggagagagttcagtggatgccatataaagtcattctctctttcaagcctctttgaagtgtgaaaatcagcatctgccactactttacactaatttcatgtttgtgaaaaaggagatacaggctgttggttttgtgcaaataaatgaaaactgcccaaatgagaacaaacagtggttacttattcaaaggtaactataacaagggtggccattatcacttgtgtttggcaggctcaaaggcgggcaggggatgggaaacccccctttataggttagaaaaagagaatacttcaagcatgctctgattggaggttgttggcctagagaagctggacatggctaactagaagtggggcaccttaagtgattgtattagggaatacatttggccttccctggttggtcccaagttggaagcagaggtaaaaaatagggacgctgacagtcactgaccaagtcctgaccattctgagtcaattgctgcagagactgtgttttggttgcctaggctagcttctgcagaggttttacatcagaattctatcattatatatgatctggccattgtctatttgtatactgattttctcagcttataatgtggactttgatgcttgagaaaatatcaatctaattaaacctactgacccttggaaaatttagagtgagtgctatgcctgctctgggttacttctggagaatggcagtaatcatgcattctatttttattcaaatgctcacatagaatacactgagtcaggtaaaagcacacgttttatcacaactacgggatctggttagatggtcggctttttaatttcatggccgctcactgccactacagcagccgtcggcaagtctacaaggtctgttttgaattcgaaattgaaagtatggcaaaccaaacaggcctgatattgacattttggagcaagctgcttacctctctgcatgtcagtgatgtgctttgctttgccttctctctttattttcttagatatctattaaagcctttgcatttatccaagaatcataatatgtacatccaaactgtcaacccaaaaatctggtctgaagtgacgactcagtttcagttgagggaagaggcaatcctgccctcccacaatgggttaggccttttttgtgttgctataaagaaatacccaagactggataatttagaaagaaaagaggtttgtctcatggttctgcaggctttacaggaagcagggtgccagcatctgcttctgatgaggaactcaggaagcttacaatcatggcgggagaggaagggggagtatgcaactcacatggccagactagaagcaagactagaagcaacgtgtcacacacttttaaacaaccagatctcatatgagctcactcatcactaagaagatggcactaaaccattcatgaaggatacatccctgcaatccaatcacctctcaccaggccccacctccaacattagggattacatttcaacataagatttgaagggggcgtctgaggtatatcctctacccccaccagtaaaaatctacaagaatagtccccaaatcttgaatgaatgaaaacaaatggaaaagaggcatcaaataggaaatcaggaaagtatcaaatcatgggtcattttaatgtgtctcagagatttaggtttaatgaatatttaactttttttttttttctggtgacagttgaaatgaatagtcaggttgacaaggtaaatgacccaacagagagtcaacaagaagatcaactaataggtaagatgccccttgtggtgagattttcaatgatcaaccagccataagaactatttgcaaatgacatactggatttcccttggttttgccaagtccccacagcatggcttgggataaaccttgaaaatctttaaaccaaataacacagcgtaaggggaaacgatcacccctagaagcttgccatcttgaagaggaaaagatgagctacagcacattcaaatcatgtataccctggttttctgtgctttgacaagtaaaaaatgtctccatccatctcaccccctggcctcctggagtggtcaaattatttcagaaactccaagctgattctgaagcattgcttttctagaagctacctgctgagttgcttggtatatctgtctttaagcataacactcaatctttgccctggagtttgtataaaggaatatgagtgtgtttggacagaaacaagcctgccttaggtcctgtttttttcacaccactacctgtggacccgtgcgtctgcacaaaggtttgttatgttgaatgagcttcagggaactcccaggaaaataaaaagcctgggtttgttacgttgaatgagcttcagggaactcccaggaaaataaaaagcctggtccagatcatgtttaggagtttttccagaccaacattctaaatctctcagtagagactaaaatatatttagaatgatgagtgtaactgagtccaaagccagtactgcttgcttcatggcagccaatacatcaagagacaacgtgttgaggcaaggaaaatgactttattccaagagccagcaaaccaagaagatggcaaattaatgtcctaaagaatcaccctaaatttatagaattttaggctccttttctctttgaggaaaaggaacagagaggtggttgagatcaagaggtgacagacatctggactgcagcaagggttcaagggggagttgtgaaacgtctttgcccttggtcaggtcacattgctcctataaatctttaacataatgttgttacttgtgtgcatactgtctttatctcttcggtggttagttttgggaaggaactattgtcatctttgctttaaagttgaactataaagtaaattcctgccgtagttagctcaccctgcatgaagagatgagcaaaagcaatcaacctaaaagatatcactggacgggggcagcggggagcaaaatggagctagtcatgctaagcctcctttacactgctacctgagtggtctataatcctcttccataccctgagggctgatgagaagaattagaagaaggaaattatgcttgatgttataactgttccaagttctggtttaaaatatttagttgttaaaaaaaaaagaaaaaaacctatggaataaatgaatcatgggtcatctagtgtaaggcacaaataatgtgttgacacccttgccccctgtacctccttgcactcactgcatgttcttgatggttctctacactttcctaagaggcttggctttaccactcttgtgctccagcatcatggaagaataaaatatgggaatgtgtgaaagagtacatgtcttattcctgtatggtcttgaatatcctataaaactaaatgtaatggtatctgtgtaatgcatgtatagcataagactgctaaaaagtataagctcatacaaacatgttcttataaacatttctcctttttttttttactttctttatatatttaaaataccctgctaagctgcagaaatgatacggttgaggagtttccattaaaaagtaatgaaatgagactaaacttgaacaatttaaatgcaagctcctcagtgtttcctttccttttacccttttgctgccaataaactataggcttcttgtctagacttttttcttacagacattatttctttcctgtgtgaccagtgtccagatgaagtgccaggattagtctgtttttcttggttaatatcaaaatgatatttttcttgaaaataaaaatgaactcatatgttaacccaaatgaatcaggtgtcaaaactttttttttttttttttttttttgagacagagtctcactctgtcacccgggctacagtgtagtggcacgatcttggcttactgcaaacttcacctccctgtttcaagggattctcatgcctctgcctcctgagtagctgggattacagtcgcgtaccaccacaactggctaattttttgtatttttaatagagatagggtttcaccatgttggccaggctggtcttgaattcctgatctcaagtgatctacttgcctcggcctcccaaagtgctgggattaaaggccaggtatcaaaacttaaagtccaaaattagtttaaggaaactaaattccaggaaggagaagtgacatgcacagggtcacctggctaataaatggaaatttaaatactccaattcaaaattctgctccctaagcaatagcaagtttctggacacagttgtcacagaggcagaatgaatgatttgtgcaacgtcactgactcccacagcaatatttacacagaagggtttgttaagatgatctggtcgtttgacagaaagaaggaacccttgctccatgaatcataccttcaaggaaattaaagaaatacagtgaaatagaattagagagctcaaagacataatacaagaatgtttggcgttgtataatttgtaattgtaaaaaatcagggatagcataaggatacaacagggagagggttaaatgcatcagtggaacactttccaaatgtaaatgttttccaacaagtatttgagggcagtaatgatggttatggaatctgaacctttggttctggagaaacatggcagactgagtgtggcttctaggttgagctttaagaggcttgtaacttccgtttttgcactctcgtaatgctcgttgcctggaatccagacaccttggaagaagcccaggttatcctatagaatgaaggaggtcacatggagaaaagtcctagaaaatgagaatccctttcagatgttctggccccagcaggtaccaccctcaagcagatgaactgtcctgctcagtccaggccagatggtaaaatcatgagaaatagtgaatcactcatgttataagccactaaatttggggctttagattgttgatacagagacaggccttatggccacagtcttgcattttaatgcccaccttggaccttgaaccattcaacgtaaggagttggaactgatacctctgcataaataaatctaggacttctagctcaagaaattaatagaaagacttggatctgcgccaggtactgcatggggagagaaaaaggctcccaagatagatagaaaccgcaaatacactgtgagtttgaaacataattttatgtgatccaaagtcatgcagtaataaacaaattgaaaaatgaacttaataattgattacagaccagtgtgattcctggtgtatgtggcaaatggaaatatgaaactaccccatggaatttctgcaaaagaaaaacaaattctgaagttgaattcatagttttaagacttacagaacacacaaggaaatgatccattttgagtgagagtcagtaggtaaaattacaggacaattagcactatgagaacgttaagagagtaggaaattttgaagattttataaaataactacatttgaatgacaaaacaaataaaagcagacctaaaacaataagaaaagagcaacactaaataattaacgacaatagaaaaaacaaattaaaatgtagtagtatcaaagacacgtgaagagacatgaaggagaagaagagaataaccaagacatgttaagttcaataagagttctacaaggagactaggcagtgtagggctgtgtatttgattgatacccaccaagcatctccaggtttaacttaatttggactgagattactgaaaaccagggaccgcagatataaaatacagaaccacaaggaaatcccaccacgatcccactagtattgaattataaagttaacaccaccaaatgttacagaggatgtggaggagctagaactcttatacatggctgggggacatataaaatggttcagccacttttaaaaaattgttagtttcttgtaaagtatgtatccatcctatggccccacaattctgttcccgagtatttgagagaaatgaaaacctatattcacaaaagccttgtacaagaatacacatagcagatatgctcacaaaagccccaaacttgacacaacacaaatgtctcgcagcaagaaaatgaactttaaaaagtgacatatacatacatgggaattctagttagcaatgaagaggaacagattactgttaacaaagcagcaacatgaatgaatctcagaagcattacactgagtgaaaggagacagacacaatgaggtacttgtatgattccattagcagggagtcctagggcagaaaaaaactaatttatggagatagaaatcagatcatttgttcattccagcaggagtggggtagtagggaagggaactttccagggtgatgtcatgtatatcttcttggtggtgtgggtttaatgtatgcatttttcaaaacagattgaaatgtatgcttaagatctgtgtgttttcctgtaggcagattatacctcaattttaaaaatctaaaaaaaataaagagtataggtttttgcaaggcacagtgtcttcttagtgtcctctcatgggtagtgaataaggcagataatttaataagtacaatctgaagtggtggcataaccatcaatgacttttgcaaagcagcattatgaaaattgttattatttatatgctgatccctggaaactagagtgtgagcatgggcctgaaaagggaagccacatcaactcagggttacagttttcaacgaatactttgaagaattgagttaatcgtccccatcagccaaagctcgttgtcaatgtggcatacatttattaacagtgatttatatgctctttaaagataccatgtgccagcaattacagttcagacatctaaagctctttgatagtcaaataagatatttctgggcctatgtgaggggtgagagacatttaaatggctgtattaaaaatgtattccttgctaagcctgtgaagatgtcttatctttaatctaacaaatggcttctctttgtcttcagcaggggcacaagatgaagcgaaggaacaaagaaatggaactaaatgacaatcctcagcatcgcaaggcctctcctggctctgggggagctcgggaagatagcagcacacgctgtggaggagggtgggggtggggggaaggcaagtcccatggaaggacggggaatcctttactctaatttctccagctgcattttgttccgtttatctgcagaaaaagaaagaaaaaaaagaaaaaaaaagtttcctttaatttggtggagggacccatgttgacgcatctttcaggcattatccttgtaatttctgtcttttctcttacaactttgccccagggtcacagtggcttgattgaacactcacatgtgtatcctggcccctgtctgctttcttggttatttcacaaagctggtcacacagtggtttattcaaaggaaggggaggaagacagtggtttgataagctgcaggataaattttaggaatcaatgagcccagcagcagtataatccccagacagaggaggcaggatagaaaatgggcaaaagcctcggaaaccacttggaaaaggtctggacaatgaggtgaaaatattttcttcagggttcccaaggcacaatttgttccaagtggctaatgagaaatatggaagctgaattttttccagagcagagtgcagaggcataacagaagggtgggccctggcagccatctgggtctcttccttcctaaccatggtggcaggtgcatccttctttgacactgactttcagcagagcttacttggttcatgaggtcttcacatggagactaccagcaagaggtgactctctgctgcataactgtaaaggatggccctttgctaggtgttacagttaaaagctaagaaaaggggcagtgcatttaggacccaaacatatgcctatgaatatcaaaagctcctcctgaaattgctgtgagttttccataaaagaatatcctgtcttcacccaaggcttgacagcccacagagtggtctcatttgaaattacaggaaattagagcttttgcttgcagttctgccttcctggcctgtgtttaaatgctgtcacttgtttatgccaagttcaaggctgattcaatggttggtcccctcacccagaaaaccctgaaggggaggatacagctctgaaggggggcagcagtactaaaaacccaagatgccagtggtatagtgggcacaagggatggcgaccatgaggatgccaggcatcatcaccaatatctatcctagagccagtataaggccagatgcctacttcccacagcctccccgggttccaaagtcatgtcattgttttcagtggaaacatatcgtttgttgcatatcttcttaaatccatcttccttgtaagggctttagaactaaaacttacttatattgtttttccttaacagagggagaaaaatagtggattattatttctaaaataaaaggatgttctgctttctaaatatcccatcaaaatcttcagttttgcacttttttgatggaaaattcatcttatcttcctatgactttggttttagcctttctgaatttgttaccccttctggatggcttatttgatatactggaatagttaacaagctatacttcagcatatgcactatattctaacaaattttttttaataaaatcaagacatcagcaagaatgacatttacgtgacctcataatgtgggattatggccttctgttgctattccagtttgatatggaagcatctatatcctctattgccgttagatgttgttgcttttcagaaaagtaacgaaaaggctcattttaaagaatccaagaaacgatgtcatccaaatattgacagtttctacatttcatgccatctttataactcaattgaaagttgccgtcattcttgtgaagtatttgacaagtgcaatctgctagaagctcgtttttcttgtgactcccaaatgttagtgctacttagcctcagtaatgagttacagttgaaaaaaacatgagggaaacagagggacagagattttctaatgaacaatgatggaagagacctaatgtccttgctagaaacagccaggatggaaattatccagccctggcattctccttatcatcaatgacagtcattttattcatttatttcaaatgtgggtgggctagaagtggaaggagggaattctctctgcctaaaaattctagaagaatgaaagtaatctttgtatccaggaaactaagagaatgaggaataaatatcttcagcccgactcctgaatttgtttattcttccatctataattagattgtgttttcatttttgctttgtcatgctttttggttgttatttggctatacagttttatgctttaaaacaaatgataaagttaatttccaattcaatagtgaaatattaacaatctaactatagccagatcaaagacacctgaacacagaaaacctttatttgctggtgctgccattgcacaggctgtacaatgaaatagatttgaaaagctgattgattttcccgcacataaattctggatgtcaatttccaaccaaactccaatacagctatgtggcatgaagagttacaggagggagggaggaaaatagccctatgttagtcatgtttgcatacagaggatcaaagtaggccttcaccataatagttctaattaaaatggtcctcgctgtaggagagacaaaggggcttttcctctagctggtaactattcagatgatggacaagtcttctttcataaaagattacaaagaaggcatccgaatcactgtctgtgatactgggtcacatattaatcactgcagctaattgtaaatctttctatgaaacactgaaaagcctctttgtgaattaatacagttctgcttgatgcacttgatttgaaaagacatttctctgtatgtggcgcatgtcggctttgctttgaaaaataacaaagttagcagaatatgttcaatatattttcttggggaatagggtttttattacatgattcattaaggatttgccttaccctgacatttgtgatataaaggaaaatcagaaaaaaagtaattttcttgatcaagatatgtttttacttaatgcaaataaatgtagtctgttgcttgcaaggaaaaaaaaatggcttctgatatctggtataaactgctaaataggataatacgtgcctcttttgttaaaccggcatttaaatgctggactgcttctaaatctgtttgtttcttttcatctgtgccatacactaaaaaacaactgttgccttcatactatatttgttagagcagaatacaaataaaatttgtttgagaggataatgtgaa
